United States Patent 11,549,145 (METHODS AND COMPOSITIONS FOR INHIBITING AND TREATING NEUROLOGICAL CONDITIONS) - sequence listing, part 65

SEQ ID NO: 1437 - DNA, 482516 bp, Homo sapiens
atgtctgcaagcgctcagcggcgccggcagcagcggggctagagctgggctgcgtcaggctgagcccattcacctcgcggccacaggagctcagcgccggcgccgcgccgcccagccccgccgagaggggcgcactcgccgccgcggggcccgccgccgctcaccgcagccccctcctggcgacccgcaagtaagtttgtgaggctgctgggcgttagggcgagggcttggcgcccgggggagtccaggagggatagcgagaggcgcggctggcgcccgggagagccggctggcctctgccccctgtgcctggcgcctctccgagccacttagccaatttgaaagcgggtggccattgggatgctcgagcggggacgacgggcagagcaggagggcagaactagctccagcgggggcccagagggcggacttgggaagaaggaaagaccgcgcggcgagggaggagaccgggcggcgagggaggagaccgggcggggaggctgggtttggggcgcgggagcccggccagggacagccgcagaaggaaagtgggggtgtcgccgggggatagagtgggagcagcgtgagagcagtgttgggggcgcagagtggagggcaagcgtgtcttgaacagaacggcaggaggatgggtggaaagtggggcgcgtggaaagcggatttggacgagagcaaaggacgccggtggaagggacagtgggctccggaggggcgagtggattcggataatttggggaatcagtaaaaggctagggggcacatcatgatggagtcagcctggaatctgtctcccgctagagtacccgaggccacatgttgggaactggctggggaaaggatggatgtagaaagtggcctggagggccgactggaaaatcgctgagggatttgggtgaagagggggggagctgtgcagtatcgggcggaggaactgggctgctggtagggcctgaaaggttcaggagagggttggaggcttccccgtgccgccccttgaatagtgatttagtactgttatctgaggttcactttcacccctggctcctcctccgtctactacccggcttggacgcacctcggctcgctgtaggcgagctttaggagatttaaatagacattaggcagtggggaaggtagtcgtttacggggggagctgctcgggcttccgttcagtggttcccggcacgctcagggtgcagtgtagggtctgaatgtgtgtattgcgggggtagggggagtggtgtcagttctaggccacaggaattcgtggtctggccccagaggtgcggtgtttttggccgggaagtcaggcagaagtctgcagcgtgcaactcgcagcggggcgtgtgtgtgcgtgtgtgcgcgcgcgtgtgcatgtttccggcccggggtcgcgtgtgtggctgcagcctgtctccgtgacaagaagatccagggatctacgggcggcacggggaagggattaaggggaacatacttccctacgtcttttctgcctccttttcccagggtagcattctttgcttatccaatgatgcctctttctaacctctccctctccacttacatcccaaacctgatgcgggtcttctctgattcggcactctaaggaggactcagccgccggctgcgaccaccgtggactccctctatggaagggaatcctgggagtcccggccgtcagaggggttcccaaatccaaagggtccatctccaaggcgtcactccaggggtccgcggttcactttgctgccccttgcaggtgatgctgtgattgttgcctgcggactgggaagcacgatggctccaaaaggccagcggggccgagaagcagggacagagaccagcatttaagggatctctggtgggggcctccctggagttctccacatgtaaatatagcgaaaaaagaaaacactacgttactagaataaacacgtcctaaaatttctgtgcaaaaacacctttttgaacagcaaagatttcacccaccaaaacaaggaagcaagaagcttccacagtgtgcaggatccgaaacaggaccggcccggcgttgggtgagagtgggggaggggttgtcggcttctccatccagcttgccatgttctgtcgtcggtttcacattttcagagagactttaccagatgcaggaaatgaggatgaaggcaactctggaaggatgcaaagaagggagagcaagcactgtacctactgtctgctgtctaagagggctggtctcataactaaaaggtccagtccctgagatcttgtgtgcaaccgtcagaaatagttcaggacatcaaattgcacagagaagattcagatgaagggaaacaagaactctgtggaaaactgttggggacagtggcacgagttgtcttgcaaggtgatgtctgtcccgtggagggacacaagagcgaggacagcatggttctaatggccagggcatgtcttcttattccatgtgacagtggctggctgagttgctagtacgtttttgaaatataccctttgaaatatgttgattattctggacatctgtaaggtgggagatttgaataaaaagacttctgctgtcattattggcttttatggctatgatttttttcagtcattattataaatcatgtgaaggtaaaataaatgatcattttagccattctgttctgcacagaatgctgttcaaataaaacatcatctgatatgtttgcctgtattgttttgtttgggggtcacggaagagggaaagtcggccaaattgattagggtatcatataaaagcagagattaggtccgggtagatcttttgagtgtgtgcaggaaaaggcttcattatagaatgctaaatttaatgtgagatgagagaatcttttactcccgatctcctgcatttgaaatacaaaggattgtacccttgggctggttcctggtccttaagtggaagcctaactggacactttttttctggaggattgttccctaaatcctgggaagctttagaaaatagtcaatggaatttttgttgccctaagataaagtcattacaaagaaaaaaaaaaaagaagaagaagaagaaagtaaaggtggtgaaatggcttgaggaggcagaatgagaaatagagatgtcagtcaaagtggaagaagagaaatcactttctctcactttagggatagatcttgttgataggcttagagcagtgattctccactgggggcagttttaccccctaggggatactgacaatgtctggagacatttttggttgtcacaactttgggggagaggtgctgctggtgtcttgtgggccaggccagggatgctgtgaacattctacaataaactggacagccttctgcaattatccagcccaaatgtcagtaatgcttaatttgagaaacttggctttcaataagatgtgcttaacattaaaagcaaccccttttaggatactttcaaatattcctattggaagtccatcttgaaaatcaagagtagttaataagagactttctttgcaaaatggtccatattcaaaaacacttgttttaaggaaattaaagaggcttccttttggcagaactgtttttcagcctttaaaaaacaaacaaacaaaaaatcttaagacatattgagaatttctaaaaggtgaatcatatgcatatgtgcatgtgagctaagtaaacattgtttgataaaaccaaatcagaactattctgctgtactaatttcactgaacttgtttggtaattgctttttaaaagcgataatcttaatttttaattcaaatgaatttaattaaaattacaacttgtaagttctttatcaagtgagggattgaacaatcagagaaaaatgttagacaaatatttatttgaaacaccccaaaatattccaaaatgaaatcttagtatttataggtatctacatagaaaggtaagaatgtcgtataattttctcgtattgtatttaatttccatttgaaatcgacagcatggagcgtattgagaagcatcaagcctttcgattccgtagcacaatacgttgcctagaaaggaggaacaataccttacactcataaatgtaataagatactgttctaatatcccctgcatgcaggagctcagagcacttattaggtaaaagccttgtcattagcacaatgaagcctagtgaaactaaaatttggtcgttgtatctaccccctcttctgtctcaccattccacccatttttgttattggtttgtttcagaattcattctgaaggtatcatcattagggttgcttacttcctttcttgttctaataactattccaatcacccttacctattactgtccctcagggatttgtgtcgcagcagacttgatactcctgctaagactctggggcacccagcaacgccaccccccccccgaccccgccctttctcctgtgcatacaaacacaaacagctcttttctgcttctaggtggaatggggatttgtacctgtcttggaaaaaggcagtggggagagcctttgtttttcacaaaggcaacctcagtttctctgcttctatatttactgaattggtttgttcaattgcatattcttgctattagagaggcttcctctttcccaagggaatagtgaaagacctgaggaaaagatgacttcagtgtaagcaacactggtactgatagaatgcacctgtcattggactacgtgaaaacccaataaatatggtttgaaccagtgataatcatatttgtaaattcaataagcatttgtaaactcagcagtagcaggttctgttctagacactgggactcttgcacttgcaatacccagatatatctctaaaagtatctgtacaaagaaacataagatgggcattcattttcattgaatttggagcaattatagagatatttcccgattgttgaaaagacttcagaacataattggtgagatgcagaaggcagaagaaatcattaaagggaaaacagttacatggatttctgtacagcctagacaaggaagaaatgagaaatttgaggtgaaaggggtcagttcttgtctcccttttcctttccttagcaaatgattattgattttgtttgacatctgagcaaggagaggtggtttccttccctgcagatacttgttgaatggatgtgtgcccttttgcacttctgatagccacagtggtagaagacaatgggctggctggcactggtagttagaggaagcagaatttcaaatcagttttgttctaatggtgtttgcagcaaaggctctaaccacacactttcaaagactgaacattctgtgtcactattttggggggattaatataaagactacagaactgagcatttttgttattttgggtactagggaatacctatgctttaaagtatacttgtttggagaaaccatatttatttgggggaaaaggaaatattgataagatggcagctccatttacctaaaaacaaacttgctgcttactctggcatgtcaattattgtgccagctggaaggagggtcatgtgagaattttatcaaacaccttatgttgttcttgttgaattcaggagcaacaacaaacacacacacacacacagagcaagattttgaaatttatgctgtagcaaaggcaaagagaatatctttttttaaaatttcattttatcttataattgttaaagataagtaatagcaatgcaggaaaaaggcaaccttgtttgtggaaggttttacttttgtttacaaatgcttattcatcttaagaaaaaaaatagcctggaacatttccccaggctttcagtcttctttataaatagtgtatctcttctatctctggattattcattatgtgatgccgtttggaatctgaatcctgggctcagatggctgatgtggttccttctgattttgtcattcagaattgtctctatcctcctaaagaaggtgaaagagacatgctgtttgtcattgggggcacagtaataggtgcaggctgtagtctgttttacagaattacatgcatgttgcttgaccttggtctgggaccccactgaccaaaacactgaactcagccttctggatcatgaagcctggtttttgcaattttgatttgaacaacagtgttttgaccaggtttgacaatcaactgatgtgtttggaaaagactgactgatgagccagaatactaaccacccatttacaaggaaagaggcacagacatttagggaagatcaagagctttgcagtcaaatctggcactcctgcttagtagtttgtgactttagatgagcttaactttatggaacttttatttcttcatctttaaaatgaagataattatgaagtgatttgcctgaggtcagtagtcactctgcatcatttcagcttagtttacagttttcaaaatctccatccaaacctctttctcaagagcatgcttattttcttggttaaatccatgtttcttctgtttatttaaaaatgctcaagaaccgatatttagctcaagagcttctcctttcagctgttagattctgttagaggcaaaaaaaaaaaaaaaaaaaggtaactgatgggtctctaattatgttcaattcaggtattcacctaaattgtcaaaaagattaaacgcctttttattttttcctaattgggatgaaaataagtagagctttaggtaaagatttctaaaaccaaacaaaaccatatgcataatgtctttcaactaggatgtattttttgatgatcagaaaattgaagattggcccttgctgataattctgttattaagtttatagatgtttttataccagtttagtgttgttgccattatggtttattgaagcatttcagattcaataaaaatctgaaaacctgttgtatgttgttcattgtaaaataaataatgtatgtattcttatttgtaatttatggtgactgatatgcatatgatcaattggaataatgaaagagttaaaattggaaaccagaacagatggaaactttgaaagaacattctctttagcaccacccaagtttgtattcaaatctctgttcctcagttattagctacaaaaaaattgggcaaattactttctaccttactactttttaagaatcatatccaccggattataggttatgattcctgtgatgattcggtgacataagcaagtaaagatgctagcatgatgtctggcaccctctttgtccttgtactctgctaattccaccacacttcagctgtgcccttgcaagtgatcatttatgcttgaattagttccaactgttttactctcaagaatcataaagcctgatctcaagtttcttgaggaaaaaaaagagagacatgattcatgactgtgtaagtggagccgggagctctatgtgactctaagcaggacctgattcagggctcacacccatgtgaccagttgcactgcagtttccattgcaatttcttagctcctcttccttaatcttggctatgtccttgacaggcttactcttcagggttctaagatggctgccagaagctttcagagcttcatgttcccaggttcaaacctagtgaagaggacagtctcttcctgtaccttttacagatgaaagaggaagctgctgttcctagaaattccagcaaatatccctggtcaggtcaagagccctccaccagtcatagtggctggaaaggtggaatatactggttgaggaagtgtgttttcccatagaaaattgagggattgctgtttgtatgctgattgtatgctagcacaataagaagccaccacagcatttatgttactgtttggccccaaagaaaaatgttagagccatggttttatttcatctgggtcatggttaaagtctagaggattctttctgtaccattactgaatatgtgtttccaatgattgatctgaattttcaagattaatgacagcagtgcccattagctctcttccttcaatctacatcattagactggctgggtacacactagaatttatgttttgctacaaacaactgttcaaggaacaaattaatatattttcttacattagatactaggtagtagaatcactgttttctgataaaagtcaggagctgtcatcatgtaaattgttaatctaacatcccgtgatttattcctttgttcctggcttaccttactaacctctggtccttcatctacataccaaattacactttacaggaaggctactaagatttatgtacaaacaagtcttagtatctacaaacatgggcaactaaaaaaaaaatccagaaaggttaacttgttaaatgtatattaaaaaaaaaaattctacatcatccattagggctgttgaatgcagtctcttaaatgcagtcattttctaagataaaatgtgatcttacttttttaattaacatattaatggactaaggatgctttctctcatttatttttcaccctttgcgtagatcacagtgactggatgtcatacatcacatattaagcagaagaatgttaacagccatgataaatggctttgagtgaaaaatattttcttctgttttcattcatccaatggtttagtcacataaataaatgtaagtgccttattttaaaatgtcttaaaatgggaaaataaaatcacatatctttgcatttttaaagttagtagctttcaggctactataaaatgtagtctgcttgtggtaagtatgtcagtgtagcaattggtttttccatatgtagtttccaacatgggaggtgggggagatactttagcacaatgcagttcaaaaattaaaaaccacagaaatgaaccagactttcattttctgttatatctatttaggttcttaaattcttaagaagactaaagaagttgaaaggtattctttcacacgactaaagtatcattgaagtgagatttttacctctttgccagcatgtttttaaatttccaatcagcagttacattggtgggtgtataacagagaaagcataaagtcatgtgaatgtttcagatacagtttttaattatctgaaatatgaaatgaacaactaagaagaaaaaattaccattctggcatggtaaaaatattctgtaattttaagaaatacctagagagaaatcattttaacatagcctttaaggcatagctgttgattatatactgtattaagagttttgtgtttgagtatcatgcacacattatgtttgttcctaaatattatgggtaaggttttctttggtattgcagtttttaaattatttttgctgtctaatgggactgaaaataaaaggtttttagtagcttaattagaaactatgcacttttaaaaagttttccatcaactgcctcttctgactgaagcacagagatttgcaaaaacagtaatagatacattatagataactacatagaaaagctctgaactaatcatttagattactttgtggaagggaatggagtaaggctgaaatttcactggaacttactaatagtagtaagtccaaataaggtaaatcttaaaacaaaacagaacaaaactcaaagttatgatgttgtaacttatcagagttccttcactgacttcaatagaagtgtattctattcagattaagcagaaaggaatccattggatggttatggaggagttcatggaattgaaggaaattctgaagagcaggaccttggacaggataatatcccagtgctggaatggatcagctctagctattttccatcattgtgtcactgtcctcaagactcagcatttagaaaggacagagagagagagagagagacagagtttgggggaagaataggccattttgaccaatagtcctaaagcataatctataatctgttactactggaagaggggaataaatgataatgtgcctgctgggcaggcacattagactgatgtccattcaggatgcagaaacttgttttagtgatcatgaattactagaaagagaaaaggaaaaccaaaacccttgagtgtattatctcaacaatgtctatatggtaaacagaaatactgttttcatttcctaaggctacataacaaactaccacaaactgggtagcttaaaacaacagaaatgtattctctcacagttctagaggctagaagtctaaaggtgttgacacggccattcgggctttggaggctgtatggggaaaatctgcttcatgcctttctcttagcttctagttttgctggccgtccctggcatttgttggtttatagactcatcacaccaccagtctccatcttcatcatctcatggctttctcttctgtgtctctgactcaaattcatagagacagaaagtagaatggtgtttgcaaggggatgggtgatgggggcatagggagtcagtgtttaatgggtacagagtttcagtctgaaaggtgaaaagactactggagatgggtggtggtgatggttgcacaacggtttgaaggtactggatgtcactgaagtgtgcacttaaaaacggttcacatggtaaatgtaatatcgtgtattttaccacaattaaaaaaaattaaacatgtaaaaagtgaagaagaagaaattagtgaaaatttctaattcttaaaaatcaagtgagggccagtaggatagttgagagtaactgggagcctcagacacaagggaaatctgtgctcatccatgagttctttcccagggacctttacttagtacttatcagaaattttggggacagagaagttgaccagagaaagccccctttggttccacaggtgtgcaggtactgagaccctgcccttaggaacaggcacaaaatcccacataccaccccagatttttctctcatgtgaaaagccttacacaactaggggaagggcagaaactatagggcccacggttctgcgcttatccaaagcagaggtctgcaagccatatagagcatagtttggtgccacatgaagagggaggggcagaaaagttgtggaaaagccagcccaaggcccaggtccatggggcctaagactaaggttggactcagagaactcaaaagtttacagcagctgcgttcataattgctccaaattggaaataacccagatgtctgtcagttgaggaatggataaacaaatagtcatggattccacagaatagaattttacttggcaatagaaaggaatagagggaattttatagacctcaccactgtaccggtgatcactgaggataaccactgggacaggagccatgaaagtttcatgaaaacgttcggacaatgtaaatgtttggaagtagattaagacagttatatgccaggtgcggtggctcacgcctgtaatcccaggactttgggaggccaaagtgggtggaacacgagtcaggaatttgagaccagcctggccaagatggtgaaaccccgtgtttactaaaaatataaaaattagccgggtgcactggcgcacgcctgtagtcccagctacatgggaggctgagagaggagaatcgcttgaacttgggaggtggaggttgcagtaagcagagatcgtgccactgcactctaccctgggtgacagagcaagactctatctcaaaaaaaaaaaaaaaaaaaaaaaagacacttatatagaaagcaggagtacttagaagggctgattataaggggagaatataaggccaggaatgagggaccataatttttcagtgagaaaaataccctatatacaatctgaattttttcattatcatacataaaatactactgatttatatgctatattctatttttaaaactcaaacccatttatcaatatatatacaactttccccctaccccaaacttatgtcaagttaatcatagtctccaagtttaaatgattttaaaattaatctaaaatctttctaaaataggtggttttaacctgtagctcactgacatggatagaattcagttaattcacaaacctggacagagaaaatgacatctttattgttacctctaattggaatttggcatattcattaattatgggtgtgggtcagaaaccacataagtaattagcagtacctgtcactttgtcaccagtagaagtcacagagaatatatcacattacagctgtttgcagatattttgaaaaaccatttatgctcatcacaactttgaaaatatgattattagacctgctgttagaactttttatttcaagtatagttgactcgaacaatatgagagttaatggtgctgacctgccccacagttgaaaatacacatataacattcgacccctcaaaaacttaactactaatagcctactattgaccagaagccttaccaataacatggctattgtgtgtgtgatatgtattatatactgtattcttaaaagaaagtaaactagagaaaagaaaatgctattaagaaaattataaggaagataacatatgtttatacattaagtggaagtgaataatcataaaggtctttatccttatcctcttcacacagagtaggctgagaaggaggagaaagaagagggacttgtcttgctttcttggggtggcagagatggaagaaaattcacttataaatgggcccatacagttcaaacctgtgttgtccaagggtcaactgtattaataaagaaacacatagactgtgtcagaaattcattcttttaaaatttgataactgtttctcattgcatttagtttcatttgaaatcctatgtatctcatttttagaatgtattataggttttacagactcccagagggattcgtagatgaagaacctaaaatctttctttgattcctcccagtagtaagttctattcagtgtgaacactggtgtggtccagaaagccagaactattgagggtgttctgtccacgcttgtgcttgatctgccagatgtcagctatgcaattccataggaaacactggttctagcaggtttcatgccatttgctgagttagcacgtttctgagcatctgtagattctctgtgggctttctacagggcttttcctatgtggagcaacgcagtcttagaattaagtgccatgtacaacccattgtaacctttcctatcaggaggcctaggctttagaccataccatatgcatgactctggatccctggaaccctagatggagagaggcagctctgaatctgttgggttcaacctcatgtgtctgtggattccagaaggaccgacgtcaaacttccaggcccatagatcagggatatttttctaagttttaatgtggttccctggcaggctgggtatgacttaaatgaacataccatccttgcctagatctatactcttatcttttaaactttatttattctaagggctgtcatgccaaagcatatcatttgagtgacttaaatatcagtggaggtagtagtcaaagggcctccccctgaggagtaggagaattgcttcctcatgagtcgtatttacaattagatacatacccattttaaagctaaacttcctaaccattttaataaagcttatttcttttttgactccctgacaggaagttttggctcttttagggtaaaatctgcttcagtttaacttctgtcattgacctaactcaggtcagtgaaacctcacaattatttaggaatttcctgaagttactaaaatgctcttactgtggccttcctgatgtattcaaggaatgctaatcatagtgacatctgccaaatcaaaatatatttactgggaaacagcagttttaggttgcatgaaacttttttttttaaccctttgaccagcctcttcccaaatgcacagaacatttttctaacaaatgctgaggatccaagtatgtgccaggcactcagccgaacatgggatacaataaggggtaaagcaaacatggcccatgctttcatggagctaatagtataatatttgtgctggggagaggatgtcagttagactacctggaaggtgctctgaaggccaagcagaggcggtcagcaggttgtgctgcagaggaacatgacactgagaatggaggggctgcctagtttgaaggccacttggagctggcggcaggagtagagaggtgttccaggcagaggaaataggttggcacatatgaggacaccaaagatggtcagagtgtctggggcaaggtgagtgtgggaccagatggaggtggagaggtaagccagtgccagataatccagagtcctcttggtgaggctaaggattttggtctttgaagcagggggtgacatgatcaaccatcctttattggcacagacataatgatatctattttccaagagaacagatagtattcagcaaaatcagcatgcctagcaactttttaaaaagtcttctatttaaacataatggacatgatacatataccataatacatatacaacattacaaatatgccttcacctctggatagcaagctttcagtttcagtgctaggattagattacttagtttctctgaggttctgaggggagggaattctaaaccacttgcctttgtcatttgcctttgaagaattgtttgtaaagtttccattataaaaagctattaacattaacctcaatctttttttaaaaaaaaaggctgttaaaattattcagctgtttgcttgctattgccatagcttacttgtttatttgaactttattataaagggctggagatactgttactgtaattgaattgaattgacttgaaaaatagtcccttatagggatggtaatctctagtacatttaaatatatataaaataagttctagggtacatgtgcacaatgtgcaggtttgttacatatgtatacatgtgccatgttggtgtgctgcacccattaactcgtcatttacattaggtatatctcctaatgctatccctccccactgcccccaccccacaacaggccccggtgtgtgatgttctagaaaattttgagtccccatttgattagcaaacatgagccaaagtcatactaaacaattgtgtacatggccctctcagctaatcctctgaattaaaagtccttgcaatctttagatcatttgagtaagaatgtaaaatgcagttttcatttcatgcttatatttttttaaatgagaaaattttgtctgcagagtaattgggcagctctgcctcatttttagtgttaactaccagtggggattaattacttgccagctcattatattattctcatggaaactcagagtttgtttgtggatattttggagtattggacagtaacaagtgtccttccgtttaatgctgccaccctaggtctgtgtgtccccatatgtgcaatttctgaaacgtttcatgtgaagcaaagacagcttgtgctgaaacagctggcctccacctgcacttgggaggctcattattattcaccaggtacttattatctagtaagcagaagacgtaagaagttgcatattgattctgcatcgtgatgcactttcaaagaccccttaaacaaggatattcagaggaggtgactagagcagttgcagagaattatttttctgtgtgtgtggcatctttatacacgacgtcaacaagagccttagagtctgactactatcagaggaccttgttctctagcaggttctgtttttgagactgtacttctgtgaatgtgtgtctttatgcatcattcctttgtggacttccctccttctgggaatgtgtgtctttaatctatgcaacattcctttgtggactgccctcgccccgtaaccacctttttcagtcctgtggtagatgtggggctaatgtgacctatccagccaaataactctcacctctagtctcagtgagttgctcaaggatagattcatggtctaagttggtaaaatgatgaccttattccctgggattttgacagaacactaaaaacatgctgtctttctcatggagcttacaaagctattaggattcttgcctagtgcagctgatgcccatcattgttatccagtggaggaagcctgcctgaaagagaaattagtcaaaacaaaacaaaaagtaaaaaagtacatctagcccattaatcccaccacacctgcagccagtatgatttctgaatatttcagctgcattaacccattatttttcacttctatttaagctaatttaagttagggtttttttttttttttttcaatgaaaagaattaaaacataaatgctgcctaaactgtccctacactgaggtggcagcaggaagggagaggtctgaagatatcatctggtatagatgtaaaaatttctgttgccctgagccaaaaagagtttgtaagtgagaccaaagaaggtggtaacttttctctcctgtttccattttctttaagtagcactggatgttttaacaaaacctgtttacattccgaggttgtagaatcctagtttttctcatatacagaaatgagagactttgtgttgctatgtactacagaaacaaacataaatgagctggatgaatcctagttacagctttgccatttgaaatccatggatacatttatttctcataaatttgcttttagcatgaggtattctaaggtctattgttcaacgaataagatattacaactcccgtaatggtctctaacatgaataacaagattagagggacaatcagtaaaaataataaaagacaaattatcttgtcaattctctatttctagtaactcagcaataaaagccatttatgttctcatttggacattaaatagctagaaaataggagtcagtcatttcggatgcaaaattctgccacagcttcattccatttggtatcgtaggtatcagtttcttacagacatttccttttaaccacaggaaagaaaagatacccaatacggtaataaaaatgagcatttcaaatgtcctgtagacctaaagtagaaagcagaaaaacagaggaactaaaatgacatttctgatataagtttaaaatagaggcttatttctcatgatttctttatgaaaagacgtgtgaaacatgtataaattaggattgttcatggctaaaaggaggtcaggggtattggaggtattattaagattcactttatcttacattgatacttgtcctgtggataataatttctgctaagatgggttataagataagctttttaactaaaaatagaacaaggttactaagctataagaagagataatctgcatattaattcagtgaccagaaaacagtgtcatccaaggtgtggtctgaatggtctccaagtacattatgaaacaccttggttggctcacttccaattagagggaaaagtgcaataaacaccaatttcccacatggcatcatagaatgtactaaggtgtttattatcccttatgatactgcaataggaaaaatagatttctccttcccaggtaatttaatgagaagaacatcccatttcaaaaaaaaaaaaatctgtgcaaaagaaagtagcatgagcataatgaaactctgtgctgtatttaatgaactgatggcttaataaactattgccttggtgacaataaaaagttctgacctttgtatctataagaaatttttctagtaagcaaaattagcattcacatttaaatttggtgtttgcttccaatacttgatttgttattagttcctatttctacaagcctatatagttaacagagcagagctcctctgagctgttccagccagatggaacatttcatagtctcacatgggaagtggctggaatccaaacttctgtgcgatggagtttcctgtgcgtttggatctgtctgcaagttcttctaccaaaaggagtgaggtatgaagcatatcctcttgccatggacacacccatgcagaatgcagaggttgctggatgggacctgtagctgcagcctgaagacagctggccatgaaaacagatggggtccctgggctatgagaatttagtactggcaggtgaagtgtattggaaggtgtgggagcctccttaaattttgtgaaattaagagagagctgggtttgcagaagtccaagtgttgactctgaattcatgaacactgcatgtggaacattgccgacagcctgagcattctgttatttacagtacagactctgatgcaaagaagggactgttccaatgcagaatagcatgaaccacagaggagcaacatcagggcaacaaaagtagaaggaatgtccaaatatttcctatagcctgtcatgaatgtggttctgaccagaattgatcggaattgatttaagaacacctcccttgacaacctaaatatgtgtgtgtatatatatatgtatgtgtgtgtgtgtatatatatatagtgtgtatatatatggtgtgtatatgtatatacacaccatatatatactctctatatatttatatacacatacattatatattaatatatacacacacatactctatctatatttaaatttatgtattaaatatacaaatttatatatttatatattatatatatttatatataaatatatagagagaatatgtatttgtgtgtatatatatgtgtatataaatatatatgtgtacatatatatagtatattcttaagatacctgcataataaactgtgagtcattttcattctgaatttcagggattcacaactcattcattcattcgttctttcattcagcaagtatgtcgattgtgcactctttgccaaacattgggaaaaaagtggtgaataacaccagagaaatccttgttttcacagactctgctttccagtttatagtgacaatcatccaagggacatacctcaaaataataggagacatctatgacgaactcacagccagcatcatactgaatgggcaaaagctggaagcattccccttaagaactgaaataagacaaggatgcccactctaaccactcctattcaacctagtactggaagtcttagccaaagcaatcaggcaagaggaagaaatacaaggcatccaaataggaaaataagttatcaagctatctctcttcgcttctatacctagaaaactccaaagactcttccaaaatactgctagaactgataagctattttaataagttttcagtatacaaaatcaatgtataaaaatcagtaacatttgtatacaccaataatgtccaggctaagagtcaaatcaagatcacaatcccatttacaatagccacaaagaaaggaaatacttaggaacacagctaaccaaggaggtggaagacttctgcaaggagaattacaaaacactgctggaagaaatcagagatgatacaaataaatagaaaaacattcaatgctcatggattggaagaatcaatttcattaaaatggccataccgtctaaagcaatttatagattcaatgctattcctatcaaaccatcaatgtaattcttcccagaattagatcacactacctgatttcaaactatcctacaaagctatagtaaccaaaacaacacggtactggtacaaagacagacacactgatatgggttggctatgtccccacccaaatcccatcttgaattgtagttctcataatccccatgtgtcatgggagtgacccagtgggaagtaactgaatcatcggggctgttacccccatgctgttctcatgatagtgagtgagtgagttccaccagatctgatggttttataagggactttcccctttgactggcacttctccttgctactgccatgtgaagaaggacatgtttgcttccccttccaccatgattgtaagtttcctgaggccttcccagccctgcagaactgggagtcaattaaacctctttccttcttaaattacccagtctcaggtatttcttcatagcagtgtgagaatggactaatacacacatagacgaatggaacagggtaaaaatctcagaaataaagccacacacttaatctgattttctacaaggttggtaaaaacaagcaatagggaaaggactccctattcaataaatggtgcagacataactggctagccatatgcagaataatgaaactggacccttacttttcaccaaatacgataattaactcaagttggattaaaaatttaaatgtaagatctcaagctacaaaaatcctagaagaaaacctaggagatacccttcttgacattagctttggcaaagaatgttttgctaagtcccaaaaagcaattgcaacaaaaccaaaaattgacaagtgggaccgaattaaagagcttctgcatagccaaagaaactatcaataaagtaaacagacaacctatagaatgggagaaaatattcacaaactaagcatccaacaaaggtctaatgtccaaagtctataaggaacttaaatcaatagccaaaaaacaaataaccccattaaaaaatgggcaagggacattcacagacacttctgaaaggaagacttacaaatggccaacacacatatgaaaaaatactcatcatcactaatcagcgtagaaataaataatcaaaaccacaataagataccacccccaaccagtcagaatggctattattaaagtcaaacaagagacgatgctggtgaggctgcagagaaaagggaatgcttatacattgttggtgggaatgtaaattagttcagccatagtgggaagcagtttggagatttctcaaataacctaaaacagagttgccatttgacccactaatcccattgcttggtatatggccaaaagaaaatagatcattctaccaaaaagacacatgcactagtatgttcattgctgggctattcacagtagcaaagacatggaatcaacctaggtgcccattagtggtggattgtatacagaaattatggtacatatacatcatggaatactatgcagccataaaaaaatggaattatgtcctttacagcaacatggatggagatggaggccataatcctaagtgaatgaatgtagaagaccaaatactgcatgttttcacttataaattggagctaaatattgagaacacatgaacctaaacctggaaacaggagacactgtagactactagagggggaaagagaaaggaagatgtgactcaaaaaactacctattgggtattgtgctcactacatgggtgcaacacacccatgtagcaaacttgcatttgtactccagtacctaaaataaaagtacaacaaaaagtctcagtggaaaccattataaatgcaagatttgtattagcattaaattgcatcattcttggaagtaaatataaacaaacaaaacaaaaaaacaagcacatacagcagtctcccacttaactgtagttttccttttcaaggtttctgttaccagtggtcaatcacagtctgaaaatattaaatggaaaattctatacataaatttcattagtttcaaattgcttgtcattctgagtggtatgcatatattagtccattttcacactgctgtgaagaaataccagagactcggtaatttttgaagaaaaggaggtttaatagacacagttccacatggctggggagggctcacaatcatggcagaaggcaaaggagaagcaaaagcatgttttactaggtggcaggcaagagagcatgtgcaggggacatgccctttataaaaccatcagatcttgtgagacttattcactaccatgagaacagcaagggaaaaacccacctccatgattcatttacccccaccccccaacgggtccctcccacaacacgtggggattatgggagctacaattcatgatgagatttggatggggacacagccaaaccatatcaacacgtgatgaaatctgccatcttgctgtggcccaactggggtgtgaatcatccttttgttcagcgtatccatgctatagatcctacccacccatagcctcagttatcatatctattgttgcagtattgtagtgcttgtattcaagtcatccttattttactattcataatggccccaaagcacaagagtagtgatgctggaatttggatatgccaaagagaagctggaaagtgcttcctttaagtgaaaaggtgaaagttctcaacttaataaggaaagggaaactaatcacatgctgaagttgcaaaaatctgcagtaagactaaatttagccaagaaattgtggagaaggaaaacaaaatttgtgttagttttgtggttgcacctcaaaactgcaaaagtgatagccagagtgcgtgatgagtgactagttaagatggaaaaagcattaaatttatggatggaaaccatgaatagaaagatgttctgattgatggcaattgggtttggtactatcctcggtttcaggtatccattggtgggtcttggaatgtattcctctgcagataaagagggactactgtacataataaaagctttgaagaaaacatattctgataatgtgataaagcatgacaagcatgagggttggtgagcagtaatagaaaagagaaggaacatgaagattgacctgagagtagaccaatatctagaggataagaagacagggaggcaccaggaaagggaactgagaaggagcagcctgtgaggtagcgaaaatcaagtaagtagttcttagcaaatgtttatgtcactgaagaatgttaagcccaggagtgacctacctgatcaaatggatgctttcaggaagcttcgccctggttgccaagggggcaggactagagcagggtaagagcagaggcagagaaaccatttaatgggctgttgctgtgacgtgagaagtaaggactgcttggactatgattatagcagtagatgtggtaaaggtagctggatctgggatatatttcaaaggtaatgtgcaaaaaatggtagtacacagaagatttactgatggattcaatattggatgtgagggaaagagaactgggcgatctactttagatcaatgctacagaaaatattcatctgaaattttgctatctggtctgtaacaacatgagaagcttgggccaaaatgtaaatcacatttttttccatggcaagattctttcaaggaaggaagtacattgatttacattctagcacagtcccttatcttgtcgtagactggaaggcacttccagacagcctcatatgcagatcttacattgcagcattgaattagatgaagtcatcagtgaaagccattattaccaagtggtttatccagtcccattcttgaagaattgctgattttgtcattgtacaggagtgtcgtggttgccaacattacttggaactgcacacagataagttataacatactttgtggagcaatgccttcttaaacttttgtgtcttgggttattttgtgctgctataacagaatatctgagactggataatttatgaagaacagaaatttattctctctcatgattcttggaggctggaaagtccaagatcaaggcttcatctggtgagggcctttttactgtatcctcacgtggcagaagacagaagggcaagagagggacaaactctttgtccttacatggcaaaagggcaaaagacagaacccattcctccaagccctttcatagaggcactaatccattcgtgaggttggagctttcatgacctaaacacttcccaaaacaccctgtctcccaacacttttgtattggggataaagcttccaacaaatgaattttgggggacacattcagaccatagcattatgatttctagattttcatatgacagtttaatttttttttttttttttttttggtaagtaggcaaatagaataagctgaggaaaacatttttttttaaaaagtcaattactttgtgtttatgaagtagggtcacagggtatattaggccaatcttgcattgcaataaagaaaggccagggacaatggcttaaatgtctgtagtcccgtctgtattcctggcactttgggaggccgaggcgggcagataatgaggtcaggaattcaaaaccagcttggccaacatggtgaaaccccgtctcttaaagaaacaattagccgggtgtggtggcatgtgcctgtgatcccagctacttgggaggctgaggcaggagaattaacgtgaacttgggaggcagaggttgtggtgagccgagatgcaccattgcactccaacttgggcgacagggcaagactctgtctcaaaaaaaaaaaaaaaaaaaagaaagaaagaaatacctgagactgggtaatttataacgaagaggttagctgtctcagggttctgcagactttataggaagcatggtgctggcctcttctcagcttctggggaggactcaggaagcttacaatcatggcagaagatgaagggggagtaagcacatcacatggcagatgcaggagagagacagagagacagaaagagagagagaaaggtgccaaacacttttaaataaccaaatgtcatgggaactcactatcacaaagacaacaccaagccatgaaggatctgcctccatgatcacctcccaccaggccccacctccagcactggggattacaattcaacatgagatttgggcagggacaaacagccaaaccatatcacagggtaactcaagcaaacccttacttgttcttgaaaacttaactcatgtgccacttttatgcggcctttcatatcttttaaccattctacatgtttttcctttgtgttttcataacaatctgtgtattttaccattatcatagcattattataaatcaagaatagttgacttacctttacctgcctcctcctaaactggaagcaagtagaaggaagactgtgtcttataacttcagtacctaataggatgtatagaatattgtagatatttaattaaatccttacaagctaagtgatgtgatcttaatttcaaggaacaaaaggataattgtgtacactgctgggcataatggttagcacttaactttggggtaactaccaaggcaaagccttcattaggctaatgacagtccaaggtaaatgatatcagttgcaacctcaaatataaggataagaggttttaggatttaaatgaggattacacattggacttaaccatctctattaaaagagagcaactggcatgagtgatagtgcttcaaaaataaaggacattatagtatatattgtgtatatatacctacatatacactgtatatatgtctatcatatatatgtgatgtatacatattataatgtatacatataataacctcattgtcacgttatacaacatgttatgcacgactcattatatgcataactcattagataatgttaccataagatttgaggtgctgggatctagtaatttttttctcttatttgctttagtatcagctggagttcagaagtggtatttggcaaaacctctgagaatctaaagagttgattatagtttacaagctgaccagttaccatccagtgcatctaggtttcttaacaaatcacaatttgtgaagctacggtgttttccattcaagagattttttgaacatctaccatgtgaaaaagtaccaggtgccattaaagtgctaggcactgtaggggaatagaaagatgaattacacatgaatcttgtccttagggaagagtgagatgaaatatctgccatttctttgttgcacatacctccacatactgaaggataatgcaaactgaacctctgtcctgaagagtgagtcatgcttccttggtggagatctcagagcctggaaagtcttctaacctgacagtgtcatgtctgttcttcccactgattgttcccagaagtggctgctttcttcaattcttgaaattgttcctgtaggtgtaccactcattaggaaagatcccaactatctcagcacttttcaaagccagtgttgtttgaagtctcctgctggttgtcccaacctgcagttcttcgagtctcatgggcttataatcaacttgcactgtactcccagtcccttctcatttccttgttttgccctgaagcaatcaattgttctatcaactttcgcttagctacaggtgagttctccaaagatctctttcttaccctgttcctaaaagcaggcataaaaagaattagtgatcgcctcaggctcttttaggtattgataatgatgatgatagtactaataatgatattagtaatatgtattgagggctaaaaataggtgagttcccattctaagtgattggcagattttttctcatttgttccttgtaactgtggaaggaagatggcattattattacattttaagataagtaacctagtcaaagagaagttaagttcttgcctatcaccttcctcatttcttagcaccacctataaaaccagccccatattgagttctggttttctcataagcttcctatgattgactgaactctagtgatcacctgtttgtgttgatgaatagtagtaaggccagtgtacatattagggactaaatatcatctctggctgtcatgctctccttggacaagcagtgaatgtttgtatggttcttgagcttgtatcaaaggctgaggcaggtttaagagaggaaagataacactggaacaagagtagtctcaggttatgacacctgtctttgcccatgctagtatgagtgtttctaatttttgtcttataatggtcatgtatttattttgaactgaattggtaacagatgctgtatgaatattgcttttccttgaaaaagttagtcttcatctctaggaggagtccaagcacaccctagagctgtgatggtaacgctactcaacattatcactgctgtttagaggcacttaggcctgaaactgtatgtgtttcatgtgcattatttcacttaatcctcataaaaacctcaggaggttgattccactgtattatgaatacagtaatctgtatatagcaatccgtgtggctgattactcattcctttataaaatgacttgaacctcatgactgggaagacattagatgaatggactcagattttattttattttattttactttgtctttgattatataattttattttatcttatatcagatatattattttttcttggattagataattttcctaaggaggaggatcctaccacttactaaatacagtaatgtgtcccttaatgacagggcagcattctgagaaatgcatctttagttgatttcattgttatgtgaacatcatagagtgtgcttacacaaacctagatggtacagcccattatacaccttggctatatggtatagactattgttcctagactacaaatctgtacagtacgttattgtaccgaatactgtaggcagttgtaacacaatggtaagtatttgtgtatctaaatattgctaaacatagaaaaggtatagtaaaaacacagtattataatcttatgggaccactgtcttatatgccatacatagttgactaaaatgtcatcatgccatgtatgactgtacctgctgtttgggggacactatcctagctgtttccaaatagtttcttatttctaccaaccttatgatttaggttaaatatggatttagaatgtgttttcaaacatgcacaactctttgcctaagaacaccttgggaaaggagtagggagaaatctataagataaaggaaatgaacaaaaagtggtgaggggacttaatgaatatggagcaaatgtttaacatggagaagagatctttgccagcaagctattgccctggcagatacataaactttatcctgtgggaggcaatgatctggcgacaaaccaaatgtaaaccttgcaaaggaatattgcaataaaattcggctggtagtcaacagcaatttttcttataataagtatgatttgtttctctgccttctctatcagatatgcttctgcttatttatgcataacaagtagggatgggggaaaaataagtccttacaataggaatctgtattagtctgttcttatgctgctaacaaagacatacccaagactgggtaatttataaagaaaaagaggtttaatggactcacagatccacatggctagagaggcctcacaatcatggcagaaggcaaaggatgagcaaaggcacatcttacatggaggcaggcaagagaacgtgtgccggggaactgccctttataaaaccatcagatcttgtgagacttattcactatcaagataatagcacaggaaaaacccgtccccatgattcagttacctcccacgacatgtggggattatgggagctacagttcaagatgagaatttgttggggacccagccagaccatatcagaatcaatcatgataataaagtctctgtctctataatgccgatgttttctgcagtattttatgaaagcgagtgggatggaatagaatgcagtggaatagaaaatatgcaaaggtggatactcagagccataaatattgacagatggaagatgcacatagctgatttgagctatagtgtcaaataatacttttttattgcaagaaaaactttctggaggaaaaaaaacaaaacaaataaacaaacaaacaaacaaaaaaccaccccagaacaaaagcaattgtgtttattggcagaaggataaaacctttactaatctgtccagattgaaacacgttcttttctttccccttcagtgaccctgaaaaacaaaacatgagaaagatgcatttatatatatatgtgtgtgtgtgtgtgtgtctatgtgtattttgtatgtatgtgtgtgttatatgtaataacattgcttatttaatctcacacatatacagatatacaatgagttgggataagctagacaatattgtacgttaacaatcaaaccccaaatctcagtgttttagaccacaaaagttcattgctcactcatgtgaacttactttatcactttgtgttcatcgcagattaactgcacctctcctttacctcatttcattctggactgaggctgacattgtagcctatacctgtaatactacctatcttttaacagagagaaagataagaacatggcagacctcatactagatttaagagcttctgctcacatgaatcaattctttctacatgtcattttgtcaaagcaacttaatgtcagcatgggacaagtatatataatcctcttgtagaaaatatttttgaatagtaatgcaagctgctacagtatagtagcacattagagtgatacacaaaactaatactgtatctgttggagagagtattggtgggtgttgaatgtgttgtagttttcagaatgtaattgtacccagggcaactgttccatctgatactaggtgtgtacttttttttccaggtggttggggtgatgttgatagtaacagaatcttgctttgtggcattagcctcatttattctcatatactctttctctttattcttcatattaatgtcattgcgacactatttctatattataaagttcactcccaatatttttaaatcaacagatacttattgaggactgactttgtgtcaggcaccttgccgcatgcttgactatatgttgatctcattcagaaacactgtttcttagtgatttaaggcctgaagtaaatagttaattttagataaaaaacacattgatgaaggactatagtgcatgaatgaaactacatcacagttttgtgggaagagacggacacgttgtagaaaatttcacagagtgcttgggaccatagttacagagaaagattgatgggattttgtcagaagtcaaggaagaagtggggtgaaagccttctaggcaaagaaatcagtataaagaagagcatataaatgtaaagcatgtctgagaaataaaactagttctttatagttatggtatagaatttggggaaagcataaagatacatctgaataaatgcaataagagaaattggagatatttgaaacaattcatcatctctatctagaaaggtcaatcttcctgaacttctgagtattctcactggcacctctgactgtgcagtctgacctcttcatttttactcacccttttcaattgagcagtgtcccagggtgagtcccatggttgctttgtatgtattaactttgattaatttgagtcctgcatttcccattttctatgactacctaagatttatacttcagcatctttattatggcttattccatttggatagagtgacctagctccaatgagtggcctaaaagatgaccctcctctaactttctcatgttgatttctatatttctgtccaacatatacaatgtctcctgttatactagatcctacagttaacgtgtttacaaaaatgaattaattcaacaaaatgagtcatttgcaacatgaaatgcaccgtgaatcattgtttttctgctgttctacaaatattcgacccaaggcattcaatgactcatgtgtggcataaggactgtgctgtacagacatttcagaaacagatcgaaaggtaacctgctaggaaaaccatcattgctttagttactttttcataaaagttagtggtatggatattgcacaagaagctcctgtgcattatctttttgaagagattcaattgaattgaggttgagaacactatgtatcaatgctttactttccactagggagaaacaatctcttcatacactgccttccagggtatatttctgcagaaattagttggacaatgttcttctttttcccaactctttttcatttttatgtctggattagatgatggatagtttgggtttagaactggaatatttcagagtgactcaaacccatatgttttaaaatgtgacaattttaggtacaaaaatgtaagtgataaaacgcacgtcatataaaagatgcggctataaaccagcatttttgactttcaatagtgttttggggggcataactgtaaaattgccccagaataagaacagtgaatgcattacctggagccaaagatttgaagaagcagcgcttgtcactgatagggtgttgtttataaattttgcagtcactttatatttcagctatgcttacgtactgatttcactacttagaaaattgagtcatttatttgagagttgaggtggcttccatgttatatatgcagaatacaacaactatttaaaattctaataatttgctttttctattttgattgatttcaatactcagtcagtaggaaaataaaaaagatgtatttgggctttgaaatttacagggactgggagctcagtcaggttttgaacttcaggtttaggcccatctaacttttgtaatgcagttgtgtagaagagcaaggtttgtattgaacaaacctgcctctgaatccctgctgtgatgcccttgttagcaaattttatccaatcaagacaccattgattgtaaatagtacccagactttagggatgcaaagaatctgataaatatatagtacctgtctgattttggtaagttaagtaataacctctttgaactttaatttccttatcagttaaaaaggtaagtgaataatggtattctcctcagaaagctttcaagatttatagagatattctgggagttatatgacagaataggtagaaatatcgagccttttttttcagggactcagtaaatgcctcagtgattgtagataggttgtttatatttcaaataaaaacccttttaggaatgagaaataaaatgtagtcttgaccatcttttccttctaaaagaacataaaagtatcacgagtgagaattaaaagcagatcagataaaaacaaaagtcaattttgttaaattactgataatagggataagaaaggagtaaccaaagaaagacctgtctacttatagcaagcttgaagtcacctgggagtgttggcctcctaactttataaagagttcatggccatctgctgctattttctagtctattgtcagttttctttgtcccaggttctagaatcattcttcagtcaaaataacttcctactatatttgaattcaacaatttgttttcccaaaatattcagtttaataagtttcatagtcaatggtggatctatgccttaaaaaaaaatcaataatcagccgagcgcggtggctcacgcctgtaatcccagcactttgggaggccgaggcgggtggatcacgaggtcaggagatcgagatcatcctggctaacacggtgaaaccccgtctctactaaaaatacaaaaagaaattaagcccggcgtggtggcgggcacctgtagtcccagctactcgggaggctgaggcaggggaatggtgtgaacccgggaggcggagcttgcagtgagcttagatcgcgccagtgcactccagcctgggcgacagagcaagatgctgtctcaaaaaaaaaaaaaacaagaatcgtttagacattatgacctaggtataatataatgacagagaaaatgtaatggcagtaaaatataatgacagagaaaaaaagttataaattgggtatttgtggggaagaaagggaaaaacaagcatacctgtttgggtttttttgtttgtttgtttgtttttttgagacagagtctcgctctgtcacccaggctggagtacagtggcgccatctcggctcactgcaagctccgcctcccaggttcatgccattctcctgcctcggcctcccgagtagctgggactacaggcgcccgccaccaggcccggctaattttttttgtatttttagtagagacggggtttcaccgtgttagccaggatggtctcaatctcctgacctcgtgatccatccgccttggcctcccaaagtgctgggattacaggcgtgagccagcgcacctggccgcaaacctgttttttttttttaaattacagatatgaaaacgaaagccctgaataagttagcctaatatttcagtttttctatatagattggctgaatttttctttaacttttagaaggcatgcatttcacatacatacagaatcaactttattggatgcttactctgccaggaacttggcaatttttttttctttctttttttttttttttttttttttgagtcagagtctcactctgtcacccaggctggagtgcactggtgtgatctaggctcactgcaagctccgcctcccagggtcacaccattctcctgcctcagcctcccgagtagcccgccaccacgcccggctaattttttgtatttttagtagagacggggtttcactgtgttagccaggatgatcttggtctcctgacctcatgatccacccgccttggcctcccaaagtgctgggattacaggtgtgagctaccgagcccggccggaacttggcaatttgtataccttacttcattcaatcattcaaggaaacctactaaatagattaaaaaccaggattcaaagtcaccgttggcatagcgtttatggtacacatgctcaaaacagaaaaacctacataatggaatagtttatatattggaataaaatgtataacaataaacttgttttaattaaaatttaactaaatattttaaaattggtgtggcttcctttccaatacccttcaggtaagtatatttgtgtatgtgtttctccttccaaaattgtgatatctaccagtgatttaataagtatcatatgtatttcagtaatttttcgcttaagacaaaagacatcattattcacttctctcttttttagctatgcaaattattaacaaattaatctgtaaatagtaaaaaacactaaaatgccttatgtatttcattaaataacattgccttagttttaattactttcacaggaaaattcattcaatcaagtcttttctgactagtgattgtaatcctgactaaatgtgtgttttatatcaaatcctctctaatttagtttgttactgtaccacgttttaatctgtctctcatctctaagtggtaactggactctatgctaaaccaaaatcttgactcatcacctcaaattcctaaatatttatttatttttttaaaggcaaactggattctttcttttgcttgaagacatattttcttggaaaagtgttttgaatttgatcatttcttctgtctgaagtcaaagcttagaattatatctaataagtaaattgtcagactagccagctattctcaaaaaatgttggacatatcattgtgcattttaatttgaagtcagatgaatccacagatttaaaaatctttgagaaccagaagttcattttgttttaaaggctctaagccagagctgtctactagaaatataatgtgagccacatatataattttaaattttctagtagcaacattaaaaaagtaaaaagaagtaggtgaaattatttgtaacaatacattttatctagctcaacgtgtcaaaaatattttcttttcaatttgtaaggaatacaaaaaagcattactgcaatttaatttaacatttcttagattaagtcttcaaaatgtggtatatattttaaatttacagcattatctcaaattagcctctttttaagggctcagtagccacatatggctagtggtaccctattggacagctcaggtctatttgatggaacatatattggcaggttctaccttttactcaagggaattttagtttcatggttaattggcgttaattatcagtagtaatcataatgtaactcaccatagttattactttagctaatatatgggcagaagtccacatgcctagtttaaataattccttatttttggttgagaaaaagtataaatatttatatcaaaattacctttctacatgacacttaaagtagtataatattttataaagaaaagaataaaaactgggttcagagattttgtgattttgctttccaaattagaagaaattaggtccaggaaaactattatgtagagaagaatcatattcactgaaattgaagtgttacactactttctttgcccatgcactccatcaatgaattgtattttcatcatttgacttttatgtttcattctttttttggtagccaaatttgtgttaacaagttttcttaatctccaaaatatattttataaagagataataaaaaagttgatgtgtatttacagcttaaggtccatcatgggtgaaagtacactttttcaaactttactttggagagtcaaatttagctaataactgcttttaagggttaacatttctaggtaaggcaaacactcaaatttaaattagtttaggagacagatttaaataattcttttcatgactttgctaatatctcactacaataaaaatgatctttgatctatttgtattaacttgggaaacatttgattaaaataatatttaatgatttatttagctgtgtggatggatgataattttctacattcatttttaattccatgcatccccaaaatacacacccacccattatcctctgcagtggctgcttctcatgtttttttatctgccactgttccctttgatttctccaggcccaatatctcttcctagcagtgttctgtatctaagattcaatttctgttttatgtatctgcttcattaccattatgtaactatattccttggtacttccttctgttttgtaacatctaacgaggatagagagcattttatttgctatttctaactcaaagccacagttttatactagagaaaaaactgaggattctttgttcttcttaaatacctcaggagaggatataagagactacccaattgacttagatttttagaaagcaacatgtttgagttatttcttatttttaggttacccttcttgtgcatttccctccattccttcagagctcttttttttttcattaaaatgcagtatgaatctgattatctagattttgaagagccagggatactattatacacattagtttaagttgcactgagatggttctcctctgggaacatctaaggaataattttcctgatggctggggcaatattagacataagtgttcagatttaatctgcacgtaagattcaacaattttggattcacaaagcactgatgtacaaatccttaaagttaataattttatttcattcttatatcataatacattgggttttaaagcttccggtatccattatatcttgatctcattaaacatacacttaacctgtgactagaaagcaggtaatagggaggagccagctccctattaaaatagttcaagatatttaccaaaagcaaatggaaagctttgtttacaaaaatagctgttcatgatgttcacagcagttttaattgtaatagctaaaaactaaaaaaaaaaaatcccaaacaagttttacaaattgtggtatattcataaaatggaatactacttagcaatacagagaaaatggtgtactgttatacacaaaaacatggatgtctccatgactttactttgagtgaaaaaatagtacattttgtatgattcgatttttatcaatttctagaacagacatcagaagaggagttacttatgggctaaaagggaaagcaagagaactttctggagtaatggagatgttctatttcttgattgggatgttggttacatggttgtgtacaactgctaacccttacccaactctacacttggtaactgtgcattttgctctgtgtagattttatgtagattttcaaaatagattgtagatgttaacaagcttgtgataataaaggaaaatgttagccagccaaagggagagaaataaaaaggattgccaagatggagggagaactagaagcacttgtagcttcaccttacctagcaggagaaggggataccaactctacataaatttctaaaaataataacaggattatcaacaattgggaaaagaaggaaggaatagcatgaatcatcaagaaacagcattttattcagagttggtagccaacaagtgacctaaaataagaaaacgttataggaggttgcttcctgggaatggtatgtgaagggaggcgtgggcatgcctccttttcagtataagtttgtccatggatcaaatatgttactgtgtatacacagtgctttgatgaaaataacattttaaagatgttatgatttccccattgtccccaggataacattcgaaagcttcaatccttcatggtctggcgtccccttgcccctctagccttatatttgctagtcctttttcctcctcacactcctcatccacccattgtcttcgggtttccagaatgtgtcttactctgtttcatcctgggctttttcctataatgttttctcaggttcaaacacttaactcttcggttcccatactcactggcctaagggatttttttgtccttttttttttgttgttctgttttaatctgtgtgtatctacctccagaatgaaagcatcctaagggcaggaaccctatgtggatcttttggaaggttgcatccaaaccagctataacaggtacctagggctgtagttggttcccagtcatatatttaaaatgagtacatagtttgacattttaaaatagtagcatgactttaagaagcaatgtaagtgtcgaattctaaatctttccctgtttgtagacagatctcaagatgttaggtcaatggctacaaaatcttggagtgatatttctgaggatacagtaaaagcagtgattatcatatgtccattttctgaaaataaatgaggaccacttatattaatcaatgattttcagagaaatgaaaccaaaaggacacacacacacacacaaaaatggaaccaaaaggacacacacacacacaaacacacacacacatacacacacacagaaatttattaaaagagagattggctcagatgattatggagactgagaagtttcacaatctgttgtctgcaagctgggggcccaggaaagccagtggtatagtttcaatcaaggacagagggcctgaggaccatggggctgatggtgttaagtcctggtctgagtttaaaggcctgagaactaaaggcactaatgtcccaggttgtcagaatttccatctcaaggagacagcaaatttgcccttcctccacctttttgtttatgtaggccctcagtgattggagggtgactgcgcacattggtgaagtggtgaagtgatcttctttactcaatctgccgattcaaatgttaatcttttccagaaacgcccacacagacacatctagaaataatgttttgccagctatctgggcattctttagcctggtcaaattgacacataaaattaaacatcacacctctttaggttaatatcccaatactgacctggtcagacctaggagaagggcccaagaattccttgccttccctgtgtattagctggttcctcgctattaatggctttctagttagatcaaaatccaaagaaagaaactgcaggtgaatatctaaacatcaggaagcttttacatgatcgcctattgattaatgcttaaaagctacttatttaaaaatgctagaatgcattagaacattctctcttgcataaactactgtgtagtactagagatctacacaaaataaaattaaaaatcagctaaatgtgtacatttacataggaaaatattcaatatttacttgctttttatccttatattttataaattgttggcaaagcagacataaatagttctcagcttgacacaatatgtgacttaatttgtagtactcaatgaaaagctctggtactactggaggatttataagttaaattttaattttttttttgtttttttttgagacagggtcttgctctgtcatacaggctgggctgcagtggcacaatcatggctcactgcagcctggcactcctgtgttcaagagatcctcctgcgtcagcctgacaagtagctaggaacaaggtgtgtaccattatgcccagctaattacattttttatttttggtagagatgagctctcactatgttgcctaagctggcctcaaactctggggctcacgtgatcctcctgcttcagcctcccatagtattgagattacaggtgtgagcactgctcccagctaaattcttatattgagcaaaacatcttcagaaaaataaaatcaattctgtactaatcatagcaaaattatctttcataaccttacatacacatcttaaataattatatatgtttgtgtgtatctatcatatatacgacatttacatagacgataaattagcaggaacccactccaggatacgtgagctatttatagccattttagtggacctattatcagtcactttggttagctttcatatgagtatttgaaactatatatggatctctattaatataaaaattagttattgaagacttttctgcctgagaaaaatgaacaaaatgaatatttcaatcttagagcagtaaattattttttcctttgagagataaaatttgttttcacatgtggtaaaattttctaatattttattaaatataaaattttagtcatctttggacaaaccaatagctttgctgctttaaatctaaattttaaaataaaaatatatatacacatatataaatatataaaggtatatgtatatacacatatatatatttgtccacatatttattgagcttgagggtttgtaattttacaaatgtttaagaaaatgtaccattactctgtccctttcttcccacctctctattcttattccttagggaaaccatgttcaacatttttagctgctttttcttccggtttacctctgtgattctgaatatcttcattttttatgtttttgttttgcatattgtcttctgatttcctactgtggaaaatgggaatgattttaaatatatattttcctatatttttcagttagtcataaattttcagttaaatcaatattagtactcatattatggctataaaaatgttatattttattatatgattacatttctttaacaatattttgtttttcctggagttaataattggtacagttcctgtgaccttttttttttttttgtgaactctttcctaagctctctatcagaaatataaacaacttctcaataactttgttaaaatcaggtattctgtcatggctttggttttagttttgctttcctggagacattcctcagacagttgtttcctggttgtctgccctcctgttccaatctggggtggctgctctgtaattctgctgcgccactgtcatgcaccatttcccttcactgtcatcctgacaattctctttgcttttctcctgtcttggattttctccccttggggtttcatgtcttcctttttcttagttttcttcctaattttagtcaggcatatcctcttataacttctagagaaggcttccataattgagagtatacatttgtgagatatcacatggtctgaaaatgcctttattctaatctcacatttgattgatagtataataggtacaggaatataggttagaaataagttcctcctaaattttgaaagcatttcttcattttcttctagcactcaattattgagaggtgtgatgctattctgctacctaacattttgttgttggtctgctttttacaattgctttattttctttgattgaagcttttagggatttctgtttgtcctcagtgttccaaaattttacatttttgtgcctcaggttggatcatttttttatccattgtgtaaaatacttagtgaatcctttctatcttggtgattcatgtacttcagttctagtgtattttctggaatattgtctgatgaataccttggttttctgtttgacatttctggagctcctacaatatgtgtattggaccatcttgatcagtcttctaattttcttattatttatctctaatttttatctttttctcattatttttctactttgtgagtgtgatttcttcagctttattttctaattcctttatgggatgagttatttctgctcttcttttaaatttcaacgataattttttaatagtatcctgttcttgtttcatgtttgcatgtcttcttatatcggttatagtgttctaaagttttcctctgttcttgcattgttcctttttttggtttcttttgtctctgtctgaattgtccattcatatttgcaaatcaaggatttaaaagctaattagataactggtatttatgtgtagaacttgttgagtggtaagcattactattttatcacttgttcactttatttggtatatttagtttatatactaaactatcattaattctaggtatttttgtcctgtgtgtgttaatttactcagaaaggaatattctgaactcgttcctactagactattggtttaactttttagaagacccagctgctattgtcttactgggtggaggaggtgtagtcatctggttgcttagggtagggattggatctaagagcctatatgctttttagatgtttaaccaaccatttttctcagccctacctataccactgccttcaaaaatacaaatatgtgccctattcctgcacccttttctgatttctgtcaagtgaatttgcttgttaattggctatttctcttccctacccattcttagcattgaactttcagcttcatctgctctgctaagttagttgttttttatcttttcactttccggcatttataatttgcaccctgtctctccctccctgcctcttctctctgttattgtttcccttcttattctcattgttcttttgggcctctgacttttatatcctcatcttcacctacacccccacccccctgcccacagacctttttttcacttgtgtgtgtagttataggagggagcagaggctaacttgtttgactgggagtcttaacgattttaagagattttaaagattgaattttatatgatttcagtgaaataaactaaagcgatttgaattaaatatgtcttgaacatacacctcctgctctaccctcttttgcttcttgtgcagtagttaacaatcatagtaccaaattctaccctgagtacattaagataaacagccaagttcaatctcaagtcagcccaaggccagcttcagtttcaatgggggatcatttgtagtcaaaaatagagagcagtcttagaagagtgtcctcagggtatggtggctggcttccgccagagtgagcaagacgggaaaacgaggcagaagccacagtgtcatctgtgccctggcctcagatgtcacatttcttcattaattcagcatactattaattacagagataggctagtcaattcactgtggaagaggtggtacagggatatgaatactcagaggcaaaaatcaccgagggccatattggaagttagctaccacactggatgtttactcaggctccctcacttattaagttactctcagatccaagcttgaatgactcaggttgttgcacctatatgaattaagtcttatggtgttacttgtgaagaatgaaaataacaaatgtcagttttttgaaagccatttataaagcttaaattaaaaccccaacttgtgtaatttgttgtatattattaatacagtcatcagctaactaagaccctataaattggcccaacataaaattatccttcaagatgctaataaagggtatccacattgtgtatgtgtccagtgtttcatctgggtaggccaggaatcagatgacacccaaatagggacttctgtttggaagggctaatgttttgaaccacatagtatgtattttggaaggactttcttattaagaaaagtgattattagaaacgtgattataaggagcatcagagatcacttaccaatgtgaaattttaggaggatagagagcatctttatttttttctccagtagtcatttcttatttttttttaatcctaatactctaagtagtcacaatgatatgtgaatcattgcatgatgagacaataccggcttctctttttttgagaaataatttctattatcatgactgcttttgaggttggtgaagatttaatattgccttacatcatgccattgaaactacacattcaactttgggattttaaaaattctctaaatatggacttttagggggtaagggagtgagagagttgtaatttccattttaagtccactagaaaccaatataattagggtacagcatattctgtcctgtagtagattttagaaacatgcaaatgaagcacactgttttccatggttgtttgattttcatttgggtgttttgaatttaatgagattttcctgatttagtgaccagtaagctgacaccatgttttactgtggaaggatattttttttcttttaataagcacagcaattcattgcatgatacaccattgctgttttgtgatgaggaagaacctaccaatccaatgtacgtttattctccttttgctaggacaaaatgaatttgtccagccatatcatagcctagagatatattatttctgtggcaggaatccattgccaaaaataaaaaaaaaattatggaactaaaacagttcatgtaggtaggaagtgtaagactcactgccatatgctgttctcatcctatcacactcaacattgaattagttgaaattttaacatgtaccttcatttctctgtagcagaaactttctgaaaactgaagaggagatcaatcataccattattgttactggaaattaaagaagaatgtttttctcatctttttaattggagaatcaaaagaagtgtattgaatcctggactatgtttccacggaactagttttaataggtttcatgtaagaaaaacaattctgtcatcatacacattcagagaattgtgaatctgtaaacaaagttaaacagacttccttactgcaggtcaccagagagcacatacgcagcctgcatgcccaaaagggagcttttatattaatccaagattgcagggacccttttttcctctaggagtatgttatgatgttagtgtctatggaataaaatctgggaaacacctttgtaggtaattttcactcattgcaaaccgaagttcactttggttcttgatattcttgatcaagaattgatctctaacaggtgcttattatgggccaccataccattttcaccagtacttctctaattctatggagaaggcaatatttgatatgttaattagtgatgaagctgactataatatgcttgagtctaaaattaggcataattacttctatatataagacactgagcacagtttgcctaagctgaagttaaatgtgttgagaatttgaattcccttttataggctatttacctcagtaacatttaaaatatttatggaatgaatcatccagatttactctatgctaggcagagctttaggaacatgaacttataaatgatgttgagattgtggtttaaacaggctcagtaaactagtccagggtcccatggctggtaacgtagtgaagcaggtactcaaacccagttcattctgacttcacacagctcctaactacctctggcatatataggcatagatagaatgcaattaataataattgtttagccttatcagagaacaagtatcctaatttaagtaaaaataatgggattttatctgcattttaaaaatgatgatgtatattagagcataacggtatagacactcagaattttatctccgtgatgacattggctttaacagtagtgcttagtgagtaagtatccccgaataattagatgaagataatataaaaggtgtatttctaagcaaactgttttaagcatgtggaagtatattttatcagaggtttagttttttttttgtaaacttgtcgagtgggcgtttatttgagaggcattgtagtagaaagggtcctaggctttttaagtttccatttctccacttactagatatcctattattagtatattttgctcaagttttttgtttgtttgtttgtttttgttttacctctttggagcctgaatttccttcaatttaaaatggtaaggtagtatgtatttcaaaggattgttgtaaatattaaatgaaataacttatataaaacacataggacaaggcacaaagctatcacatttttcttcccgttttctctatttcagtaatatttaaaatttttatttgtcattgaaattaactcatttaatatatatgttaaatcccaagataaaatatcctagaccttctacaaccagatgttatcctcctaacaaactaatttgtagttgaacatctgtttaaagcctggctaaaaattgccttaaaaatccttcttttctgatactaagacaatgtttttactcatttaatatttcagaaatgttcagaaaagcggttattcattcactagtgggacttgcaatcagtggcaccttagaatggaagaaatatagcagaaacatactgggtgatgcagcaaagaaatgtgttgaaatctattacatatgaattgttattttctccatttcgtagaaaggaaactgaagttccaaacacctgtgtagcagtgggtagagaaaagactcggattccacttttcagagaagatcatctctacttacacttaacacaagtccttaattccacaggagtaaatccggatgagccaaattggaaacaagaggcatgtggagtagatcagaaaacacttttttcacgtgtgtgtattatttttaaacttcgacatgaactaaagaataatcatgaaatgtatttcttcaaaagcctttaaaaacagataatctataggttagaccatttagagaggtaattcgtctgggataatttgtgtaactttctaacagtttttgtcaaataaaaaactgtagtaagtcgacagtgcattcatgatgtgcattcactgatgtggctcaacattggtaacagtatgtagagaagaatctgacaatttcagaaatataggcacacatatcagatgattatatcaatgcaaacctgttgctttggttatatgagggtacacttcaaaaatacacaactcaaagcttttttctttttctctgtcaaaatagacaaacccaggttaataaaaatagccagggagttcagtctcccaggaagagcagtctgaagaatgatgacatacattgtgccttgaaggctacaatcaatctttattgaaaagaatctacactgaggacaggcagggctttttggacattcctacctcattacattttgcatttatctgccatcttcttacctctgttggtcattgagggttataaccatttacttagagtgattttttctttttacaaatgaagataaatgagcctacaatattaaatcacatccttgtttcctcattttatttcggtccctgtaaagattaaatgttgaacttttttctttaaaacttaagtaaaacattgggctaggaaaggttagtggcttaatgtatttgtttttctctctttttttctatctatctatctatctatctatcatctatctatctatctatctatctatctatctatctatctatctatctatctatctattgctcgaaagagagagggagagagagatgtaattttttgtgcaagtagaaattctaagtttaaggtctgattttatttatttatttacttatttatttaatttatttatttagggacagagttttgctcctgttgccctggctggagtgcagtgacgcaatctcggctcactgaaaccctcgcctcccgggttcaagtgattctcctgcctcagcctcctgagtagctgggattacaggcatgtgtcaccatgcccagctaattttgaattttaagagcaatagtttgcagactgggagcctcaaaactgaaaaatggcatcaagcctcaattctacagcagttacagcacagttgacagggaataaaagaggaagtgtgttcacctttgtcgtgattggctgtcatgttttcttttttaaggcaaatagagctatttaagctgatttgtctatagctgattgatttaatttcactgaatcatgctgtgaggggcaaaaacataacgcttgcatttttatgtttagggttaggatttccaggaaattgggatgacctaaattttgcttaagtgtctatgggtggttgaccatgaggtatccaaacagtagcccccattttcatttatttatttttagcaataggaatacaggaaactataccaaatttaggcaactatttactaaaggaaaaccaaaaaagggtatgagcccattactttgttcagtaaggtctggttttaaatatcgatcttattaatgctttttgcataaagtgtaaccttaatgtgtatttttccttgcttcatctccgaggtgactttctagttaggacaccattggatcaaggtgctcaaaaacaggggggcccctctcccattacacagcacagtgcttctgggtatgtcctgtttctggcagcttgaggatctgactgacatagcaggatgcttcagaatatctttttgtaggaaaactctctctcattctctctctacttcatctgttctaactaaattccaaaaaaaaaaaacaaaaaggagtgggagagtttgtattgttcttctgaaaataaaaacttagaaaatagctttttttggtattcagccacaataatgtgcattaatattccaatcttccttctgctcatgaaaaaggacacagaggaaagactaacaaagaaaataaacctgtaaagaatagtattgaatgtgagaagataaaattaatatattcctaatgaccatgacaggaaataatgatagcattaaactgtagtgtcttttccataagttttagatatactgggcatatgtgatgcttattatacacgtaggcatctcaagcagaatttaaccttgagaataattgttaacaaaattgattattaaaaaaaatcaatggctttgttatttgagtgtaaacacgtacacaaaaatgaagagccaaaagttagtggttacgatttctctcttgttccctgccctagaactgagttgttaaaatccaaaacaatatgctttttaaaagctatgttgtatagtatttattgcagctatcatttgcttcaactttaacctaaaggcaaagtcatggtaatctcttccttgctcagaaatctttggcatctcctcagagcctcgaggaaaatgaatttttttgtatggtattcaaggcttcacaaagatctcccttgctagcctcttccccactccttccaccctgcttcctatgttcacaaagttctctgccttgcctcaaatgttatagatttcagtcttctttgaaataccctcttaacacttctctgcttagcaaattcctattattctcaagggtcagctcaaatttaccctttagtgaggagggcatcttgcattcttctttcttctgacttctggccaaattactttcttcctcccttgcattccctggctcctttgttcatatcacaagtttggcttagattacacaattattataagatacttgcttttctgctagtttcttagtcttttggagtgcagatacagtgttatttatcttttaatcattagagcccagtatggtaaaggagagaaataaatgaattgaatcataggtctatctccagatgttaaaagtcattgtaataaatgagggagaaaatatccaaaatgtttttcttctcctttatctgagtctatcaatcttattgcttaagtggatggactatttgaatagttgatatttctaattagcttgtgtattccaaaggtaatttacgttgctcctgtgttttaccattaatcccaaactgtggacatcataaagatgccttacaaaattaatttaataactagctaaatatagcataccattttcttcaaactgattgcttcatgggttcttatttccatgagatcttctagcagaagtaatttcgggttggtgtctatctgaaagccttctgtctagcagatagcattgaagtggagctttccttaaagaggacagaaaagcagactgtcttccctctttgccgcagagccagaaggacagggtgaaaagtgtctttcctttgactaaagagaatcacattccactaaaggcagcccatttcagactgattattggccaactttatatccagaaggaaagcaatttaacagaaaaggagtagtctttcagagaattaaattttttgtctagatttggactgaagaaacaaggcatattgaggtagagcaattaaagctcttttggtctagaagagaaaatcaaactctaagggaattttaaaagccctttttgttgtgaaatatgacagtttgcagaagcctgttcttcttccacttaccctttcaatgaggaaacttatcttcctgacaaaaattgcattaagaagcagctgcagccgttttcccgtaggcagcattctgagggaatatttgagagaataactccccaaagataaatgggttcctcagtagccttgggcaggaggaataaaggcgattctttatttttcatactgtgggcacttctgtgaatttgctggttagcccaagctaaaagtcaacacaactttttgattaggaatagttgcaggtcagcagtactttttgttttgaagttttgcagcacagtcctgtgggtggttatggttcttttctctgtttccaagtttgcagaagtttgagaggtgaccttttgtggactggaggaggctgagaaactgagtgaagtgcacactgtatacccctttgccgagaaattgtctctcaggctgcagaccttagagcagtggtaactatgattgacatgtaatgatgcattcaaagcacacatcacatagcaagaccaaatcttcattctgaagtcgtatctaagtgctaagtcctcattctgaagttctgaatgaagtttagcccctcattctgaagtgccaacattcatcttcacaatgatctgtgactctcctcaccttctgttgctttcttcccccattgtccctacagatctttccttcactgggttacatccactcctgcgtcaggatctccttgtcgtagacttaggtttctccaagtatttgtcccctttacctctggttagcccacagtgacaaggcagcaaaactcatttttataaggggtggagggggaatcgttgtgataacttaccctttaacatttgtctcataggctcataattccattactttgcctgtaatagtggtaagtaaatatgcccttctgtttaggttttagggcaaagtagtattttagcagttaagaatttactgagcatattcctcttcacaaataatttattggtgattaagtataaaattaccctgtgtttttaattcttattttctcccatctcttttctcttctctttttctctcattcttctttttttggggggggcggggacagagtcttgctctgttgcccaggctggagtgcagtgacacaatctcggctcactgcagtctctgcctcctgggttcaagtgattcttgtgcctcagcctcccgagttcctgggattacaggcatgtaccaccatgcctagctaatttttgtattttttgttgagacatggttttgccatgttggccagactggtctcaaactcctggcctcaagtgatccacctgcctcggcctcccaaagtgctgggattacaggcatgagccaccacgcctagcctctttctctctcattcttggtagcagttattacctatacctttttgaatgctgaaagtattgattaatgctcgtaagacttagtaacacaaatctgtagtacttcatgtaacaagagcaaatgtttttcaaatctattataggaaccattttatctctacaaataagaagttaaaaaatagtttttaggtaatatgaaaagtaatttgaaatcacaatttaacaaaacagggccttgtgaaaaattttgtttgttgataggacaactgatgttaaataaatttttccacattaaatgttttcagttgactatgtttcaaagaaaaaatgtaatggattttatagtatatagtatagattttatactacaactaatgaaatggaacctttatggtgaggagggtccttggacagtggacgtgtgactggtagtaacatgtggtccaaagtgcagcagggacagataggagacagaagtcagaggttgatgttgaggtaggggtggtggtggtagtggtagtggtggaggaggacacagatgggccaaacagccctacatttgacaccagtttctgaatggtgttaagactatttagtaaagatgttgagtgagcagtgagaagtaagagcgaggagcgagaagaaaattagagtgtagcccctccttcgcattcaagcttccccaccaactaaaggcacagcctccagattctaccccaaagtgcattctgactgatgttataaattgcttttgcttcccttcataaggcggtattttctagaatgataattaatgatagagttgtaaaacaatcttaaacaattaattgggaactatcaaataagtatctgtgatgtttgatgttggaaaaacatgatatgaaccttttgctgaggaggccctagtttactagttgaaagataaatttgtcatgacatctcttaatacaactttatatatcttcattactcaattaaataaaaactcagcaataacaaaactttattatatgagaaaataagaaaatagtatatgatgcagaggaaaaaactaaaggctgataaccaatatgcctgaattttagctctgccatctccatccccaacaagaggggcattgcttttgttttgcgtattgagtttcaatataacactttagttgaaaagaaggttcttcagcaaaatacttgcaaacagaatccagcagcacatcaaaaagttaatccagtgtgatcaagttggcttcgtccctgggatgcaaggttggttcaacatacacaaattaataaatgtgattcatcacataaatcgaactaaaaacaaaaaccacatgattatctcaatacatgcaaaaaggctttcgataaaattcaacaccccttcatgttaaatactcccagtaagctgggtattgagggaacatacttcaaaacaacaagagccatctatatcaagcccacagccaacattatactgaataggcaaaaactggtaatattttccttgaaaatcagcacaagacaactgccacttctatccaacacagtattggaagtcctaaccaaaacaatcaggcaggagaaagaaataaagggcatccaaataggaagagaggaagtgaactatctctgtttgcagacgacatgattctatatctagaaaaccttatcaactcatcctaaaagctcttccagctgataaacaacttcagcaaagttgcggagtacaaaatcaatgtaaaaaaattactagcattccttacaccagcaacagccaaactgagagcgaaagatagaaaggcaatcccattcacagttgccacaaaaagaataaaatacctaggaatacagctaaccagagaggtgaaagatctctacaaggagaattacaaaacactcctcaaagaaatcagagaagacacaaacaaatggaaaaacactctatgcacatggacaggaagaatcagtatcattaaaatggctatactgcccaaagcaatttatagattcagtgctattcctatcagactaccaatgacattcttcagagaactagaaaaaaaaagactattttaaaatttatatggaaccaaaaaagagcctcaatagccaaggcaatcctaagcaaaagaacaaagctggaggcatctttaccagacttcagactatactacaaggctacagtaatgaaaacagcgtggtagtggtacaaaaattggcacataccagtggaacagagtagagagcccagaaagaagtctgcacatctacgaccacttgatctttaacaaaactgatgaaaacaagcaatggcaaaaagacttcctattcaataaatggtgctgggataactggctaggcatatgcagaagattctttacaccatatacaaaagtcaattcaagttggattaaagacttaaatataaaacccaaaaccctggaagacaaactaggcaatacctcgtgcacataggagcaagcaaagatttcatgacaaagacaacaaaagcaattgcaacaaaagcaaaaattgacaagtgggatttaattaaacttaagagcttctgcacagcaaaagaaatgatcaacagagtaaacaacaacctgcagaatgggagagaatatttgcaaactatgcatctgacaaagttctaatacccagcatttataaggaacttaaataaatttacaagataaaaacaaaaaccccattaaaaagtgcgcaaaggacatgaacagatacttctccaaagaagacatacatgtggccaacaagcatatgaaaaaaagcccaatatcactgaccattagagaaatgcaaatcaaaaccacaatgagataccatctcatgccagtcagagtggctattactaaaaagtaaaaaaataatagatgctggcgaggttgtggagaaaagggaacacttatacactgttggtggtagtgtaaattcgttcaaccattgtggaaagcaatatggtgatttctcaaggagctaaaagcagaactaccattcaacccagcaatcccattactgggtatatacccagaggaatataaatcattttaccataaagatgcatgcacgtaaatgttcattgcagcagtgttcacaatggcaaagacatggaatcaacctaactgtccatcaatgacagattggataaagaaaatgtgttacatagacaccatggaatactatgcagtcataaaaaatagtgagatcatgtcttctgtggctacatggatggagatggaggctgttatccttaccaaattaacacaggaacagaaaacccaatactgcatgttctcacttaaaagtgggagctaaatgataaaacttatgaacacaaagaaggaaacaacagaccctggggtctacttgagggaggaggttgggaggaggaggaagagcagaaaagatagctattgggtactgggtttaatacatgggtgatgaaataatctgtacaacaaccccccctacacgtgtttacctatgtaataaaccttcacatgtaccccaaacctaaaatattttttttaaaggaaaggaggttctatacaaaaaaagaaaaaaaaaaactttagaactctctggcaatacatgttatgcatcctgtgttagtccttgggtaccgtgaaatttccttcttttttttttagagcacctagtgccctccatcgtcatcaaccacccactgctgcggatgctgagcccccatctgttgagtgcttaccctgtgccagaaactctgtattgcctgtgcattttctcactgatcacttagactaggcttgggcaaacttttttctgcaaagggtcaggtaataaatattttaggcttttggaaccataaggtctctgtcacaattactcatctctgctgaggaggggaaaatggttccataagacaatgtgtattgtgttgaaataaaattcacacactacacggtaaaggaattagaactagaatcctggtcgttcaacttgaaattttacaatcttttcataattcctgctaatagtgtgacctcctaaactgtaaaggaaattttgtaggttaaaaaaaagatgtatttatcttctgtaagtggatagcaggacctttaggaaaagaataaaagtaatagaagaccaaagaggaagagactcttgggaagaattttttatttcacagaaatctttctcccccaatagaacaatgaattgcttgtcctaatattgtttccttacctcttaacatattgccatataacatattctgctaacagtataaagacttggctgtctttactttgctattattctttctgaatctacaaaatttttctttaaaaataatctgcatgtgttctccttcatttatttccacacttttccttcggaagacttgctagtcattggagaaaatatggtgtaatggttaagggcccaagagcgcaaatgagatttcctagtttttttatccccaactctattaatctttatcaaataacttctctgtgcctagatttctcaactgtagagtgtgtataataatagcatctatgacctagggttgctgtgaaggttatgattactgcatgagaacacacattgtgtacatgctggttactctccagcttgctcagtacatgtgattctttaccactcttgtttttagtacaagtcagtccttgagtcaccctgaaatttgccagtcacatttatttacttgatttatatttttcactcagatctgaatgctttaggaatatacccataaagagaaaaacttaaaatatattttacatttacatttttatgcaaatatgcatagattattttgattttaattgctctttattaaaagaagagtgccttttaaaaattaagtttactataaggtaaaatcctcattcaaggtgaaagcatttgtatttgaggatctgaagaagaatacatttaggtgatgttatctaagtgcaatgtatttttgttacttgtaaaagaacagtaaataacagacatatgtatagtcattagttatcatgattgtgattgatcttttaccctagataccaagtatataaagtcagttgctttgctgtctttggaattataataggtttgggtgaatgttctgtgattgctgataattatcgtattggtgggaatgtaccatctttgaccacatcgtctgtcaaaatttcagtatgtctaccagtctcccttcacctctcactcgtccaagaagcattcccaaggtaaagcagtcttattaaaatggaaggatgtccctagtgtgttgcgtagaaaacaacaaccatgatgagtgcagggatactctggttaggtaaattttctcgtgtttacatggatcttaaatgttaaccttgcctgcagcataattccaataagacaagaaaaaggtaagtaaactatattgaaaaaagtgactcttgttttccaagctaaattctgcctctggcaagacaagtcaattatttttctagtcaatgaagatagaaaaagaataaagtaaccagttgatttctgcttctgattagaaaattttgttttaatctcagccagagatgtttcagctttgccgcagggcaattttaaatacagttgtcaagggaggacttcttgagaaaatgacactagaacaaattcttgaagggagagagccatgtgaatatagggcaaagagcattccaggcagagggaccagccagtgcaaggaccatgaggtgggaacatgcctggaacatttgaggaacacgaaggaggccagtttgattggtgcacagtgagcagaggaaagcaatagggaatggagtcagagaggtagtagggaagggtagagggacatcatgagagctttctaggactttgtaggaaatggtgcctttttattaatttctctgtttagaactttgtatttagaaaatagtgcatttttataaaggaaattacttttataattaatacttcctttatgagagaaatcattacattattttaatttttaggaaaattcacaaatacatatataatcattttaatttcccatctctgatgaaaatttttgcctataatttcagtaataaagtatcctttgtaaaaattgttttctatatttgaccatcataccattttttaatatgctatattcagtttgaatgccgaacctccaatggttagctcattgttttctatatttttatttgacagaaagtagttcaaaagcaaatgaactactttgtggagattaaaaatatagtgagcaattttatgtcctttcaaaaagcatagtttgaaccaagaaaaagttactttttgttcctgctctttgatttcattttaattttaaaactaatttcatgcttttaaatgttaaattactataagggttttcaactttctgtccttaattctagcattatctattatctaccatgctaatttcctttctgattaattgggagtacgacagacaccagcacaaaaatagcagaggtcaaaatacttaacaaatgagatactgatacaatgcataattcatgaaatatattcactcctgtttttgatcttcctcaattgtaatgcgtcttgctaaatgcagctcaccacattgttttaaatgttgctgaaattttcagattcctaatgtttttatacttgtgaaaaaaaatctcttttggtctgttttgtcattggctttctttataaaagtttcttcttaaaggaatactcatttggctttgtacttcaaagttctctaatatttggttactcatgccagaggaattgtgagtaccagctcataattcaagttaatctatcgataagcaaagtataaatttacttcaccatataatgtaccagcattctattgttttgtgttttcaaagaaaagaacataatttattgttgtccttgcattagtcatcaggactattgcagctgcaagtagcagaaatccaattcaaattattgtattttaaaaaggatgaggggaaactaaaggatgtgggtttgattccaacccagtggctttaggtattcaaatgatatcactaggatgctgactgtctgtgcatttctctcacttcactaactcctgagtttagcatcattttcaggcaccacatggcagcaaattggcccctgtcagtctcaggcttatgcggctcatagctaacaatccagtgtttattatttggccacaagggctatatttggccattcttagccatgagaacacccctggataagtctttgtccagaagaatgggaaactgatatggattaagtgctcaactgagataggaaaggtgaaatggcaggaacagagaatgggagactttaaaaccagagatgcaagatgaacagcagcaataccaaattccagtgtgggttagtttcatttgtttcacaataaagggaaagattatgatgacatttttatcatttgtttgtttttatccctgtccagtaaaatcctcttttagattttaaaatatcctacattaaaagttaaaaataaatttaataagcaaaggcggtcctgctgtattctgggaagtgtctgtaaggctaccgtgctggaagctggttgtttggggtatgtgaaacttcaatgtcagtctgcctgctttctgagattcagatattgagatggtgacaattttgtttcagagcaaagaataaagaataaaaggcaagaaagtaataagaaaaaagaaaacccttgagcaggaatagtaacataacaagatcaccaccatcctttcagaccaacacatttaatgagtctcagagatacatcaagagcatatttcttattccagagtcaatagttagcaactgaaataacctagtggcattaatgctcctgcagggccatttccctttttcatttctgctgtcagaattttcgacctcatcatccctagcctggattaccactttggccctctgcttatcacacctgctttgagggggtcaggagctcaacttggggtcaggctcaccatcatttttttctgagttggagtctctgttgcccaggctggagtgcagtggtgcgatctctgctcaccgcatcctctgcctcctgggttcaagcgattgtcctgcctcagcctcccgagtagctgggattataagtgtgtaccaccacgcctggctaagttttgtatttttagtaaagacggggtttcaccatgttagccaggctgatcttaaactcctgacctcaggtgatccgcccacctcgccctcccaaagtgctgagattacagtcatgagccactgtgcctggccacaccattttgaaatacaaggttaatcatgctgctcatctgtgtaatactcattgacactttttttttttttttgagacggagtctgtctctgtcgcccgggctggagtgcagtggtgtgatctcagctcactgcaagctccgcttcccgggttcacgccattctcctgcctcagcctcccgagtagctgggactacagacgccctccaccacgcctggctaattttttgtatttttagtaaagacggggtttcaccgtgttagcccggatggtctcgatctcctgacctagtgatccgcctgcctcggcctcccaaagtgctgggatcacaggcgtgagccaccgcgcccagccatcagtgacactttcttaactacagatgcacgttttggagcacaggaccttttatgatacatgcctaggctctggcgagtgggaacagcagtcacatgacagtctcacatccccctacctatgagcaggttgcataggtgtcagtgagcgggttgcatgggtgtgagtgtgtatccagtgtacttttctgggtcttagtttcatcacctataatggggaatcaaaatagtgtctgccttgtagacttgtgttgtgagaactcaattcaaaaaaaaaaaaagtgacatattcaccacagcatttggcaaatactaaactttaaatgaatgttggctattctctgacccctctctgtctgtagccctatccatggacactctcccaaatttgtcctatgatttagccacagcaaccttctgagttcctcatttgccactctgtttcacacttcttagccttcattcatactgccccttctatttcttccactagactgaacagtataaagttagtaattctctcttccgtgcttttatatacttaacacaatgccaggcactttgctgaagactgtaacaaatactgctggatgaggacaactatttctttctcaaaattgaattgacttctttgtgtacttgccttagttcagcttcatggtggggtagtgcagaagcctcattgaaggaaactattttgccctagtgtcagggatattctgcaacactgcagaatgggttttgtgggctaagtgtagtgattttactgacagccttttaaaattttctatgctgtcccagagacttcatgaaaaaaaagttgtatgatcggcctgtttcaaataaagctaacattagatcatttaaaaaagaaatcatgtttatttctagggttattagagaaaatataaaaattgtcttgaaattgtagaagcttctctggagctgttttggggagttttggatggggtttattactgctggatgttaagaacttcttctagattatgacttgtcttcttaagactccaccttccctgtgccggagaaaacaaacatgacccctgcaagtgcaggtcactaatattgagggtattgggctctgccatcaaagtgtgaagaactactggccctttcattttcatcagcattgaaccattcaaccagggtgatttgtccgcagtaaaatacattagaagcatttctcctactcaaatgtgtagttgttaattggcaacttcttctgagaactcaaaaatattcattcttccctgatttccatagccagtcttgataaaagtgaccccccaaaaatggtagttaaaaggagaaaagtatgaagtgctaagagaaataaagttttattataaatatctttcatattagaattactttatttgcaattgcagtgatttatttttggtgagttgcccagaattgcttcaatacagtaaatgactgtcttgttcaagacatgcttcttacttgtttgtgtatgaacacaaaactatttgccctactttataaatatttaggttcattttatcattagtccccaagtaaacaaacatctcatccagtgacaaaaaagcaatgtattctaattgtctaatataacaaaacatttttaaattaactttatgcaaatttgataggatatttttcattagttgattaaaatgaaatgtttgaaaagttgcttcaaatatttttcacaattaaaattattgttgccatagattaatttgtcattgaaacacttacaaaaatacaagttaatttctttgcaaactcattgcaattgcacttagagatgtcttagaaataaattataaaatattttttaaagatttatattagctttataataaaatataataaatgatggctttgaaattatttgtattgaactacaaaaggaaatgtcgtaaatcccattctgaaaaactttttattctttgtaatggtaaagggaagcattacatagaatatctttaagataattcttttgaggccaggtgcggtggctcacacctgtaatcccagccctttgggaggccaacgtgggcggatcatatcaggccaggagttctgtaccagcttggccaacatgatgaaaccccatctctactaaaaatacaaaaaattaaattggcatggtggcatgcacctgtaatcccagtatgcaggaggctgaggcgtgagaatgatgaacccaggaggcagaggttgtagtgagacaagaacgcaccactgcactccagcctgggtgacagcgagactctgtctcaaaaaaaaaaatgataattcttttggcattctttgttatatttatttcttagaaagaacatagtgtgtgtgtgtgtgtgtgtgtgtgtgtgtgtgtgtgtgtgtgtgaatgcccttcttcctccccatcctcagcatactagtttcttattttcataaaataagtgataaatttttttggatttgagaatttattaaatcaagtcacgtattaaggaattgggaagcaaatatgagagagggtcaatgaaaaatttaggatgctcacatggtaaatcatgagctttaaaatcagagctgtacataagaagctgtgttttaataatctgcctttgccatgtttcttcttccagttgaatcttccagttggatatccactatcttaaatgttatgaacacttaggatcttgttatgtatatttaagaaacttaaaatgcttattacaaattattaatgcttaggaatttgatttttgccaatgcccaagtaacttattggttggaaactgcatacatttgatagaacaagggctgattataggtgaaactaagaaagataaagctaggttttggagacttgcaccttatatcggagacccagtcctaccatgtgtgtctgagagtttgcatttcctttggctatacattaattcttttaaaaaatttgaaatataatatacatatcataaaattcacccttataaagtgatttctttatacaactttatacaacttagtgatttctagtgtattcaaaaagctctgtaaccatcaccactatctaattccagaatatttccatcaccttaaaaagaaactgtacccattaatagtcatttcttacttccttcttttctagcccctggacaccatattctactttctgtctctatggatttgcttatcctatctctatggatttgtcctataatggacatttcatataattgaaatcatacaatctgtgcccttttttgtctgacttctttagctttacataatgttctcaaggttcattcatgtagtaacatatatcatttattcattctgctttatgattgaataatattccattgtgtgcatatactatattttgtttatccatttatcaattgataaactagaataattccactttttggctattgcgaataacacttctatcaacattcatgtataagttttgtgtgaacatatatttttaatactcttgtatggatacctaggaatgggattactggatcatatgataactctacctttgagtttttgaggaactgccaaactttttcacagcagctatgaaccattttacattctcagcaatatatggagattcaagtttcttaaccttctagtcaacattttaatttgcagttgcctaattttgagttatttatctttttattgctgagttgtaataatttttcatatattgtagatattagatccttatcagagatatactttggaaatattttctcctattatgtgggttgcatttttactttctttatagtatcctgtaacatgtacaagtttttagttttgaactccaacttacctttttctgtttttggttggctgtgctttagctgtcttatcaaaaaatatttctctaatccaatgtcatggaaaattatacctatgttttcttctaagattgtcgtagttttaattcttacacttatatttgtgatctattattaaattaatatttgtatatggtgaagtagaggtccaatccacttctttttgcatgtagataatgattgtttcagcatttgttgaaataactgttctttttggcactcttgttgaaattcaattgaccatggatatatgagtttgtttctggactctccattatagattactgacctttatgcttatcctatgccaataccacactgtttttattattgtaactttgtagtaaattttgaaatcagtaagattaagtcctaccaacttttgttctttttcaggattgttttggctttgctgggtcccttggattttcatacgatcttatagataaacttgtctatttctgtaaaaaagataaaaggcagttgaaatttgtggaggaattgtatttaacctgtagattaatttgagaggattaccatcttcacaacattaattcttcgaaaccatgaacataaacatgtctgtacttgcttaggtcttaatttctttcaacaatgttttatagttttcagtgtacaaatcttgctttttttgttaaatgtgttcctaaatacttttttatacttgattgctattttaaatgaagttttttttaaatttaatttacagtttgttcattggtagtgtatggaaatacaactgaactttgtgaattgatcttgtgtcctccagctttgctgaactcattactaactctaatagttatttctttgtgtgtggaatccttaggatatctgcaagtatttttactttttcctctgtactcttgatgccttttatttcatttttgcttacttcctctgactagagcctccagaatagaagtggttaaaatggccatcctttctcgttcctgatcttaggggaaagcttttagtcttttaccattaagtatgatgttagctgtgaaatttggataccatttaaattaagttcacttaacttgaattagattgttataaatttagatgttgattgtagtccctggggcaaccactaacaaaataactcatcaactcatctaaactacactccaaaaccttgggaatttattgcatgcttccccttctcctgccattcttgatttcagctattttcatttttgctgggcctattgcagaaactttaaaactatttcctgatattccattctttctgtcctccagcttatcctccatactgaaagcagaaaaatgcatatttgatcgtatcatctcacaccatcctactactgctaataaatccttcagtggttcggcattgacttcaataacagatgcaaactccttggctgccatctcagcacctttcttgaaacatcctattacctcccctgcttcttctgatggtctacccttcacatcagacacatacattgacacacacacacacaaatgcacacacacacatccttactcctttaaccatccttgtcctaatcacttcacaaacatgccattctctctctctctctgtcctttccatgtgttgtttcgtctgctgaaacacttttattttctccctcatctatggtgcctcaaattttcaaactctcacattaccttctttaggaagcttgcctagcttccctttttctgtttgatggctttctatcctccactttcctcttctaaccctcaagtataaaattacactttattttaattgttgatttacgggtctgccactcaccttgcccgctgagtttcttgacatcaaattctatttttggtttctggatatctcaagctgaacagtgatatggagtaaatgctcaaaaatatttgaatgaatgcttactactaatagtgtactcatactgcccttctgggtatccagaattaaatactgagttttactcagacatttctccatggaaggacatggcatcttgaatctttccttcttttatccctctttcagcccattctatctgcttggttataattactacagtacactcttcactgaagaaaaaataaaaaaaattttgatttgaactaagtgatttcccgattatttgattcctaatctaagttataattctctgggtcaatagttaaaactatgctcagggttttgtttttatttttttcttataaaagagtgattttttaattcagataatatagacacatgagatataaattaaaaggctgattttaaggccaggtgcggtggctcatgcctgtaatcccagcactttgggaagccgaggcaggtggatcacctgagatcaggagtttgaaaccagcctggccaacatggcaaaacactgtctctaccaaaaatacaaaaattagccaggtgtggtggtggttgcccataagcccagctacttgggaggctgaggcaggagaatcacctgaaccccggaggcagaggttgcggtgagccaagatcatgccactgcactccagtctgagcgacagagtgagactgtttcttcataataataataatagaaataaaaaggctaattttaatgttaatctcattttcctgaggcccactggaaagaatgcagtggtggcagggctagccaaaatgagataaaaggatcacagtttctccaggtaaggcaaagtatacgttgtcagtgcagaacaggagtagccattgtctggcaccccagtggatccccaaggacacagactttcattgtgtggtttagggaaaggcagaaattatattgtagagattcagcaattccaatgacagattcagagacttgattgtgttccatcagggtaccctggatgatagtcttatgaatcactccctattgaagcagtagatctgactctagtcattaagggattcatttgcttttgcataacaaacccaccaatccctttgtaacatattgctacctcactttcacatttcaaatatagacttgtgcctacattcaaactgatgaattggaatcaaattatgttacccgtctttaactaacatcaggtggagtgtcttgccccctctacccactaaatcttttattactttggggaagggacactggcaagccccagatattgacttcagctttctcttctgaagatatttcatttttggtgaactcttaaagccatcttagattaataccaaataggagaattttgggccctgtggcaggttgacaaaacttcctggtacttcatgtcataaacactggatcataatggctctttaataacctgaaaatgttgacataaacccatggcttatggcattacctagagtcatttagatactgagctaattcaaaatttgttaggcaaatgtgtataccattatgataggatatttaagcccttagtaaataaaactgtacttatattttgcaaatataaatgtaacatcaagcagctatgcttagtcagttttctaattgggaaatatccgtgaattataaagcatgacttaaaatatttaatttgtaattagcgtagaattacaaagataattcataaactcactgtttacagatgagattttaattgtgctttttaaggcttaaatatctctatcatatggcatatttaatgagtcagaacaatttggaagtaattattattatgaaaaaataattctgtggcctagataggtactgcagatgatatgggcttactgactaaaattaaaaattggaagtaagagcttatagaaaatgtgacactagcataaactaagaaatatagagagaaggaaggaaagcctgtaaatgcttgacattttatgagatatttcatttactgtgtcacattagactgatgatctaattcaacttccttgtttcacgaatagagaataaacttgagattcttcaaatggccagacgaggatcacacaacttactgacaccatcctggggtagaacccaagtttctaagccatcaattttatgttgtccccataggaaactctcattatgaaacaacttctcagatgcctattgatctgggtttaaaaaatacttaaacattgtcagaatgtgttatatgtagtcttaagtatctcagagtttcaaacataaatgttcttgaggtcatatcttttccttcatgatatgaagaaaaaaataaaatatttttcctaacaaagaaagtggaagtataaagtctattggaaatcacctttctcttatgttgatgtataaacagaattccatatcttgtctggttataagcactatcaggacaatttttatttcaatagttaaaattgtacataataaagaattataatagctacttaaaacactaaaagttaatgtggctttttataggtttaggagaacaaatactgaactcttttgtgggaaaactcagagcattcattgttccggttatatctgaagttatttacaagtataattcatgaacttctattttatctgttaaacaaaattataggaggccattgttttggactgagctcctgttctgggccccaacaaaccagaccaaaccaaaatggagtcactcatgctaaatgccaaataatcaaacggaaactttaaaggagcatatgcagtcccaagcagaccagtttttcctcaaaataggagattctattctatccgaatcagattaataaggaagtccagtctgctttgccccttacaaaaaaaagtaatctagggctgggcgtggtggcttatacctgtaatcccagcactttgggaggccggggtgggcggatcacctgaggtcagaggtgatcaacatggtgaaacctagtctctactaaaaatacaaaaattagctgggtgtggtggcccacacctgtaatcccagctacttgggaggctgaggcaggagaatcacttcaacctgggaggtggaggttgcagtgagccaagatcacaccactgcactctaccctgggggacagagtgagactctgtctcagaaaaaaaaaaaaaaaagcaacccagtgttaaccaatccattttttccttattcccactttttaaaaaaaccactgttctgctatagcccagtgggagctctcattcttttttataaaacggaggctacttgattcatgtgtctcaaataaaagccaattatatctatcactaaatttgttgtaattttatcttttgacatatcctaagccatccatgctttataacttgtaattctctaaaacatattttgtgattcttggtatttataccaagaatttctctctctctctgtaactctctcactcacccactctctctctctttaatttaccctctggtccctatctgattatttggcaaataggactgcgaatactccctctgtctcttcaagctgctctcatcaaaagaaggaatttacacatattacataatggacagaaatgtttttgccccaattttctcttagtttaaaggtgcttcttttcttaaagggaaatttgcatttttcatttcatgtttccctttaagaacatacttacatacttttgtgtccacattgataaatttatttgaaatactgctctttggggatcattccctaattgcatgtattcagctataaatattgataaatataacaaaattggctgggcgtggtggctcacgcctgtaatcccagcactttgggaggctgaggagggcagatcacaaggtcaggagatagagaccatcctggctaacacggtgaaaccctgtctctactaaaaatacaaaaaatcagccgggcgtggtggcgagcacctgtagtcccagctactggggaggctgaggcaggagaatggtgtgaacctggcaggcggagcttgcagtgagctgagatcaagccactacactccagcctgggaacagagcgagactccatccaaaaaaaaaaaaaaaaaaaaaaaaaaaatatatatatatatatatatatatatatatatatataaaacgaaatcacagataaaatagatactcaataatcattatagagactagcatgcactgctatttagatatacatatttaataagtcatactggctctttagctgtacctaaaacatgccaaatccatttttgtgtcagggcctttattcattattctttcttcctttgataaaaaaaaatacttctttctatgctaaatgggatattttgtagatcataaattcgttagtaaaactctgaagaaggtactactgctttctccattttacagatataaaactaaggcagagacgtttagcttttgaaggattaaatgagataaagtacttagaacaaagtttaaaatgtagtaagcaatataaatattactgtatataaatgtgaatcaataaatattagcttttatgatctgatatgtaaattttttgcatttctgtaattcttttcccaaagtcactttacaaaacacaattttcttagctgatgaaagaatttttataagcttccagcctaaagctcttctgtaggcaagctgtaaaaccatcattcagaagttttaactgtttaccctgaatccttttaaccataactccggtttttgtactatagtgattagcagcagtcaactgataggatgtgattggaacagttgtgagggaaaagaaaaaaaaaaaaaaaccttctgacttgaatggatcataataatgacctgccaccctaagtcaccaggaagcacttaaattatctttattttagtccattaaaaaagcaaaggtatatgtaattatatgctttagaagttctacctgagctgctgaataccctgtcatgttttcaatacaacttttaaaatccataaatacttcagaagaaagtttaaattgtcccctttcatgttttctgcctaagtataattttcctagataggcctttcctgatcaccacatctaaaatagatgtaaccctgtaacccactagccccttacatacttgctgtatttttcttcatagcatttatgatttcttaatattatatatccctgttatttagttgttattgtctttttcctcccctaggatataaatcagaacagctttttgtgacaattgcggtgaaacagcttttcctggttttgtgctatattcatggcacttagaacagtgcctctcatatatagacattcaaatatgtgttgaatgaatgaatgaataaggaatagaaaaccaccaaggaacacagcaggaagcaatgatttacatttatactatctactataattttaggaatctcaaacaatttttcttaaagcctctgtattattcaacatttactgatatttgcaaaaagtttatagcaaatcttagtgtaatctcaaagatacattgggtaaacttgcattattcataatgtagactaggcaaatataaacacagtacatgaagatactaagtgataagcccaagcttgaacagcttgtctgccttaaaagcagtcaacatatttcaactgctgctactaaaagtttcgttttatttattatataaaaaagtgaagacgtcccaatattttttctctgtcacctctgtatatatagtttattttatagccttcaccttacttaattttatatcttgggactaaggctactattttccaaataaacgtgctcatatatctaaaacaacagtaaatgctacgtataaatatgatatacaaattcaggttaatgagacttgaataagattgagaaaaaaggaaaatatttaaaatagtacatctttttagaaatacttacatattgatttcctcatttattcaattagtcaatctacatatatatatatatatactttctaacaaacagtattattaaaagacaactaaatgtgatagaatatatgttaatgaaacaaagataaataatattgtctcatctctagagggacttcagtgggggaagacaggaatatcaaatatgtgtgaatgtgtctgcacacacacatacaccatatatatatttagtgttctgtcctgttcaccatctgctactgcttcccacacaagttcttctgtcctctgaaagctctattcttctatccacctgactgctaaccaaatgatctcacctctaagggaactggaggccatacatttgcttagtcataagtaccactgtttcccattttcccatttctgtatttaaaaagtgtttctctatctgcatccaagatcacctcattttgtcaagcctcagaggaggttttctcctctttttctggactaggatcatccttccatctatatcccccacctctattttttttttttctttttaggtaaaagggtcttgctctgttaccaggctggagtttagtggctccattatagctcattgcatccttgaactcctgggctcaagcaatcttcctgcctcagcctccagagtaactgggattacagatgcataccaccatgcccagctgattaaaaaaaaaaattcttttttttttgttgtagagatggtgtctcactatgttgctcagcctggtctcaaactcttagcttcatgagatcccacagtgctgggattataggtgtgagccactgaacctgaccccgtctatatccttaatctgatgtcttctcttcaggaattttcttgcttctttttcttttcttttcttttcttttttctttttttttttttctcgagacagagtctcactctgttgcccaggctggagtgcagtggcacgatctcagctcactgcaacctcggcctcccaggttcaagcaattatcctgcctcagcctcctgagtagctgggattacaggtgcccaccaccatgcctggctaatttttttttgtaattttagtagagatggggtttcgccattttggccaggctggttttgaactcctgacttcaagtgatccacctgcctcggcctcccaaagtgctaggattataggcatgagccaccgtgcccggcctctcttttcatcttttatgtatttttttagcttttctctctctactggctctttcccataccctgtatttcacctctgggttgttttttcatagttcatctgtgtgcagcccataccagtttgcatctgagagtccattgtgagcatctcttcccaacattgcatttggtgtcacactggtagattgaaattgccctcactatagtggggttatttttgtgtgggaaattggcaaattctatgaatcaaattcccctccactctccagcaccggttgttaaacatttacaggcaaactgctgctgtagtccctcaccttcccttaaaaccatgttctggaaaagagtatactctaaatctatcagcttcttcacttcacatcaaatctctgaaactagacagcttcccttgcctctactggaagtcctataccctgggagtcatcttagactccttgcttttcttcactctgcaaatccagtcagtccctgactatctttctgtccctcctcctccatcactccattctcactcccagctaccttctttcaggtctttaccatttcttacatagattgttataatcttctcccagtttgtcctcctgccttctgtcagactcagcccattcttcccaatgccactggaatggtgtgttttaaacatttaaacctgatcaagtttcttccctactcaaaatccttccctggctcttcacagcctctgggataatgtctttattatataatactttgtcatttccaaatagcagaggaccatgtccagatcgcttaagcaaaatggaactaatggcaactgaatattctagagaatggatctaggttgaatgatgtcaacgggaatttgtttctcttcatatttcagttctgctttccattgtgttggtttcagtctcaggttcggtgtgatagcaaggatggtggctgccactgcagctgtataatgtctcaactttaacatatagcaagaaagaaactagaaactccaaccttcccatgaagagattcataattatctcattgcaactgggccatgtgcctaccccaaaggaatcaccattgctagtaaattgtaatatgttgattggcctgtatccaagccacatgaaagttaaggaaggtgtatcctcaaatggaaattcaaactcttgctggaagaatggacagtaggaaagcgactacttataatgaaagcatctaatatgtatttagcgctttgtatatctcgggtagtgcttcagtgttttgcatgtgttaacttaatttttaaaacaacatcatgaggaagggagaaaactgatatacagaaggcttaggtagtttaactaagttagacacagcaaattactggtgtttattgcaaaatacaaatttctgagtatgggccttcctttactttcttacctaataaattcctgagaatatttgtaagccagatgactggtagttcagaaactaacttaaataatataaagtgaatgtgttacatttttaaagagctaaaaaccactggagatttctcacattccctgtcttccacagcaccagatgacttttagagtgcatagaaatgtcaaaatgggtggggttccctggttttaggaggttaatagctcaggattgggttggggtggagatgttaagtccccagctgcttgcagcagatatctgcttcccacgaactacagtttctctcctaatccctccacagggatcagggtacaaagatagctagccaccgttttttgtttttgtttttgttttgttttgttttgttttttgagacggtgtctcgctctgtcactcaagctggagagcagtggcacaatctcggctcactgcaacctccgcctcccatgttcaagcgattctcctgtctcagcctcctaagtagctgggactacaggcgcgtgccaccatgcctggctaattttttgtatttttagtagagatggggtttcaccattttagccaggatggtcttgatctcctgacctcatgatccatccgcctcggcctcccaaagtggtgggattacaggcatgagccactgcgcccggccaatttttttaaacttctacttgagtgaaaaggcaattacataggattccggcctttctcccagtagaagcagtggacaggaagaatttagccagctgatgcatgaaaagtgaaattttgtatattatgtgtaacactcttgtattcctttccagtcttacatcttaccacatacccctcacattcatcctttattgtaaaatcccgtatgcctttctcttacatgcctttcacaattcttttgtgtcttgacaaattctacaccatctgcatctgacacatcatctctcaaaagttgtgtcaagtgtcgtcttcttagtgaacaccttcctggaatcaccctccttgtgaggaaacagctgtgcttccttttgtccaattgcacttaaaagaacatttgccatagtttctgtaactaattactgtgtttctgtatttatgtttgtctgcttctcttatgctgcaagatccttgaaagcagggagcctattttattatttcttatatccttagaaaagtgcctgacacacagcaggtgctcaataaatgttagagaaattaatgaatgacataagaacacatagcaggtgctcaataaatattagataagtgaatgaataacataagagatatgcagaaaatataacaaggactcctaattggcaggaattaaagctggttagagctaggagggatgtgttgggcaaagcttctcactctaagattctagatttgagaccattaaacacatatattcctgcaataaagatagcctttgctatccaaatatttactgtcacattttgctagaattttcacaaaagttttagtatccaaatagaaaattctatcataacatttatataagtgcaagaatggaaatgtttaagtcgtaggtgagtccatgtaggaggatatagagtatctccatatagaatcatgccagtgtcttctaaggaagtagaaaagcctgtgaagaaagttggtgagtacaagaggtctagaaaatcccatgtattaaaagaaatattggtgcataaaatatacagagaaagattaacacataaaacatacgtttgatcatgcacatggctctctctataatgcttgtattttccacatgtaagacaattttaaaatatattatgattattggttttttgaaagcttccctgtgtcactcaagcataatatggtatgtttgagaagctagagacctatctcatgtggtgggtagacaatcagaaaaattgaaaccatggattacctactgatggcgctgtaattctttgaagatctgaaggagatgaaaaaatttgatcattcggtaaaaagttgactttcagctgaaattctggactagtacaaaagattttaaaactatgtaagatagatggaatcattggaatgaagatcatagaggagggaacatcttggtaatggggttgcagcagtttattccaccccccctaccgccgccagtgaattgaagaaaactatcgacaaaggtagcaaacaaattttcagtaatataaattttcttgatataatttggctttttataaataagtgttatcagaagataatgaaaaagagctagaatattacgcatccaaagataggttagcataacttttaagtgaaaattgtggaggcgatagtaaactaaaacctctctacttgtgtaaatctgaacagccgggactattaaagaaatgtggaagggtaaagtgtctattatgtggttcttaaatctaaaacttggttgaaaaaggaagcattcagtcatttttcaaggagtcattgtttccagtggtccattttttaggggtatagaatcttagaacataaagaattgtggctgaggtttgggtaaatttcatttaataaaataaatggttaataaagttgctgtgaagaaacctagtttggatgataaactaagaaaatttctttttttttttcacatcagcatgaatatctgaattatttttccatccctaattcattttgccagtggcaacatcatttctccaaggatgctgtggcttcactgaatcttcagtggtactctctgaggtttagaggccctttctgttgagttccaaaaaatggaagctctggctgggcgcggtggctcacgcttgtaatcccagcactttgggaggccaaggcgggcggatcacggggtcaagagatagagaccatcttggctaacacggtgaaaccccgtctctactaaaaatacaaaaacaaaattagccgggcgtggtggcgggcacctgtagtcccagctactcgggaggctgaggcaggagaatggcgtgaacccaggaggtggagcttgcagtgagccgagatcgcgccattgcactccagcttaggcgacaaagcgagactccgtctcaaagaaaagaaaaacaaaaaaggaagctctttggtgttcgattttaattaagcatgtccgtgtctgtggagtgaaagccaaaggcttttagagaataggcaattcttctctaggctcaatgaaaggacttgtttaagagaagccaattgatttttatcacgttgtatattttccaataatgccctaaagaagaaaacattttcctaagcaaagagtgacatgcagatttcttttgtgatccgtatttgtgaaaaatgcctcacttcaggattgcaatatgccctaacaaataatactgcctgtgcctgggggctgagtagtggttatcaccggagaaggtcttaccctcttagaagtagacattagttttctactatctattgtttgagtatgagtcaaacagtagatgcagatgccttcactgtctaacagaggaaatatcaataacttatataacctttataacatagcaattcaactaaaattgacttaacagatatttattgattgttgattgtaggcaataaactctactaggttgtacagggactaggaaaaaaattaagatataattattgttcttgaggaattagtaaaagccagatcaaataagtaaataagtagttattgggtttattttgcttttgtactttttctaaaatacctataaatgattaattatattttatgtgactattactatatctgctctttcattgactgtcatttgttatgacaaaagggggctctctgattcccatggctagaaacttcaaattcagtatttcttaaataataaatatttcttaagtaggtaaataatatcatattattaacatttagtgttcacctttcacagataggtaaaccgtaacatgagttttctgatgaaccttgttatagaaatatgtacaaaatgtataaaatgtgaagagtacatatatgaagggaactgaatttttccaagttttgaattaaagtgggtattgatttttgagctagattttgcaagactaatatttctattcaagaagggaaaggacattccttgaaatgggaacataatgatcagtttgttcattgtgaaacataaggtcatggatgcatttagtttatttggagagaaaccaggtacatgttgccaggtttagggggcacgaggggtgggaaagtttaggatgaatatcaacaaggtgacttgggctgtgctatgaaggacattgaagcaaagtctgaaaagtcttcagaaaacacacacaaacacacacgcacacacccctacctatttatatattgcattcctaagtgcattgtgttcaaaagctgattttcctcgacttgtcccacgttacttcggaacattaacatgcttatgttctgagaatacagaaagattcattaaatgtgcctaagatattttctcatttgaaacatttattttaaaaaatttaatctgctgcttttttttaacttaaactgttttttggcaatcttttttattgggcaatccacatgggtttgaacctttaatgactcattaaaattgattgtagattctaaaaacattataaaaacattgataaatatatcaaaacagctggttttgagatattgtacttttaaaaaatgattatttatttagtgctacccttgagtacaataaagtacacctgaaaaactttgagttttgaaccgagaattctgtttaattttgggctagttccaagtgaagagcactgtgctaggccttcagcagagagtggaaacaaacacactgagcagtagtaatccgagggaagacaagccagaagatatagcataggccacactgaggaggatcccaagcgtaatagttaggttgtaggaatagtcatcagaggttttctaaataagaaatttgcatatgtaagtgctttcccttaataaaattacattgtaatatggattggagggttagagacaagtttgaaggccaatgcaataatttccagctaatttccagccagtgatgtgcaaactgtgtaccaggaacaccagtgatcagtggagaggattcaagtatttgccaatgatatgttccccatcaaacactgaagattttttaattttaagaatttaaaaaaattagggtgattttttgattattaggtttttgatcatatgattttttgatcatccaaatgatcaaaatgatccaaatgttcaaaaaatcattatattatatgttccccattaaacactgaagattttaaactgcccaaagaatttaacttttttaaaaaattaggatgtttgtccatttttaagattttaatatgttattcagatgctttaaaaaatctgaaaaaaataaaccagtcaagacaaaagataataaggatttgaacttgggggatggcaatcagaataaagaggagaaagtgacttcaagatatgtagttgagcagtaaacaaagcaaaacagaaacgaaaacaacctcggactaccatttaataaaaaatcagggaaaattattctggaagccaaagaaaaagatcaactccatagattaaaattttgaaaattatctcctgagaaaatcacattagatagaactttgaacaatattaccatatggaaaaatggtgatggatccatgaagaacagtgaaaattggagagcttcgatgtttcagcaccctggaagtcaagggttacaagttacccaaagagagagggaaaggaaagggatgggtatagcaggcaaagggaataacacgtcaacatcctatgagctatagaggcacaggtgcactcaggaaaatgcaaaggagaaatcaggaacaagtgggcggagtggagtctgacagaagcctattggaatcagtagttaagtcaatacaccagttgactggtgatgagaatgttagagtgaagctcagaaaacaagagtggatgtaaaaaggtgaaggctgtgggtatagggtaatagttggtggcatttgtgaatacagggaagaagtgagagaaagcaatagtttgaagtcacagctgaggcaaggaaagattgtacagaatcagaaacagaggagaaagaaccagtaagaggcagacatgaaagacggaggcaccaaagaagcttacaatcgcattaaagttcaggagaaaatgagatcaacgcacagggacaaaagttgtctttatagttcatatatgaatgaaatgatcttttttctcagaaaattatagcagtatctgatatagttaattattctcgagaaaatatctcaaactgttttagggtgatctttgtttgaagtaataatttatttaaaagttgctgtaaggttcataactgtttagttctctggctatggtaaatacttcctgtaatttgaacataaggatatttctgaagggggtgcttaggctaatcacaaatatagacatgttgctgtgataaatgctttagactaattactgacatgctcaattgaatactaatacttcccatgaaatgactttaatacaagtaaaatgacagctgcactgcagtgagaggacacataaaactgcattagtttgtctccaaggttaccatctgtgctgatctgaagttttaatgtgtgggatttctcaacctgtgcaaagactgtattttcaggataggtatcaataggatataaaagcagcttggaagctacttaagcatttatttgggatacatccatgctgaccttaatcattcaattgttctagagagacacatatctgtgttctgttagaaattttgtgcaacgattggggaaatagaatgtcaggattatttgactccactttgcatatacaaataaaaagatgtgaatttacatgttgtacaactgaactacattctggataaaattgaggggcaaaacagatttgaaaaattggatgacttctactctagagttttcatagttattccataattaatattcaagtttcaagaaaatatttaaaaacttataaaagtatagacattttaggagtctagaacctataaatacggctccaaattaaagaaatggtattttgatagtctaaaaggaaaagagagactgctgttagttcaaaattgtatagaacttaacatttcttaatgtaaaacatttatcattttttcaacaaatgttgattgaataccttccctgtcctaggcaccgtgctaggccataagtttgcaaagtcattaaaacttgctgtctgtcctcaaggaatttacaatctagatggaaaacagaccagcccaggtaattaaaccaccctttctgaaggttgtcatggaataagaacaggatgttgtgaaagaacataggggctgcacataatgacgattaggcaagtttggaagaaatgatgtgcatgttgagatgtaatgagttagaagttagctgagcagaggggaaaggaaagggatgagtgtagcagacaaagagaaaatagcacatcaaaggcctgtaagctgtggagacacagatgcattcgggaaaatgcaaatcagcttagctgaaatatagtgtgtattggggagcaggggaaaggaggtaagggtctcagtgagagaaggtggaaaggaaagcaggtgtcagatcacctggagtcttgtgaaccatctcagggaactgatactttactgcgagggcaatatagagcaattacagagtgttggggaagacatctattaccaccagcatctccttgttcttcctcatgattgtcgtcatcatcattgtatgaactcactatgtggcaggcaatatcaagttagttcatgcatttttacataaaatttttatcatgagcttattactacatctaatattcctattttacaaatgaagaaataaacaaggaatgcacttagtttccccaagctcacagttaccaataagcacagttggtaatcgcatccaggagtttctgacaccatagtagtccctgcctctctactctgcagttcttatgtagaaaatgactgtgttccaccaagagcactcagtttgcagtgtattgcaatgatgtattagatgacagctaaactggaaaggggggctggttatgaagtcattgttattaatcaggcatcagaagacagtggatagaggtagtgagaatggagaaaagtggatgtgttccaaatatatctcagaggtagaatcaaccaggcttagtgattaactggatgggtggaacaatatacttctggcttggacgatgagtatatttcaggaagtgtatttgtaaaatccactggatatgttggttctccaagaagcagtaatgtcagaaagattacatttatacatttctggtaggaatgtaaattagtacaacttctatgaaagggagcttaccagtgtgttttagaatttaaaatgtgcataggattgacccagaaattttatgtgtaggtatttatccacaaatataaaccgatattatatcatgtgtataaggatatacactgcagcatcttatgtaattgcaaaatattgcatacaaactcaatctccttcagtatgagattggctgatgaattaaggtaaatccattcaatgaaatgctctaaaatcctgaataggaatgaggcatctctatatgtgtattgatggggaaatattgtatatgtacatgactttatgactgtatgtatgtaaaaaataaaggtgcaggtaaaactgtatatgttaggctgccattttatcaaagccaagtagatagatagatatcgaagtagatatagatataaatctgatagctgggtacagaggacagaaaagggagagatatttattcttcagcgaatatccttttgattttactctataagcatagatttcttattaagaattaataacaagataacacaaattataaaaattcaaggcagaaccccctcttttaaaatcttgtctctagagaaagtttaccttaagggaaaagtaaaactgttagtttggtttccttgtttattttgtgcctcattaagaatttaactatgggctaggcatggtggctcacgcctataatcccagcactatgggaggcagaggagggcagatcatctgacgtcagaaattcgagagaccagcctggccaacatgtcaaaaccccatctctgcaaaaaaatacaaacattagccaggtgtggtggcgcatgcctgtagtcccagctactggggaggtgaggcaggtgaatcgcttgaacccaggaggtggaggttgcagtgagtcgagatcacgccactgtactccagcctgggcgactccagcctgggtgacggagtgagactctgtctcaaaataataataataataataataataatttaactatatagacaatcaattttcacaggaaaaataatatctttccccaatgattgacttatatccttccaaagtcctggagttccaaaaattcataattcaagtgtaagaatataataatgtcactaaattattatttttgagtcattcaagtcatattgttgctaacattttattttgttcattttttacattaaatttttttcttattttttaattggcaaatataaattgtatctatttatgatatacaacatgatgttttgatgtatgtatacattgtggaatggctaaatcaagctaatgaacatgtccattacctcactaatgtatcattttttatggtgagaacattaaaaaatctgctgtcttagcaattttcaagaatgcaatacatcgttattaactatagtcaccgtgttgtgttgtacaatagatctcctgaacttattcctctagtctaactgaattttttgtgtcacttgactaacatcttcccactacctccagcctgccgcccctagtaaccaccattctactttctgcttctatgagttctgcttttgtagatctcacatatgactgagatcatacaatatttgtctttttgttcctggctgattttagcgtactatctttcaggttatccaaattgtttcaaatgacagaatttctttcttttgagaaatgtccattcaggccctttgcccatttttttttttaatgtatagtatattcagagctcaggtatgagcattgtaagtaagcaagctcaagcagagtagagagcctaggttaggaaatatcaataaggtaagtttatagggaaaccagaaaacaagaaagaggctttagattttatgtgaaaataaaaaggaatccaccttgtaaaactcaaaagagtctaatatttctttgataatttgctctgctaacatttatttgaatctttagcataaaagtcttctcttcatacctcatgcattttattcttcattttatgcccattagctcttgtagtgccctgagtggaattcaaatatatatgtacctcattacctgcacagtacatctcttaaaacaaaatccaatggacccttggatatcccagtttgaaattatctataatgtttagtatcccctttggaattgaagcctaattttctgcaggcaaggcaatgtcattcactgtgtacacttaatgcttatggtgcttatggtcaaaaccttgaaccattttggttcttccaagaaccatttttatagatttactgttttaaatatgaaatatagaaaacctatatttattatgtggtaggttacttaaactgatattcacagaattttaagatcttaatgatacagcagcatctaggtatgtatagaagtagtttagaaaaatgtgtcttttgcttaaataaaatcacttcacagaagatttgtgaaatggcaaagtaattacaactaaacgaatttattagaatatagtattttttttcagatggatttgaagcctaaaatctcattcatgaataaaatgattaaaatgattattttggtaaagtatcatcccaataatccattgttgtattcaaggactcttcacattttaataaatatgttaaaagagagagggtttattaaattcacatcctattttccttaatattgcactaaatgagtgacctaaagagaacaattgtgtctatgcttatagcttatatcatagctgggcattcaggggaagtcaaatcactccatatattttaaaatgtttcctctaatatgaagatatagtctttctcttgtgaaaaagggacagatctcactcttagcaatgttagaattttggctgaaagctatgaattcatatgtaagtgtggagaatgatgttggagatttgtgttaagattatgaatcaccaaaatgaacaaaaaatttaaacttatgtgaagattttaaagatgttttctctggaaagattacattgataagcaatcaatcatttacatgtaattaaaaaaataacaagcccaatacagggttttttaaaaaaatcacgtcataaaaaagtaaatataacaggctttttaatttttttcaactcagtaagctttgagtgcctgttaggcacattgtgcctattcttgacaaaataaatcagatagttataagttataaaagaaaaggaaagatgatataacaacaaaatgaatgttagagtgattagtataattgctatgaatggtcactataaatttttttgtgtgcttggatatttacttataaacatgtaagttttttttctttttcttttttttaatttttggtgtcatcagaaaaaatgcaattctttaatatttatttcattttagaaatctacatataagcttatcaaattccaagttggtagttattgcaggtaaaggacattgagtaaagattgcacttttaaacattatggttaggatcttaggaaattatcctgaactttaaggactaaaaacaataccctgtcaaagaaaaaatgcatcagacagagttaaacagctgcgaggaaaactggattccatattattgcaatagaggagagagactgaacacaactccgctaaaacaaaaggcagaagtgtttttaagtgctggattgagcttgcagaaaagttctagaggacattgagtgagggcatggttggtcaatttgattatgccatctttgtttactaattggcacttatttaaattagacttctaccctcccacagggagaggcagctagcaaagctatctttttcaatggctacattttaaagggatggctcccaggtccttgagaaatacattactggattatgaaactgacaggtggttgacacaagatttgcatctcaaaggggcagagaatggatttacaattgcaagtttcctgaagtaaataccctaaggaaaaggaagtcaggaggccatagacaggaagaaacccacctaaagtttagtcaaactgagggaaacattaagtctatcttggtcaactcttcagttatactaaattgtaccatgtacattgacaatatttgaccatttttgacctacaaaagcaatgggttcatatgactctatctaagattctaggatccagtttgtttttgtattatttttacattctgcagaagcaaacaattctccacttatggtttttagttttacactttcttatttcaaaaaggacttagggggattttatgtgtatttacattaaataatatatatatttatgcatatgtttgtatatatctgtgtgcttatttaaaaaaaggttaaaattgaagttggcaaaaataataataaaaaaaaaggttagcagaagtcttgaatacttcctaaagaaatgtcacaggtttgtttcagagcttcccataagttaatgcaaggaaagaagtgtagtaagttgcagtaatgaccctaggagaaaagcaacccagaaatttagaataatagttttacaggtgttcagacctaacacaatttttccctttaagtgctcataaaggcaacatttgtgtgttggcaacttgtccactaagcctaatagttgatttcatagtctgggtttttgctcgttgattgtttttttttaaatgatgtctctcaatgcaaacttggcaaaactccacagtgtaatttagtaaaagcaatttgattaggtatgaaaataacaacatccagatacacagtcctctaaagatggaattaaatatatctagaagaatgaattgcatcagacaatattccatatatatgtgtatatatgtgtgtgtgtgtgtgtatatatatgcttttttttttggtaaactgaaccctcgataaaaatgaggcaatacagcttggaaacttttgaagttaactgttgtggtgtcagaatttggagttcctttgcctttacagatgtaagtctatatgccgtaacaattttaccaaggacaggatagacagcctcttttggaatgtaaacagacaagttaggatgtggatgaaacttcatagctgcttacttcactggcaggccaatattattattctggcagtcagggtccagctaaaattagaattcattaaaatcatggttcttgctttattccttgatagccactcatatgcgcttgtatgcacacaacaattttcagagtgtgctttatttttgtgcttttttaaaaatatgatggcctctatgttaaatggttttttataggtaaatattatattttattaatccttgtatcattaatactaatagtaatagggcacgagaaatattttgtttgcttatgaatgacttaaggaagctgaagtttgatatttaaaattataaatataaaatgtaaaattgtcagtaaacaatggactgattccatctctcctttgccccatgttttccgctttgcagtaagtaaaaaaaccacaaaactttgggggtcaaggtcaccaagtctcaaacgtggtggcagacgctgctagttttctgccagtatccacttccccaccttccttaccgacaggcactttggtttacggttaggacactagatgcccggaataatggctgcattttccaattgtctttagagtaagagtggccaagtatctaaactcaggccaataaaatgtaggcagaaatgtcatgtgtaaatgttaggaagcatccttcttttcttcgtcctcctttctgctggcaggaatgcagacatattcgctggagctcagcaacctcttggaccacgaaggcaaacacatgattgagaagggtggactacaagaaagaatacacctccttccctggtgtccatggagttgccatatatgccttggccttctcaggtcgagatttatttgtatgaaagaaaaataaactttttttaagccactttatttagtggctttttcttaaacttgtagcccagcctaatggtagtcatttggggcacatctttggaaatccttcccaactccctgagactgggctggaagcccccttttctgtgctcccacatgccctgtatgtgcctttattagaacactttccctattttattgaaatcatcttattttacataaaacattatttgagcacaagaacaatgtcttattcattcatccctgagctaaagctaggatagtgtacgttcacataggatatgctcaataggtatttgtttaattgaaaaacactggattaatgacctgactgaataaagtgctaacagtactatggaattaatttgattgattttgattcaaaatcataggacactatagtagatgtcaaaatacatgtgtggagatgtttgtcatatttgttacatacataacaccctggcttatctcccccatgttaatcaatataaatcatttttcctattatttagtggaataatttaattcactaaataatttagtgaataatttaattcactaaataatttagtgaataatttaattcactaaataatttagtgagtaatttaattcactaaataatttagtgaataatttaattcaccgtcttatttagcgaataatttaattcactaaattatttaatgaataatattttgttaaagccttgggtgtgatggcaacttgtgtcatggaattcttttctttctttctttctttctttctttctttctttctttctttctttctttctttgctatgggctaatcaggatctttgttctaatctttttatcacaggtatataaaactgatttggagagtataaccatatgagaaaatatttggttcctccaaatcacattctctcatttccctgaattctctactccggggatttaacattttattaactgttcagatggttttaaaagtaaagcattcagcttatcatatggttggtttaattttatctttggtttattacatgtcttatattttaagaaaaagatcatattttttgtgtgtatcttataccatgacaaaaccattgatttggatgaaataaatctgtgacaaaccacatagaccaggtactagagatattcatttatttcttttctttataggtcctctcaaactgtgagtaactaagtggtttgtgcatcattccagaagcaaagctaaaatttttagcggtgttgtcgacttgacctgctaatttcctgttctggaatcgagagaagactcctcaacaagttgctgcaatgtctgtgtctaatctatcatggtgagtgaatggttttcttgccttaaatgtaaatgaaaatatatcatgagcagtattttctgagggagtcgtacaggcagaacttgggcagagagaaaacttaaaaatctggtttccaaagattattgtcccatgttagcgtaaagaaagcaatctaggattagaagtctgacactttcagtgctatgatatctgggggctctggaaaggattgaagcctcgcactgaatcccagtgacctccaatacctttcttcccagcacaccctaggagagagaagtaatattatatcctttcagtattccttgctatcggtatattcccagatataggactagcaagctatatgggtggctgccagtgtggggtagatatttgctcatcagtacttctttgcttcaggttttatatttcaacaaatctacccagattaaactgaatagaactgaaatacggaatagaaaaatttgttatagatgcacatctctaaatagctggcattctaaataatctttgactttcagtgcatgtttaaaagctgtttgggatttaaaaaaagaagtgtaaggatatttttctgacaaaaaatgagcttttctatagcaatgaagaacaatactagtagggataaatttgaaggtattttattgaactttgacttttttatataacgagatgagtaagtgacatttatataaatttacagtattcaatacatgaatataaggaaaatctggtaattttttccatttctttaagaattcattttatccttgctcttcaatttgtgctggaaatgtagatagcatcagattaaacagttgttactggctcaacttagctccataaatttatttttagtgaagtcagcaatttttttagggcaaggatgtaattatttgtttagattcggagtcatgtttctgaaggacccactgttcatggactccctagaagatatccttggatcttttggcctgggtgctaagaatctcagtttgaaaaaaaaagcattaaagaaactaaagtataatcaaacaaatttcatttaaactttgaattattactgcacagtatgttttcttattatattattattaaaattaaaagtttttaaaaatgtaatttttgtagaacctgtgagtcattttgagctcctgggagaccttgacacgtttccttaaaggaattatactcctggcaaattgtgtgtaggagatgaattctcaaaaagcagggagcatgtcaaagaagggggacaggagggttggggaaaggaaaaggaaagggcaggagattgaaacaggtatgattgttgtatttcaagatagtgtgcagtgcagcctggttcacagggtcagggcaggactaacattgaggcctggcctcggtgcatgcttctattaactgctttgatgtgatatgaggatatgattgttgctccaaaacacagtgaactccgcaaagagagagactgcatgtcatggttccagcccaattgtccagcacagcacctagaatttagtagatattctgtaagtgcatgcttggaaatgagtgaaaaaatgcaaagcaggtaattcaatggtaaataaatgttatccttctaaaagaaagctttaaattgtgaggctatcttatagaattcatctatgtggaatttgtaagaattctttccatgttacagcttcagattttatagaaatgattcttggatatttttatcagcactatcctcgattctagctagtgttctgcattagatttccatgcagggagctattaatttgttttaccagtgtcacccccaccatgcagctgtgaggtgtttggcatcctcattctcccacttagcatttgggttgcccaagtgctggcagcaaaggagacaagaaagtaaatctaaagcatgcaaaacgagtcactgatttatgtcactgatacctagtttagacatcgttaaccttctattttttttataataacctttgtaattcttctatattcctaacatcttctaatttttattttggggattattgttttataaatattttaacaggaatgcacagtaactcatcattacattaatttagttaagctgttatagtccctcatcgggctctctgttttgaaatccagaaacaaagacatgaaaatattgactgatatgggaaaattaactgggttgaaagattactaatttaaaataagacatgtaacatttaagtgtatgccatgcttgatttagcctgactagtgcattctctaactgttgtggaaaactacatgggaatctaaatcagaagtttggctgataaccatataatcataacaaggagagctacatgcttccagtgttcaaaggaatcaggataggatacacttggcaggatacacctgtcaatagaggatccacctgctaaacacagaggtcagcctcgcagggcagcttcttcgtgtctaggagttggattagcactgccaatgtttgccccgatgattctgagttccacttctgccagactctgtctgcttggctgtcttgtcaatgttaccactgagcttctagtcaaaacttcctgcaatctgtgaacagtgtagtctgcctactatgacatcgtattagttgaccatatccacgtgttgattttaaaatgtaactctgaggttaatgtgggaagtgcaggatgcctgttgtgactctcgtagaaaacctaggaattttaaaagcataggttagtatagttacaggcatatttacaaatacctaagcaattctcccagcttttaaataccctgtataagaaagttatctttttatacattaaagaaacttcttgctctaatagttatgtgtatgatacttgaaaaaatatataaataatttagccatttcatgtaaaatctaagaaatatatttaatctaggaaacttccaagtttccaggaaactacagtctcagttggaaaaaaggaatagtggaacttgattgtttcatgaatcttcctatttagtaaataatgatcagagagagacaatgagtaagttgatgctcgttgaaatagaaacaaagggatgcgcagaatctgttgcagaaaactacgaataagtgacaggttccaggctaatctgagggaaagaattgtttctggtagcatggataagtaattggagacaaaatactggtcagcatatgtacagtaacactaaaatagtgggaacttagtgtgtagtagggcctggagattagcaaggaattggtttagtagtggagggtctcagtatgttgatagagatcctagtgaaggctcaactgattttgcaagatgacatctttttgacccaaattatttttcactgtgatgcctgcacacactttaattttggtccccaaatctgttaaagactggacagcatcttgtggaggtgatagtaattcttctagagccatgtatgggagaaagaagtcactggatgaaaggcagaatccaagtagccactcaaaaactagtgagcatctataacatgccatgtcctgtgctaagcacagggaaacagtattggttaaaagtaatgactgctctttttggagctcatttataagccagaagactgataagtgatcaaatagctctgatttaatgtgataagcgctttaaaagataaaaggtacgtgcagaatgtgtttgaaaacaaaagggatatttgttttgcctgcttgggatgaaatgacttatttttcagaaatacaaatacacctcttgcatttattccttaatataaagaaataaactaattgcaaatggtcaaacactacagaaaaattatatagcagaaactaaaaatgacctaaatcttataattcacagaaaaccattgtttaaaacatttatgtatattattttctgcatatattcgttttttttttttgcaaaattagactcaaaacatgtatgatactttgccatcttctgtttttagtgaacagtttctatggccctcactccatttggtggatatagagccacatcatcacctatagaggctggtgtatcattgcagggcagtagtgttgtttagccatctaggttggaccttcagatagcttccacttttcttttatacgattgtaaatatttctgctgtggggaaaattattcagagattattggtcacaaagtactgtgccattcagggtatgcagcagagccctatcttgttgcaactacctggattgtagacatcaaggccctggaagaaataacgtttctgcgaaagagacttgttaattcatcttcttttttttttcagttttagaaaagggtccattatgtatgctcacccttttcccagatttagttcctcataaacatcaagtaatgtgctggtaactgggaaatactgcagtttgttagtagaattttatcagaagtcaacaaaatattccgttttgcatgcctacagattggaaaaataacaaagcctaagttgggtaagttattaatgttttgactaaatttagaaatggtgaatgatcttcattacatatgtatatcatttaaaatactattatgaatgttggcaatttcaataacactttaataggaaataaatacatttgaattattctctttatccaaaaataatgattttttttaggctgggtgcagtggctcacgcctgtaatcccagtacattgggaggccgaggcgggtggatcacttgaagtcaggagttcaagaccagcctggccaacatggtgaaaccccatctctactaaaaatacaaaaaatttgcatggatggtggcgcacaccagtagtcccagctactcaggaggctgaggcaggagaattacttgaaaccaggaggcagaggttgcagtgagcagagatgacaccactgcactccagcctgggtgacagggcaagactccatctctaaacaacaacaacaacaacaaaaacaaaaaaagtaataatttttttttagaattttagagttcagaaaaatgcaaaattagaaatgcagaaagttttctttgtcagattattcacattacttataatatttatgtctaacttcttatttaatgaataaatgaagaagttgaatcattctatattgttctttggcacctgcatttaggatgagaaaattctggagagacagaagcagccacttcattttaaggaggtggaatggggaaatcaaactcttatctcaaaaattgctatagccactgttttgcaaactacttgtcctatttgtgctgctaaattgcaggctctcagggacaatactaatgtacttgtatttgcaatggcagaggaagtagagacttgaactgtctctatttgtggaacaatcaggacctgcagggggaacaatgtggataaatagagattgtaagggaagttattagccccggttttatagtaaaggaggaaaagtcagaattttgaagggtctattgttgtcaagaaggaaaaaataaagagaaaggttagatatgaatataaggctgatatttctaatttttttttaaaaggagacctctgtgtgataggaaaagcttagttgtgagagataatatgagtatttctcagtggtaagttcatgttgaatgaatgactgtttcattacggtactgagaagagagtgggtttgagaacctgaaaccaaagaatcttcctgttaagtggaaatggtcagcttgtaaaggagtagagacagagtagagtaactcaagtttaggggagcataaattaagagaaaataacctaggaagagaaaaaaaaaaaagaatagaatagccaaaacaaaagctcaagaggaatgaaaaatgtgtcctcccaaattacataaaactttaaggtaaagtatcattatttgggttaaagttaaatttaattaattctacaaaatgccaatgtctttctattcaaactatgccttttcaaattgaaagtctttcattagtaaaatgattaatactattttgatttgggattgacactttaattaaatacactacatttttagaatccgcaaccattttttggctttgagctatgtgcctttagaataactttttaaaaattagacatttataagagacttggatatttttcttcttgtatctccctcaaattatttctctttgaatagtcaaataattagtaaaacactatattttaattttgtctttaaaaactaatgccaactagacataaatcacatccttgaaaggaattgcttggtaagttttggtctagatagaggagtttgatttcctgtgcatttaatgagcctgaggttgcaggttcaaaccccacagggactaataagttctattctctttcttttccaaagcctactagacctgtaaccttgaccagccctccttctcaaacttgccattggtcataagtcattagaaataattgattgattatcaccagcttacaaccaggtttggggaaaaatataaacatgaaaatcaagtgttctttaggggttgataatgggtcacatatatcatcttccttttgaatatcatccaggtcaaataatttagatttatgctttgaaataagacttttcatcattctcaaatgaaccataatttactttcttgtggaagatctacagtgaattatcacaccaatatttccttagactgtagaagctttaacataaaactgggtagtccattccaaaccttaaggctagagtttctaaacaccacccatttgtggacttgaacaattaggtaaaagaccagcaaatcgtctacgatataatttagttatcaaaatagttatgtaggctaagagatgttactttcagcatgatcaaataaaattgactgtcaagtcttaaacactattttctgtaagtgtataaaattatcaacattgtgttatcctagtaaaaaaaataaagagaaaggttagacatgaatataaggctgatatttctaattttttttaaaaggagaactctgtgtgataggaaaagcttagctgtgagataatatgagtatttctcagtggtaagttcatgttgaatgaatgactgttccattacggtactgagaagaaagtgggtgtgagagcctgaaaccaaagaatcttcctgttaagtggaaatggtcagcttgtaaaggagaagagacagagtagagtaactcaagtttaggggagcataaattaagagaaaataactgaggaagagaaaaaaaaaagaatagatacattctccatcttctttcatgtattacattttgtttggtttttatttgtttttaaaatttccagcttgattataaaactattccagtttaaacaatcacttttcattaccattatatggtcaataaaagaattcaatgcattcatttacactgagttttatgtttcccttttttttttttttttgagacggagtcttgccctgttacccaagctggggtgcagtggtgcgatctcggctcactgcatcctcgcctcccgggttcaagggattctcctgcctcagcctcccaggtagctgggactacaggtgcgtgccaccatgcccggctaatttttttgtattttttagtagagagagggtttcactgtgttagccaggacagtctcgatctcctgacctcgtgatctgcccgccttggcctcccaaagtgctgggattacagacatgagccaccacgcccgatctatgttccacttttaagggtaggttcattgatatgagctttgagaataatttaaagttagtttatgaatgaataattttaaaataattcttgctcaattagagataaattagtataatttatttctaaacaggcagtatattatttttattaaattagaatttaaaaatatttatattcattcatttctttattcaacaaatttttgagcatctacattgtactatttttaatgctgtggagagaatgatgaatgacagaaatttctgctctcatgaagcttagattaatttttatctatatctgtgctgaagacagatatagataaaaaatatgtcagcatgacagatagtgatatgtattttgaagaataagcagctcataaagatagagtatgatggtagaggattggggagttggtatgaagaggctcctcagaagtgacatttaagcagaaatgaactatacaacttttagaggaaaaccatttcaggcagagaaacagaaaggacaaagaacctgagactgaaaagtatctggtatgcttggggaactgtctaggaagccaggtaggtggaaaacagccaataagggggagagtcccaggaactgagcttagagaggtagcagggaggcatgtaggccaagagaaagactggagtgtgttctaaatgtgatgggaaattttgccctcccttactaggttacaggtgagagttcatatgaaatgtaaatttagagaaattcagtgataggaataattgagtgttgaaagcagagtcttgacatgatctgatttctaaattcaaaaggatttctctatgttcttcaaagtttatgaaaataattcatattgtatccttaatataaacatatgacagaaaaataagatataataaaaaaagaaaagataccaaggtaatggaaaaccattttcatgaatataaccagtttctcattattatacattttaagagattcaacaaatctgacacatctgaataattaaggacatggtatgtgttttgttttgttttattgcattttattttattttttatttttattttttgtttcttcttaaaaaaatgggatatatgtgcacagttttcaggtttgttacataggtgtatgtgtgccatggtggtttgctgcacctattgacttgtcctctaagacccctcccctcaacccccaccccccaacaggccctgatgtgtgttgtttccctctctgtgtccatgtgttctcaatgttcaactcttgcttatgagtgagaacacacacggtgtttggttttctgttcctgtgttagtttactgaggatgatggcttccagcttcatccatgtccctgcaaaaacatgatctcattcctttttctggctgcatagtattccgtggtgtatatgtaccatgatttctttatccagtctgcagttgatcggcatttgggttggttccatgtctttgctatggtaaatagtgctgcaataaacatacttgtgcatgtgtctttagagtataatgatttatattactttgggtatatacccagtaatgggattgctgggtcaaatggtatttctggttctagatccttgaggaatcaccacagtgtcttccacaatggttgaactaatttgcattcctaccaacagtgtaaaagcattcctatttctccacagccttgccagcatctatggtttcctgactttttaataatcaccattctgactggcatgagatggtatctcactgtggttttgattttcatttctctgatgatcagtgatgttaagctattttgcatatgtttgctgcataaatgtcttcttttgagaagtatcttttcatattctttgcccactttttgatggggttgtttgttttttcttgtaaatatgtttaagttccttgtaaattctgaatattagacctttgtcagatgggtagattgcaaaaattttctcccatactgtgggttacctgttcactttgatgacagtttattttgctgtgtagaagctcattattttaattagaacccatttgtcaattttggcttttgttgcaattgtttttgacgttttagtcatgaagcctttgcctgtgcctatgtcctgaatggtattgcctaggttttcttctagggtttttatggtttggggttttacatttaagtctttaatccatcttgagttaatttttttataagatgacggaaggggtccagtttcagttttctgcatatggctagtcagttttcccagcacaatttactgaataggagatcctttccccattgcttgtttttgtcaggtttgttgaagatcagatggttgtagatgtgtcgtgttatttctgaagtctctgttctgctccattggtctatatgtctattttggtacaagtaccatgctgtattggttactgtagccttgtaatatagtttgaagtcaggtagtgtgatgcttccagctttgtccattttgcttgggattgtcttggctatacgaggtcttctttgattccatataaaatttaaaatagtttttttctaattctgtgaagaatgtcagtgatagtttgatgggaatagtattgaatctctaaattacttcgggctgtttggccattttcacgacattgattcttcctatccatgaggatggaatgtttttccatttgtttgtgtcctctgttatttccttgagcagtggtttgtagttctccttaaagaggtccttcacatcccttcttagctgtgtttctaggtattttattctctttgtagtgattgtgaatcggagttcattcatgatttggctctctgcttgcttattgttggtgtaaaggaatgcttttgatttttgcagattggttttgtatcctgagactgcgctgaagttgcttatcagttcaagaagttttgaggctgacacgatagggttttctaaatataaaatcatgccatctgcagacagagacaacttgacttcctctcttcctagttgaatagcctttatttctttctcttgcctgattgccctggccaaaacttccagtactatgttgaggaggagtggtgagagagggcaactttgtcttataccagttttcaaagggaatgagtctagcttttgcccattgaagacgatattttatgtgggtttgtcataaatgttcttattattttgagatatattccatcaatacctagtttattgagagtttttaacatgaagggatgttgaattttatcataggcattttctacatctattgaggtaatcatgtgattttgtctttggttctgtttatgtgatggattacacttattgatttgcatatgttgaactagacttgcttccaagggatgaacccaacttgatcattgtggataagtttttccatatgctgctggatttggtttgctagtattttattgagaattttcccatccatgttcatcagggatattgtcctgatgttttctttttttcttgtgtctctttctgggtttggtatcaggatgatgctggcttcataaaatgagttagggaagagtcccttcttttcagttgtttggaatagtttcagaaggaatggtaccagctcctctttgtacctctggtagaattcagctgtgaattcgtctggtcctgggctttttttttttggttggtaggctattaattactgcctcaatttcacagcttgttactggtctattcagggatttgacttcttcctggtttagtcttggtagcatgtatgcgtccaggaatttatccatttcttctagattttctagtttgtttgcatagaggtgtttatagtattctctgatagtaatttttatttctgtggggtcagtagtgatatccctttatctttttttattgtgtctatttgattcttctccctcttctttattagcctagctagcagtctattttgttagttttttcaaaaaaaaagcagcttctggattcattgatttttttggagggtttttttgtgtctctatctccttcaagtcttctcttagttatttcttgttttctgctagcttttggattagtttgctcttgcctctctagctctttgaattgtgatgttagggtgttgatttgagatctctctagctttctgatgtgggcatttagtgctataagttttccttttaacactgctttcgctatgtcccagagattctgctacgttgtctctttgttctcattggtttcaaagaacttcttgatttctgccttaatttcattatgtacccaggggtcattcaggagcaggttttccagtttccatgaaatcgtgtggttttcagtgagtttcttgatactgagttctactttgattgtactgtgttctccaataactcttcctgcagggaagcctcacccaatgaggaaggataggcctgaagaaacactctggtggcagactgccacagcaggtgtgttgggctgtggggacaagtcttgagacaaagcctccctggctccagcaggggaaaagcacagcctggaactagagaaatgggtgctgcccttcccctgcccagggagcttagcttgttaggcagttgcgagtcccagtgctgactgctgcctctcccacaaggagctcaaaggacttagacagcaggcagtcacaactgtgctggttgcccctccccccaggagttcagcaggcttaggcagattccagctgagaggctgtaagaatctgcctgttccagggttggaacagtaggcctggtggcatgggttcgcaactggtatcttccaatctgtgggtagcacagtttcatggaaaaagcagtttccctggttgggtagtgtgctcaatcaacacctcccttggctggggggagggggttccccatctccctgtggctctcaggtggcctgccacaccacactgttcttccttctctctgtgagtcacaccagccttctaatcaattttgatgagagaacctggataccttggttgctggtaaagaattcacatgcttattatgttttttttttttcgatggcagccttagaacactgctgcttctagtcagccatcttggcctctcccctatgatacatgttaagcatccctaatttgaaaacccaacatttgaaatgctccaaaatctcaaactttttgagtactgatgtgatgccgcaaatgaaaaattttacacctgaccttatgtgatgggtcacagtcaaaacagagtcaaaaccatttcatgcaaaaaattattgaaaatattatataaaattatctccaggccatgtgtataaggtgtatatgaaacataagtgaattttgggtttggacttgggtgccacccctgagttatctcatcataaatgcaaatattccaaaatccaaaagtatccaagattcaaaacattactggtcccaagcatttcaaataagggatactcaatctgtataaaagagatgtcatctatagaaacattttaccttgccttttatcagtagatgaattatgtttttataaattgtggaaattcagaatatacaagtcaccctcgatatccatgagttccatattcatagattcaaccaacctcagattgcaaatattcagggaaaaaaatttacaaagttcttaaaaatttgaatttggcccacagcaagtactatgttgaatccacatgaatgaagtaatgtgtaggcattatattaggtattataagtatctagggatgatttaaagtctctgggaggatgtatatagttatatgtaagttctgtatcattttatacctggaacttgagtatccttggatttaggtatccttggtaggacctggaaccaatccttcatagatactaagggatggctgtattacagttgcccaacttgtgttttatgcttatttttaaatcccctccctttcccataaactttaaggctaatttcaatatgtaaacacaaaagtgcattaaacaataaattttttttactggttgtttaatgtgcgtgtggttttagtgaggaatcaggtataacacagtacccatccaggtgctaacatgttatggagagaatgttggcataaaattactaggcatccttcttggataaaattcactttattctaaaattatgacctttctatacttttcatggtaaaatatggtttcttctatggtactggttatagatggaagatagggtgttctttaatatctttttagacagtctccctctgtcacccaggctggagtgcaatggcatgatcttagctcactgcaacctcgacctccgaggttcaagtgattctcctgtctcagcctcctgagcagctgggactacaagtgtgtgccatcacacctggctagtttctgtatttttagtagagacagggtttcaccatgttggccaggccagtcttgaactcctgacctcaagttatctgcctgtcttggcctcccaaactgttgggattacaggtgtgagccactgcacccagccctgatgtcttttttaaaaatcagaatgtaaaatcaaaaagtttggaattactgatgtaataggaattacttaaaatcggctcctagccaaagtagtgtcaatggtatatgatccgtattacagaagtcactcgtgtatctcccaccttcatttggcacttaggttggtagattcagtgtattgaaacagcttaaacattacataattgcctagaaagggctaaaaatgatcttataagcatacaaatattacagcctactggagtcttcttttactagacacacatagatcactgcctatataaggagcatggctaatcatcttcttccctggatatttgccatttgatgtctgggaaatacaccatagtgttataattacttttttcctactactgctttatagtcatatttaacatttatgcattttccttctctttttaatgattacattttctttattgggtagcattaaagttttcctactgatgggtcagacaaactcatttttattatggtcaaaatcagttaattgttcaataccatctaacttgctaatgctatttccaagtatttagaaatatctatttttcataataactaggtttgagcctttgaatgtgttttaatttctcagaatttggaaagttaaatgttctcacatttatacttacagaggtcacataaatgatatttagtgagttcaaactattaattatagatacaaggttgaattcaagtgaacattttcctttgatctaggtctgtttagataaaatggtccatgattttagcaacttcagtgctaagtaatcagagcagcctagcagcagcaacagagacagaataatctccactgacagacgattttataaacagccagattcaccaggcctccctatttcagctatgagctcatagcagaaggctgaggttctaagatgtccaccatcttttctggctgataaatttcatgtaggaggaatattattgttccagatggtttttcagcgttgtgcacactagcctcatagactcccgctgtaattgaaaattggttttgctccaacaattgacaaaaaattagattaggttaactactttttgattttagattactgatacaaagtgctttcatgactatgacaaaataaattgaaattcagactaagtgacgtccctgtgtgtattttcacttagatatttttccctgaggtttttatagtatcattaaattacattcagatacagaatttgcatagaatcaggctcattgaaattttgatgatctttttcaatctgtaatattgctagtagtgtttttatggaaaactagctagatattttaagtcactgtaaagacgatgatataaaaagatttaaaagccatctattattaggttggtgcaaaagtaattgtggtttttgtcgtacttttaatgacaaatagtttgcttgcattgtgaaagcattcattgtttacttctaggttctcatgaaataagaaagtaattttcttgaaggtttgtttgatagtcctccatagattttttttaattaaaattttaagcatttggagaataaaacatatatttagcaggttataaatgagatcaattgaagtcaaactttgagctatagttatcatcagaacatatatggggagacacatgaaacctcagcttcccagttgaaatatccacgagacatctgactactaggaaagggatggggtcatgttacacaattctggtcccaggtgctcaacaggtgctttgcaatcacaaatggctggacattcattagtgctttcagtctgactcccagctaggccttggaacagagagtgtgtatacaatattggttgaagagtttggttaaaaagaaaagcaaagcccagtgttagaaaaagaggtgacatcatttggttcctataaggctattctgtgcctaccatatgcagacacgtttttaaagacatgtggtgccttagctctgctgcccaggccaggatgcaatggcatgatcatagttcactgcaacctcgaactcctgggctcaagccatcctcacacctcagcctctggagtagctggtactacaggcacatgccaccaacccagctaattttaaaaatattttcaaaggcagggtctcagtatgttacccaggctggtctcaaactcctgggctcaagtgcccttctcacctcagtctctgtataccgacatttttttactggtcactgaggagttttgaggatatatttccagctgtgaattagcgctgtggctcatttgagctaaggtgaaaacattcctgatattcaagaaaataaaacaaccctgttcccattctgtcctgttgatttttaacatcaaccctttggaggaatatcctcagattcatgttctgtccttttttgccctttctaactgtcccttagccttttctcatcatcgtaaattattacctgacattgacgggggatttccctaaaattgtagagaattttgtagaacgaagctgtgaaatcataaaagacagggttacaaagcctgagttcatgatcaaggactagtgaagacaaagaatcttgttacaaaatgagaaaaataaaaataatattggcctaagacttcaaaatgagaaaaataaagatagttattggcctaacattactttcttcctttagtttgaaaatgatgtccttcctgactttttgttattaaaatggacattcttttgtgaaatgaaggtgataataaatgatcattgatgtcactaattgataaaatcagaagtggttagccctaaattggggttccacctctgatttccacatgtgtgctttcatagatctaagaatgtgggaactactgatctaattcagctaattactcaaaccatgtatcccgtcaacagaaatgctaacaagtggtaatccagccttccctgaaaacccttcctgtgggttctcagccagatgggctacccattatgcttttggactcttctaattaatacaagtatcccctacattggatgtaagtcttctatactaattgctactttttaattttacccagaactgtatatgctatgtctaatgtaacattttcctaattgtgttccacagaacattaattctatggaactctatggaataattaatatctattaatagatattaccacaaaaaggggggagaactacagtcaaattattttggaaaacaatagttcaaactataggttatttcagtacttcagaaatgcatttttgggataatacacacacttttcttttttttgagacagggtttccccctctcgctcaggctagagtacagtggcatgatcatagctcactctaacctgaattcctgagcccaagcgatctttccgtctcagtctccccggtagatgggactacagcatgcaccaccacacttgcctaatttaaaaaaaaaaaatttatagagatgaggtctcactttgttgcccaggctgatcccaaactcctggcttcaagcaatcctcccatcttggcctcctaaattgctaggattacaggtgtgagctatggcgactgacctaacaaaatatttttgagtataattatatttgacgcaatcagggtaagttagctgtaagtatgaccacaagacaactaagttgattagtatagcataaggagttcatgggcagccatgttctatttgctaatctatgctggatatatttcagagggatatacagtcatccgagtttctgaaatttggcctatggaattaattttttttaagcagcgaatgctatttagggcagcagtaaatcattaaacaaacattatattcatttcctgttctacctttctttaacttttcttatctaaacatgtcaattgctttaacccttaatcagttacatgatttctataccctttaactttactctaggcatgcccttgttttgtccttgcttttgttgaaattatggtgataactgaacacaaaaatcagatttgttttgacctagtgtagtataggtgctatcttctttttctatttgtatatttctatcagcattaacagaagttcatttttattttgttgtgttctttttgtctagtacttcatgtggttatcaaataccaaattagaatcctgtaataagtgcatatctatattaagaatcaacttgttagagctggtccatcaacctgtcacattaagatctttttggaatttgttaattagctttcaaagaaatatacccactcaaatatctcaagtaaagacaggttactgtagggattaacactggaaatcacgaggacaaatatcttagtgacacagtgaaactcgcagcattgcagaaatagcagcacatccaagtgtcagaggttgtgctgggacaacctcttactgctgcatcactgggccacatgggaatgagaatgtggcttaggaactggaaacccattaagatgcagtgatgcccgagtgactgtcatctcgttgcttccccccactctcttcaaggagcaggactctattaatgtctcttctagttctctggcattaatctcattcgctgacatctgacttttgttgttgttgttgttgttgtttttgagacggagtttcactgttgttgcccaggttggagtgcgatggcacgatctcggctcaccacaacttctgacacccaggttcaagtgattttcctgcctcagcctcccgagtagctgggattacaggcatgtgccaccacgcctggctaattttgtatttttagtagagatgaggtttctccatgttggtcaggctggtctcaaactcctgacctcaggtgatccacccacctcggcctcccaaagtgttgggattacaggtgtgagccaccatgcccggcctgatgtctgactttctttgggacttccaattctgctcctgctaccactgcttaagtcttactgtatatttcaaattcaagagttggcctattcattacactgctgagtcttataccctttttcaatcaagcaatgcttctactattgcaactttaatctgccatatgccttatataatgggtttgatttttgagtataactgtatttgacccaatcaggataagttagccgtaattatgaccacaagacaactaagttgattagtatagcataaggagctcttaaaatgtggttcctaggctttgcagaatcagcatcacctggaaacgtgttaaaggcatcatcccaaccctactgcatcagaaattctgggatggcattcagcaatctgtattctctcaagccctccaggtaattctgatgcatgttcaagtttaagagcagatggtataaaattatcactctagagtctagatttatggtgtgagtgccaaaaataatggctttaggcataattgatatgtagatctttctgataatattaactaacagtttcagctgctttttaaagttgttttttgacaagagaagaacattataagcatgtaagatcatgcttttattcctatttgttgtggcatttaattgatataaacactggaccaattttttgtatacaagtttactataataagcctgtattcttttttttacttttttctttctttctttttttttttttttttttgagacagagtctctctctgtcaccccgactagagggcagtagtgctatctcagacactgcaacctccgcctcccaggttcaagcgattctcgtgcctcagcctcccgagtagctgggattacagatgcgtgtcatcacacctggctaagttttgtatttttatcatggtagagacagagtttcaccaagttggccagggtggtctcgaactcctggcctcatgtgatccatctgccttgccctcctaaagtgctgggattacaggcatgagctaccaaacccggtccaaacctggattcttcatgtttaaagtacttgaaaaggaatgtgtatccctgcctattttggttctcatatatattttttaatataacagctttatcgagatagaatttacacatcatacaatttacccattaaagctaagcaatttaatatcttttggtatattcacagagttttgcttttattgccacaattttaaaatattttcatcaccctaaaaagaaatactgaacccgttagcagtcattccttctttctcactctcaccccattccccttccccttctcccagtcctaaacaactactaatttactttctgtctctatggatttgcttattctggatatcttagataaattatatcatacatatcatacattatatagtcttctctttctgttttttccccttaacataatgttttcaagatttatacgtgtcataaaatatattagtacctaatttcttaatttccaaataatattccattgaatggatataccatactttactcatgcattcatcaatggagggacatttgggttgtctgtacattttggctagtatgaataatgcttctgtgaacactcatgtacaagtttttacatggacattgttttcatttctcttgggtatatacttagaaatagaatgattggttcacctggtaactcttgtgtttaactttttgaggaacttccaatctattttataaagtggctgtcccattctacattcccacctacagtgtttgggtgtttctgtttctccacatccttgtcatcacttattattatctgctttgggttacagtcatcctagtgggtctgtgtacaatctcactgtggttttgatatttacttccctggtgattaatgatgtggagcatttttcttatgcttatcggcaatttttttgaagaaatgctattcatattttttgctcatattttacttgggttattgtatttcattatggaattataaaagttcttcatatcttttagatgcaggcccttatcagatatatgatttcatagaagttttttgggatgaagatttaaaaggtcaaatatgattcctgtgaatggagagagaaattaatgagagataaaaatattaattttcttctcaatgaaacacagggtagcagtgggcattagtacgacaattcaacaccaaatctacctattatatatgcaggatatttaattgagatttttgcttgaaatttgttgagaaggaagccagtgcagagttctgaaggaaagagagtttccataaagaatagatagctgaatattgaagagttcacacaggactggaactaaatataagttattcaacctgtgaacaatgatcttaattattggtgacacagtttctcaggaatgatggaacaataagcaaaatgcactcatcttatacgtgtgagagaggaatggaaatgaagatggagaagacttgcctccattaagctggaatgcgatgagtaggagagaggaggctggtgaggagatggaattagggtcaaggaagcagagggtcaaatctttgaaagatttgagcatgtttgaaggaatggaaggaaagtgtgtggggagggaccaatcaattgaacataaaagagaagggtagggcagaatctcagtgaggtaggcagggaagaatacagaactcacagggagctgtataataatggccattgggtcacctcttagagttcctgaaccttgctcagatgtgggatctaaacacacaggttatacctttactgttcatgtgggcctgttgacctcaatgaggtttctaatcttcattaaattccctcttctaatatatttatctaaattttctatctaatcatcagggttgggtcaattcattcatgaagaaatgttccttattatggaatactctgtattgctgagttatttttgcagtgacattctgaagtttgaggcaagcttttaattcaaaaattctcctgatatcccttataattcagtattttagtggcttaaatatacctccagtcatactacaattccaggtggcatataaaagtgggaaatggttacaaacattaatcacttagccgaagcaaatttaattaaacaatagtctaaacatttctttctaaattatgagcatccatcagatgatattccttttgtttctgtggtttatatatgaagctttcttattgatgcgatttcactatctgtagattaaatgtatggaaatcagacttttaactcagcagaaatcaggagacccagctttaagtcctggctctgcagctaactagctctgtgtccttggtcaagtcacattctttctgaatactttgcttcttcattgtgaaatcacaagatcaaaatgttaagtgtatagtcctttccagctttgttattttgtgaatctttctgttagtttggagttgaactttctctcattgtttactaacccagatccccaagtgaaaaaaaaaatgcagcatcctgatttaaaggtataatgttccataatgtcttatgttctcatggctgatttcttcagctgaccacaagtcttcaaaagagaaatcgtggtgtttccttcctgtccatggattccttcacatataactaacattgatctagagctgcttgtggagctgtcccagtcacaggccttctgaacagcatttttgcgcttgttaggacctaggcttcctgcttggtgtggaccctgattatgattactacactcaaccccacagcccagctctgctagagggtcccggcaatccggtattttcttttctaaagtctcctatccaggtctgagaactataggttttttttttttttttttttttttttaaggagagagagaagttagggggacagggggctatatactaggcactgtgttaggtgatctgtaatataattccaataaatgtttataccttttctggctctggcagctgggtaatcacaacattatatatgggaaaactaaggctaatgcaggtgaaataatttacccaagtaagcggagggaaatggtctgaacctctgacagctaacatccaaagtgttggcccttagctactctgattttgtgcatctatagtaactttgggtggaagagtactttttctttttttttttgtaaccctgggtgcctggaaaggtaggaaggaagtggggagacttgaagaatatgagaaaggaaagattggtaaccatatctttggagagcacattcatttcatttcagggtatctattctaatggaaatcatattttcccattgttaataataaatgatcatgaaggcagttgttattctttgagttgcttgtataatgatgcaagaacactgttaatcagtattttaattaggtttatagcattaaagttgtttttatatttctctatgtaaagtttccatgagtttcacatagttaacatcattggtttctggatatctaattcattttcagcactgataataggccatgttgtattagtttggaaatgtattatctatgatatgtattatatcctcttggcagctacagcattgtgttaaaatgaagcatcgcctgtaagccagatgtgtgcccttgtcattgcctcatttgaaatactgcattatgaagaaattgatgcaatgctcacaaatctataaggattattttgcatgtgtttgattaaaatgtagggagcaaaccattactttacaatacagaggttagaagttcagcatgtagtgagtgtacacttttgcccaaaagataaaaagatgatcaagactgaaactccagcttcacatagctcacagtctggtgaaagagatagatataagactgggctttcaaaaccataccataggaattaacttcattgactttattctatttacctacagggtctgaagccatacatcgtaagccaagtcagtgcagcctttaatcaaaatcattttatcatgtagcacttaggattaaaaaaatcaccacaaaattatagaatgagaaaaacttggcataatagcaactcctcaggaaaagacctagggattttatttgttcataaagttaatatacacctaaagtgtggtgagcctctatacctattacaaaaggtagaatgaatagaagtctggggcaagaacaaatgggcaagggggaagacttcatctgtgtgctatagtagttagatcacatgtagagtagggggctcatttctaaccactactttacagagaagactgacaaaatgatgcttgtctataaaaagtaaataaaaatagaactgcatctcataaggatgtttgagtttaaaaatgttagttaactttaagaccaattggagtctgtgatgatgatggtatcattaaggacaatgtttacttcattatctcatttaatgttctgacaatccagtgaaataggcgtgcttatgatcacccattcacagataatgacatgcacacaaagaagtcactgcacttcctgagatcacatgactcgggacagctcaagcccatgttcttaatgacagtgctgtgctacatcaaacataagcagttgccggtccttgacagtgttatcctaggccttcaacactgtgtgaggaaggaaagtgacttcatagcttcatcgagtataaggatacagaactagtcattggctaaatttggcagatgctgaaaaaatggcaggaggagctatcttaggtatatttcgaaatcaggggaagctcttatctttggtgtgctccttttattttcttttctctatagagatggaaatttccagttatctaggtactaaggattgtcaaaagcattcattgctgtcttactgtcttaaaattctttttttcttttttcttttttttttttttaagttggaatctcactcactctgttggccaggctggagtgctcactgtaatctctgcttccagggttcaagctattctcctgcctcagcctcctgagtagctggaattacaggcatgcaccaccaagtccagctaattttcatattgttagtagagatgggggtttactaggttggccaggctggtcttgaactcctggactcaagggattggcccacctcagcctcccaaagtgctgggattacaggcatgagccactgctcctggcctgtcttaaaattcttaacttaaaataatattaaagagcattttgttatttcttatactagttccagtctagactcttgctttttcttcttcttaagggacagaaatagaaggtttcattcagaactcaaagtgaacatcctagggcaggactgtgcaactccttcaaagaagaatgattcctgaaagcttttattactttccctggaacagcagttgtctgtgacaattacctaatttgaggcaaatgaatgacaattcctttccattcttcaaaagcaacattgcaaaagaaagctggagggaagtctagagagaaaattcttattgatattttacaaatataatatgtttcatttgttacaattcatataaactgccttcttgtaaagatgcacccagatcttagttgagcttacgtaaattttttaaaagtcaccatttcctataatataacttatataatgctatattatgcaattgtaactaacatgtgttgaacactcagtatgtgacaggcagtgttccaagtactttacaccccaccaacctggggagttaacaatgacaaatattctctctttatagacataataaatgcacagaatgagtaaccgtccaaggtcacgcaggtagtgagtgtctaaaatgtgacttgaaactgaacattctttttccaggttccaggttatgtgtacacacataatcaggtttctagatggccttttgttatccaatttgttatgcatgaaagaagcaaaattgttcattatgtggggagtctgtgaggcagtcactgcacattggctcacttgatatccaccctgctcccattctaaaatgtcttcctgcactctaaaggctggaaactagaaagccacatttttaagagtcctttactgctagacttctacctgtgctctaggttctgccaagcagattcagacgtctaagccttggaatgtgtgaaaatgaggtacgggcatggcagcaaagacatgtgatgggtacttttgtgcatgctggtctggtctttggcattatagctgttgagcagtgggcagcagcagcagcagcaaggtttcctctagaacactcttagggtatggttggaagcttctgtaactgtctactatcccgtaataaaattcttgctacttaagctagctagattacattctctgcaaacaagatccctagtggatgcagagggcttcaagcctataaagggatattggttcaggagggtctctgacctttggtgcccatccagtgctggaaaattgaactagaaggctcattttaagtttaaaatttttctgatttttaagacagaagactctgaatagggtagagaggagatccttcatgcatttgcttaagcaagtttttctatagaaattatctcctccctcctgagttagccatatgacaaaaagcattgcatttctgggagaaaatgtgcctcttgtactgccttgaagaataactaaaccaaaataattaaggagagcccaaatgaacattgcctgttatgtgaatccaatcaattctggaaaagcaataatggaatggggagttctctgatctctcttgtctttgtttttcttctcctgccctcctccaacccctaagtcaaggggaaaatgggaagggcactggaccttgaaggtggatatggtgatgtgggaagcctccctggaagggaacagtcattgagaagggcaggatgttttggaaacaggagtctgcaagtttctctggtgtaaagggaagtgtggagaagcaggggaaaataagcatggggacaggagctaagaaagagctaaggagatagtcttccatcatgtggataggctgatgattttttagcagacttttaaaaaaggcttttttaagaagattaatatgaaatcagtaagttagatgattggaggtgggaatgaaacagcaggagaaatagtgatgaagctgcttcagtaagccagcaatggcaaataaacacctgaaataaaaaactggaaacagaaaggacaagagttagcaaagatgcactggcctaacttaagaaattgttatgtaagctgggtacaaaaaaagagtttttaaaaaatgagagtgagcattagtgccatgcctcttacatataaataagaatacagacatgttaaactatagaacttgaagattaattatccttgaagcataattccaaatacaatgttggaaaaagattgcaaatatcagggaatgcaggtttgcacagaccagtcattctttttagttgtttgttagtggaaaaattatttatttcacaattgaaataactagcaccaaatatctaaaagctggtgggtttaccacagaaactctctctctctccatctagacacaattatgttttccaggttgcactaggagaaacctcatgctacgttctcatgggtctgaaaaaaggaggtcattcttttgagattgttgggtgtttctctgaggttctttatccagttgttacttctgtttttattttgcttataaatctttataaaagtgacattggaatacttaccttttaatggaaaactgcaagggtcacggcagagctcaagattactttttcttttcccacatggaaaattttaaaaatacaaaaagtattttaagtctagggttgcatctctcatagtatttaatttcaaatagatcattggaggacacatggtatagaccagtcatacaagtgcattcgattttccaggtaataaaagtacccagaaggtgttcattatgctccaactcttgagtagtatgcatcacatcagtactaagctggtgacttaaaggactctaaatctgtttacagtaacaacttatttttctcaaggtaatttattttgcacttttagccatcctaggacacattaaggaccaggaaccaagtttaaaattctcttacagcctaaaatagttatagcaatgtctactgtataaagctcatatgctttccaggggtaaatcccttggggaaatattacttttattgtagaaccaatattagaaagattgtggctttccaggccataacaaattagaagcaagaaattgcaaagggaaggaaaaggtgacagtgacaaatacagtgagtgcatcaagaagtaaaagctaggtgtttcactttaagaggatgaagagaaacagaatccttatttccctagacttggaaaaattatttgaagacctagttgtaaataaaatttgtggctaaccctatagcaagtgctggaacaatgatgtccccatccaatacctgtgcatttggatccagcattcaaagacctgcagcccttgcctttggcctaatactgctcttatgccatttgttagccccaaggtctcacaggactttcagttcttttttttttttttctgagacagtgtcttgcactgtcacctgggctggagtgcaatggcatgatctctgctcacggcaacctctgcctccctggttcaagcgattctcctgcctcagcctcccgagtagctgggattacaggtgcccaccaccacacctggctaattttttgtatttttagtagagacggggtttcactatgttggccaggctgttctcaaactcctgaccttgtgatccgcccgcctcggcctcccaaagtgctgggattacaggcgtgagccaccttgcccagcctttcagttctttaagttgagcttcaatagcacaggacctaagaaattctaccattttactatcttgcaccttgaagctcgtatgttcctgctttgatggcttaggccaataagctaggctggaaagctgatagtataaaattatttgagcttcagtagacgtcctctgtgctcaaagagatctttctgttctctcccactttagggtagtttcttccagggatagcctcaaaacttaggtgtctgagaattatataatgacctctaaaatcagagccatgggaactgagtattcagtttagaccccttctttaccctcatccttctaataagaagaatcatagcactctagagcttttagtgagataaatatctttccaaacctcaaaaactcctgagaacaatactgtattataacccagagtaataattaatttttgtaatgatgacattgagtcattatgaaaaggttaagtcatccaacataaagtttaatcaagcaatgcctgctacatgcaaaaaagcaaggaagaattgcatacattttgaaaaactgcccatgaaaatgttttaactttataaggaaagataactttaggctatttggtaagttaaattctgtgaaacgcccatgtgctgtcagtgctggttaaatgaggcatgtctgtatttgactgtgttttctcataagacaataagttattaattaataaacatgaatactatatccctaccatgcctatgaggcctgtgtctatagagcctaaattagtttatacttaacactttaaaatcctttttcagtaattcatggaataatccatatgcttggaagacttgtgagaagctgatcatacccattttcccagttagtttttaaagtagagatctgacctaaagaactgagcttacctcccaaagagaagtataaattcaacctcaataaaactgatatttcatatttgatgatgtatgccttcagatattaactggaaagacaaatttttgggggtatatatggattagtttcatttgctcttggattttaaatttatccatcatgggctgagtgcggtggctcatgcctgtaattctagcactttaggaggccgaggtgggtggatcacttgaggtcaggagttcgagaccagcctgacccacatgttgaaaccctgtccctactaaaaatacaaaaattagctggaagtggtggcaggtgcctgtagtcccagctacttgggagggtgaggcagaagaattgcttgaacccgggaggtagaggttgcagtgagttgagatcgcaccactgcactccagccagggtgacagggcaggactctgtctcaaaaaaaaattatccattgtggatgaaagtagcaatttcatgatttttacttaattataatttttacttcagcaggattgtttagtatttttatttttaatgttataataagtaatatacattcatgtttaaaaatctataataagaaaactaaggttttatagatttatttattccacaaatattatttgaatgtctgctttgtgccagcctagggacactactgggacaccttaatggacaaaaaacatcagcctttctagagtctgtctcttggagaggaggagaaggggagtgtatggaataatagcttacacttatataatgctttctgtgtgccaagcactgttctaaacactttccatatattaattcagttagttcctcataacaccgttaagagatgcaaactgttattatcgcctactttatgcataaggaaactgagatacagagaggttaagcaatttttccaacgtcacacagaaagtatcagaacaacgcttcaaacccaggcaacttggctttagttgcaggtgttcataagtattgcacatacagtatcattacgttactattctgcagaattttaaaaatcataacagtatgagcagaataaacaattcagtagaaaattttagttactgaaaaacagatgttaatttggtaatggtaataatagtaaaataatttataatttctatcccagaaaacctaaattcttctgtaagtcaatatgtatagattacccaagtagactcacacataagactctccaatatagtttggtcttaagtgaatgattcactggaaattttaatttgctctttggaagcccccctcccccagatactctcattagtaaactaccaaccctgtgcctgtaggactcaagtttttgcacaagaagagaaattcagtgttattaaattaaaggcaacatttgcttatgtttgtcatttatcttttgtggggttcgcctttaaaaaacatagaaacttaaatgatatgaagtcttcaaaataattggaattggagaaagtgagtggaagcagagataaaacaagattgaccgtgagttgataattattaaagatgtgtgatgacttgataattattgaatcatgaggattcattaggttatctgtctatgcttgtatttgccattttttcacaactaaaagttttagaaagatacagaaattatatttacaaaaaatactttaacattttgctgtagatctaattcagccagggttaatatccaatgtgaaattttgggcatgagttgctaagaatttacgttgatggtattatgcatgtggtagtataaaataataaatcatctttattaaaatgatgcctgtgttccatgaccatgacatacactccttgacttgagtcatgagggaaaaatgtgttctttctttaaaatatttttgagtaatgaatgctgaaatgtaacaaataaagacacatgctccatttaaaatgagatttcaagtctgtgtccctttagtttttttatataccacaacaaatgtttttttcaaaccacagtttgatgtcctatgaaggataaatttatttgtgcattcttttgagctctgcaaacttagaattttttttaaatcttagcatacagatttaaaatctctttttgttgttgttgttgttagtgtttttccatacagtattcatttatttctgatggctaaagccattctttacataagagaaacatttaaaatatggaaaattttaaagaaaaaaaggcatctgcagatctgtaatccagaagtaccaatcaaaacactgagggcaggggcaccttcacaccataccctggcactgccccagagaattagggagacaccagctgggattgttatgttctgtcctaaagacctctcatcctcagcaaataattccttgctcaaagcatgacacaaaagcatcatcagagctgcaggacgtttgaaagaaccaggtgatgagcatgaacctatgtgcatctgtggtcaatcgcagtttgctcttggtactctctgctggcaagtgagaccttaggacttacaaataacccaatggatgttcaacccttgtggtgactgactgatttttcccattgcttagaaagtttcttgtacataggaaatcctcaccccacatatgtgtttgctttgtgcaaaggaccaaaggatggtcctatttactctagtggaggacaatggaagaggactgcgtttgagagggaaggattcatgagctcagttttggaaacgttgaatttgagctgcctttaacacatctaagtaaagatgtcaagtaggcagttggagaagataaaatttaagttaggttggtgaagagacaagagaattttttttccaggtgagttagagcatacacaaggtcacagaggtagagacatgagggaatattatattgacaacaaaatatagtaaggtagtgccaagtatggaaaacctgttgcttatgatatgcagtgatgatattattgcatatgatatgcagtgatgatattattgctttatcagcataaaaaattggtaatgggtgggaatttcatattctttaaccaagaagcttcagaatgagattttctataattttcctgtaacctagttatcaccctaaaccagctagttatgtcatagacaataatatctaaaagacagggagcaaataggaaagtaatttcctaggaacagtaaatatagctatgatatttcttcacaggataggggtcatcacccaatagatgtaccaactcaatgacattgaatctaaataaaaacagcttgctggctctttttgttgttgttctttagattttcttgccatacgcagcttcaaaacaattacccaagctccttttagaaccatattgctccccacacgggggatctggagaacctgtgactgttttccatccttctccaacttctccacttaacttgagattgttttcctttctgagtcacagctccatatggtttctgtttccttcctcttacatagcaagctgattacctgtaatcttttcattgctacagtctgtacctttaactctaattaatctcacaaatgtatgacaaagagaaattagtagaagcagtatgggcgaatattagcttatccttattactagagaagtaagtcaacacaaatttcctaatggtaaattgataacactgtctttgcatgtcataaaccatgtgagatagttattcattagtttactacagtgtgcctggactcagataatcccaaaacacagtaacgagtcataatctagccaccaatttatatcagtgctttgaagtttttattcaaactgctaatttacataatgaataaaagtagaaatcacatgtgatctatttttaacagtctatgttaaaagtctttccattgctataagaaacagtcgatagaaaaaaacatattatgtctaaaaagttaaaaatctccaaccacttaaatgctattaaaataatcttatgaattcttctttatttccccttccttcttcttgatggtttttgtgagtaatgaaatacataacataaggtggattgaaaggtgctatatttcagatatgtaaggagtactttatagtttaagaatataggaatttcaaaaatgtaacttttctagtaaattttatgtacatattataaataattctataatgatcttcatatatatgattttggtatcaaattttactaagtacttgatataacttgtataatacatacttatcattaggatttgatattcctatatatttatactatcagaaacacaattaaaacattgttagccaaggaaaaggtgatacttctacattttaaagacaattttagctatttctgtttaacatacattttaagataataatgggacacaaattttagggaaatagtagaaaattatttttaaaatggaatctctacctgaaaaggcagaccataactgttgtacagatatactatccactcagtgattaaataatcaatgacagagcattttcagctgcaacattttattctaagagttgggggcaggaaacacattttcagctattgacacacagccaccccaaaatcatgacaacatgttgccctttttgaaagatgaaatctttaaaattagaggactttttaaagggtatatttaatagatatgctatacaactgttagaatggtaaaaaaaaaaaaaagataaaacaatttcttacaaaattaaccacatgcttgccatataacccagcaacctcactcttaggtaattacctaagaaaacttaaaaccaatatccacaccaacacctgtgctatgatgttgataatcattatcattaaaaactataaatatcattgtgcattctgaatatcatttatattcataatcattaaaaactggaaaccacctgaatgtcctccaactggtaagtggataaactgatatgatacagccaaatgatggaatactactcagcaataaagagtgggacctattgattttaacaatatcatggatgactcttaaatatattttgtcaacttaaagatgctagacccaggaagctacatatttgacttcacttattttagggatggagagcaatttggtggttgccaaggtttgagggagaggacaatagttgaccaaaagaggctgcacagatgaactctggtgtaatgggactgtttcacatgctacttgggtggcagaaatatgactctatacatttctcgaagtccacagaactgtgcatcgtgagtgtgaactttagatatgcaaataaattttcaaaaggatcaacctaaggatctcaggatggaatgcagactgagaaagaaatctaacgtttacaaatgtatgttataacctcactaaaagtagtggggggaaaagtaattgacctgaataactttagaaaacattgacattgttttcactggaaactgaaaagctaaaaacaaaaggaactgtgcatagcgataccttctggcagttctgaaaccatgttatgtgttttgatgtatgtgtatgttttagatcatgggagccagatttatcactatcagataaaagctaaaatcactaccagataaaagctaaaataagcaaagggggcagtctagaatgaatcctgtggtgttgaattagagttggagccatcaatatgcacaagataaagattttcatgctgctgataaagacatacttgagactgggaagaaaaagaagtttagttggacttacagttccacatggctggggaggcctcagaatcatcatgggaggtgaaaggcacttcttacatggcagcagcaagagacaatgaggaagtagcaaagcggaaaccccagataaacccattagatctcatgagacttattcactatcacaagaatagcatgggaaagactggcccccataattcaatcacctcctcctgggtccttcccacaacatgtgagaattctggaagctacaattcaagttgagatttggtggggacacagccaaaccatatcagatatggatacataaaagtatagatatgtgtgtatacatcgtttagtacagatacatctatttcctaggtctgtctaccaagagggccaagaagcaatgatacactattggtaaagagcagacccaatgcctagattgtactttctaaataccactctccaataaaaggactcagcattctttgggaaaatggctaattctagggctgggcagggaagatacaagacagaccttgagtgtcttctagtgtcaaaaaatgaggaagtgctcaaaaaaagaaaagaatggggcatgtcacaggggcacaggggccaacctaaatgagttcccaatggccaagactggaaccattaaagcagcaaaataaatagaatagtgctagtttacaacccaaagcataaaacaaatgtccatgagttcctacttatataaatacatacatacatacatacatacatacataaatacataaataaatagagggagaacagataaatcttccactttgaacaattccaaatactatatgtagatataaccccctccaggaggtggagcttaattccactgtgctggaaagtgggtcatatttagtgtctcacttccaaagaatagtgtttggaaagggagaaagagtaactttacagtagagaaacctgacacacaccgcctgagccaagtgatcaaagttaacgttgctggtgatacgggacatccatctcatgtaccccctgataggatgtgcggaggagggtgcctcatgtttgtgacagtgttccccaaacacatagtcctagtctaattatgagaaaaaaaattatgaaacaaagactgaaggacattctacaaaatacttgacaaatattattaaaactgtcaaggtaatacaaaaataaggaaagactgagaaactctcacagaccagaggagactaaggggacatgacaactaaatgcagtatggttccctggaatggaccctcagacagtaaggagacagtggaaaaactggtgaataatgtctgtagtttttattaggttggtgcaaaagtaattgtgctttttgccattacttttaatggtaaaaaccgctattacttttgcaccaataatagtaatatgccaaggttaatgtcttagttttgacaaatataccatggttatgtaaagtgttaatgttaggagaaactagatgaagggtacacagaaactctctatactgtatttgaaacagttctttaaatctaaaattatttaaaaataaaattttatttaaaaacaaatgaatgctgtgtatgtataatgacttggaacaattccaagatatattattaagtgcaaggaaaaacccccagcaatttgcagaccaatatgtataatatgctactatttatattaaaatatgtatgtgtaaattattcatattgcattgagtatcctggaaagtttgtccaaaaacttggtgatactgattgccttgaggttttctgggaagaagagtggcaaggagatttacttggatatcttgcactttgttgcaccatttaagttttggtacttgtgcatgcatttcttattgaaaaaataaactaatgatatgtatataaattttaaagcccagctaatctcttagggcttaagggtagtaagtaaaccctaggaaggtggggtaaggctgaggagaggaaggtcacacctttgaatcttaaataacaactatagcgtacatgggtcggaaggagccttacttttttactgaataaacttttctatcttctgatttaaaaagtacaattaactttttaaaaagctcagttagtggtggcattctagtcatacttctctgaagagatttttttctaaatctttattacttatagtctccgtgggattttttaagagttcagcagaagatgattatactcttgggaattttgatgaaataaataaagtattgattagttcctgtttggggatttaaatctacagatttcttttttctgcccttgaaaaaaatctagctaataaggttttacctcaacttttttttccccataaatcaacaatttcttttaaaagtcaacatgacccaagtaggagaatgttttaatatgttcaacttggccttataagttagatatcgagttgtaccttgcattagttttttgcagctgccacaacaaagtacaacagagtggcttaaacaacaaaaatgtattgtctcacagttctggagaccacaagccaaaatcaagatgtctgtaaggttggatccttctgaaggctgaggcagaatctctttaagctccttttcctagcttccagcagtttgctggcaatctctggcattctgtgccttgtagattaatcactccgatctctgccttctccttcacatggccttctctgtgtgtgtgtgtctgtgtccaaattctgcttttataaggacaccagtcatattggattagggcttacctaatgaactaattttaacttggttccctctgtaaagatcctatttccaaataaagtttgtatcactaattctcttcattggctgagctgtggtctagactgtcagtaattgcatttccgtggtcttcctttattcttaaacttagctgtacatcagagtcacctggggaactttgaaaaatactgatgcagcagtctcactctttagagatttagatttatttggtacagagtgcagcctgggcatcagagtgtttaaaagcattttcccagatgattcctgtttgcaacaggattgagagctgctgctgcaagccccatgcactcaaggagaaagaacgagtcagttgccacatgagcatattctgccttgggcaaggaatgggaaatgagtgagtcagtgatcacaaccctttctatttttgaatactgaataggtataaaactaattagcctcttttccttctggtgtgtgtaaggttcaagcacacaggaatattaagggaaattaaatggctctcagcaaatttagttggtccagatgccttctttaactctactatctttaagtttccctcttcccttcttgggaatgtgttcaagggggtttgagtagcagcaattgctcaggtgccacccaccccacctctggtgaatcagttagttttcattcatcagggcctacgcttgaaataatacagacatctgagagtataaacatagctatttgctattcttctttctgctgataaatcactgcttcactcactgagtcttattgttctctaaaaataatcctttcacatgcacatctggggatttttttctcatcttccctaaaatttctgtttaatccctccccaacaaagtcatctcaaccaaattggaatactaaatcttttactttttcactactgtctttatttatttgtactttccataatgattttggtgcccaaaaggccacttgaaaatactgaaatgttgtgaagtttaagtggaagtaactaccacttagacactaagcctactaaatgatctgagttacatttccccatctctgacacagacacattaattccataattgtcccagtgcacttcattgtgttcttgtcaggattagaagaataaagatagtaaaaaggacttgggaaatataaaatactctattttctcagttttattgtattcagtgatacagctgtgacaatagcaatcctagcatttcatcatcactatttgattgagctcccagctgtttacctggccaggagcaatcaaaatagaaatgagttcttatagcttgttttggattttatagtctgatgctagctacctcatccaatatattatattttgaagctcattacaaaaaaatgggtgctacagtgatggatgtgaatagttaacaaatatcatttggaatagaatttcactatccccaaagaaccctctctgaagtattatatgtgacattcagactgtgattagaaaccctcttttgaccagaataacccagagtcatacagggatgggattctaggaaatgtaattcccactttaaccaaacagatgtaacacaatctagcttaaacaggtgctactatcatctgtgttttacaaatgagaggcagggcacaaagaagtcaagtaaattactcaaggccacacagctaattagtggtaaagtcaggtttgaactcagacagtctgattccagattgcaagcttcttacccctgagttttgctgtctctatgataagataaagggttctgtagaaaatctcagtgcatttttccttgcatcaagaatccttgtttctgattaattaaagaaaacttatcatcaggctgttacataaagcaattatatgtgttgtggcccttctgttctactttttgttaataaccctaacttattttcattttttcacagaaattatttgtgttttgccctttcaaaattcactttttttcctgaatcatttcttgattataagccttccaactattttgattgttgtttcactatgtgactcttagcagttgcatgtgttgcactagtttaatgatcgttcaggtttatgttctttgtatatattctgacatcattaaagtgttcatgctccatatttccaagcatactgcaacatccttaagtcaggagtattctttatatcaccaccaagcagtgcatagtagatgctcaaaagtattttttgttaaatgacaaatcttcctgtagcaaatcaactccattgggttttgttattctggtttaatgtctaccctcctaaaaatactcccaaaagaggatgaaacacaatgaatatttttagactggaagattcccaggattttccaacactagtaaaattattccttccaatcagtttcctcttttttcaaaggtattaaaatgctgataataatatttttaaacttttattttttaattaacataaattggtcttatattatgattttatagctagagttggcagattacttgtgactgaaatactgaattataacatccaatttagactgggaaaataaataagacttaaatttgttgtgttataaaatgaaatgtctgtattaagtatctccataatgagatttcattctgaatcacacttagagacagagtatctaattgcaatctgtaaataaaacatgctccaaaatatcacaattctgctgggtagattatgacagatagatacaactaggtatgtgttttggaggagtaaattattatttttactttttaatttagtcaacatggtttattagctgctactcaaaaatttcagtctgttagtacatattatggtgaagagtaagttgaagaaaatggagaattaaagacaaatgaaaagtaaaacatttccaaagagagttttgtttgaaactacatgacaaatgttttttcaaatttctttatcaccaatttttcaatcatgtaccttccaaattctagaccatccggctgtatcattggccacagtccttgaatgtcatcacgcatctggccatttctccttcaagcaaagtgaacaaccaggtgtactgctcaaagttctgcccacgagaaagatgtcccttaccactctacttcagggatgtcccagaaaaaaagctgtagtggtgcagctgtctgttccctttcaggtggtactggcatatcacgttgaaccatttgcagaccatgcctatggtcttatcttcctctaattaagcgttcggtgtctactaaggcctggtaactgtttctcaaaaacagagtagttatctacgtgtgatgccagggctctgaatttttaagggcctgcactgtgattcacctgtagggatctgacaaaggcctggcagctctgaaattttaagggcctgcactgtaattcacctgtaggggtctgacaaaggcctggcagctttttcggtcactcagtagattagttggagtaacacacacaaatgaggaatatgttatcttgaaaagccaagagacctcttttttggttgtaggaggggccagatgcaacaacttatccttcatctcagaagagatatcacagcatgcccccacaccactggacccctagaaatttcacctaagtagaaagcctctgaatttttgtcagttttatttcccaccctggcatgcggtaagtctaagtagttgctacttcttgctcagtaggtctgatcagcataatgtcatcaatgtaatgaaccagcataatatcttatgaaggggaaaaattgaccaagattcctgcaaactatggttttatagcctgaggattggagagttgatatatctctgaaataggacagtgaaggtgtattggtggcctttccagctaaaagcaaacggcttctggtaggccttattgacagggatggagaaaaaggcatttgccagatggatagctgtataccaggtactaggggatgtgttaatttcctcaagcaacaaaatcacatctggcacaacagctgcaattggagtaggcacgtagtttagcttaagataatccactgtcattctccaagatccatctgtcttctccacagatcacacagatgaattgaatagtaatatgatggaaatcaccacccctgcatccttcaggtccttgatgatggcactaatctttgcagtccctccaagaatggagtattgccattggtttactagttttctaggtacagacagttctagtggcttccacttggtcttttgccataatgatcctgacttcacaggttaggaaaccaatgtgaggattctgccagctgctgagtatatttatttcagttatgtattctggaactaggaaaataaccacaagataggttcagggacttactggacccactgtgagacgtctttgaactaaaacttcattggtcacctgatatccataagccactactttggtgacccacagtgatgtttgggtctcctgaaattaatgttagctcaaaaccagtgtccagtatttctccaaaggtctgattatttcttttcctcaatgcaagtttactgtagtaaaaggctataggtcactttggaaaagcctgggaaaaagaattacagcatgaatttttgagagtatgctggaatccttcctcaaggagacccaacttccccttcattgaaagggtcctatttctttctttctttcttttcttttttttctttttgagacagaatctcgctctgtcgcccagactggagtgcagtggcacaatctcagctcaccacaagctccgcctcccaggttcacaccattctcctgcctcagcctccagagtagctgggactacaggcgtccaccaccacgcctggctaaatttttgtatttttagtacagacggggtttcaccgtgttagccaggatggtctcgatctcctgaccttgtgatccacccgtctcggcctcccgaaggggtcctgattctttaaagtggctcaagtctgggaattgattgagggaatatgactctgtttttatgattcaggttaggcttttgttcacttgaccaagacttttctgcttataccaatgaagtaagaatttagtaggcttcctatttcttttcttcgagaaacatcatgatcaactagctaataccacaggtctacaagactcagcgtattctgattgctgctttggcacttctgtccatcagggaaaccctgcccaccttgcctgtgacagttgagtgctgccacttggcctctgccacactgcagttcagttattcccattgaattaagttttcccaaatcaatgggtgtagttcccacagtaaggtctggtctacagagaagagcaattgtggagctcttcaagaatgatggggcctcccacacaaatttatttctcatgcttgtggtaaaatgtatatcttctggattctaccagtttagataggtagatcacaaataacaagcctaccctaacattccaatctccttgagcctttgaattttttcctctgtaataaaccaagtcaggtctggcatttccaacttgttcactgttgaccaccttttggttcatgtttcagccatccaaataaactgctggagtctagatcaataagtttggccttttccaactttatgttcctttcaccattatcccacacccttagtatccattcccacacatgttccctggatttttgtctgtgtacattagaaaactcaaatatttcttttggaatgtagcacagctcttcatgggtcacactttgaacctcacctttaggggcctgttgggtcttaaatcttgttatagatctgcaaacaaagagatgtgagagggggaggttctaaggagatctagcattgtcttgcatgtgaggcctcagaggataccatttcagtttcttcaggcaatgcagggttaatcccctcagacaaagtggtatagggttttcagatgggggtggaaagccctctaccacttgaggttgttgggggacaaatcaattcacctgggggtagggatgctgctaccactgggtgtggagatgctgggagtaaggaagccacttctgctgggagtggggaggccacttctgctgcatggagaagcttcttctactgaacagggggagacttcttctacgggtaaagaagacttaccagaatgtagggcctcaatgtccccaacttcatcagagttttcctacatatctccatcccaacttacaggatcccattgttttttcaactaataccctcattttaacagtagagaacctgtgagactaggagttcaacttgtgttataattcagccagctgcaagatgagattctgcatttgatttttgtcaatcttagccctatggctacaggagtaacaggtttccttcagaacacacatagaagacgttaggtcatttctaccacataaaaactgggaattggaacctcttagctcattctttttttttttcaccactttgtccagaaacattaggagtgaacagccaaacttactatgtttgttacttttccaaaagtatcagaaggtattatatgcagtcgctcagctccttgcttattttttttttgagacagagtctcactctgttgcccaggctggagtgcaatggcacaatcttggctcactgcaagctccacctcccaggttcatgcctttgtcctgcctcagcctcctgagtagctgggactacaggttcccaccaccacgcttggctaattttttgtatttttagtagagacggggtttcaccacgttaacctggatggtctcgatcacctgacctagggatccacccgcgtcagcctcccaaagtgctgggattgctccttggttcttataagtgatggattgagtttccaatgcaaatatttgtgtatttctgttgccagatcaaacatgtagtatcagtgctttcttcacttctgaagaggaagtcattaaaatatttacctcaaatcagattagagagccaattcagaaaccacatatatatatatatatatatatatatatatatatatatatatatatatatatatatatatagtgtgtgtgtgtgtgtgtgtgtgtgtgtgtgtgtgtgtataggctcatgtgattatggaggctggaaagtcctacaatctgccatccacaaggtgcaaatccaggaaagctggtggcatagttcaaaggcctaagaactagagagctgatggtatagattccagtccaagtctgaagacctgataactgggagcataatcattcactcctttctttatctcttctgtgaaaggtgaatttgaaacttgtcccatcaagaaatgaagtctgattccccttcccttgaataggggcagactttgtgatttgcttcagcccacaaaatccagcagaaataactttgtgcaagttcagagcctagcccaccagagttgttacatgcttctactcttttggaaccctatccagccaccatgtgaacaatcataggctaacttgctagaggatgagagagtatatcagccagaattgagtcaacccaggtatcccagccatgatgatgtaacagagtatagcaaagatcaacaaaaccaacttgcaactgactacagatgatgaaggaggccaatttagacaaacaaacaaacaaaaacccaaaaccaccaagatgagttcagccgaaattgtttatccacagaataataagctaagtaagtggttattgctttaaaccactaagttttgggttgttttgttatgcagtgatagataactgatacaccaaaggagttctttaacagaacaaaagactaatcaacattatattaaataactctatcttatatactgtatataattaactctaaaaagcatgaatagtctgaaatcattctcttattcctccaaagaaactaataagcatctgcaggctgtgtggctagaacatacttgggattctcctgtctgtatcttaccccgacctaatcttgtcatagggtggcttggcttactgtttgcttttgcatttgtatgagtacctggagcacagtctgtactcattgatccccaaaatggctgttacttctggccctctaatataactgctgagttgattcagaaacatgtaaattaaaagttgacttaatagaagttcacttattttttaattaaaaaattaagatgtaatacccattctctgttttacttattcatatatatatataactatgttttgaaaagtgcctgtctccctgcaaatacctgcacactgacacttatagcagctttcttcatagttgccaaaactatgtcctttcagtagatgaagcaatgaaaaactggtgcattcagacaatggaatattactcagtgctgaaaagaaatgagctatcaagccatgaacagttattaagaaatcttaaatgcgtattactaaatgaaagaagctaatccaaaaaggctacatactgtatgatttcaactacatgacactctggagaaggcaaaattatggagacaataaaaagatcagcagttgccagggattactcaggagagagggatgaataggtagagtacagaggatttttaagggcagtaaaactactctgaatgatactataatggtggatacctgtcattatacatgtgtcagaactctagaatgtatatcaagagtaaatcctcatggaaactatgggctttgggtgataatagcacgtccatataaatttatcacttgtaacaatgtactattagtttggtgcaaaagtaattgcggttcttgctgttaaaagtaatagcaaaactgcaattacttctgcactaactaaatactctggctgtgcgagagtgggagcagggggtatatgaaaactctgtagtttctactcagagttgctgttaccctaaaaattctctaaaatataaagactattactaaaagtatctggactatggattatgtattaaactaaatgtttccctctctttttttgtggaaacatttcagaattgttgaagtatattaatgtatacttatgtatgtacatctgtgacaggctaacacatgacaagatttaaatctttgaaactgatactatcttgagctacttaattcaccatcagtgtaataatgctgggatttgtctgaagggtgagtgagttctcctttgaatctgattgattttccccagaggggcattagaattcagaatgcatttctaatcagtttgctgtacctaacttattagaattgctgtttgattagtgcccactgcaaatcaatataacatgaagggtgtccattttaataagcagaaagactactctaagaaacagatttatcaaagaatttcttaatctgaagtgccagttgaggtcatctactaattgaataccttcattttatagacacaggcactgaaattctcaagagttaaacagtttccccaagatcacatagctgggtaatgattgggccagtactgttatttattacttgataacatctttcagcagtacaaactgtctgaaacatgtgatggaggaaggagagcatgccacagcaactgtacgtgtacaatttggataattcattgacctgggaattgccagtactaaccctgaatgtgctcaattttgagtttttcaattacatttcctcatggaggaaggggtttattttggccttctgtacaattcttgctcacccttcaaaattcagtttaagcatcatattgtttggaaagccttcactagtgtactcaggcactattgaccagattccccactacgttttgtgctacccatcagttacagccacagttctcaaccaaggggtgcttttgctctctaggagaaatagaggaatgtctggaaatatttctaattgtcatggcttgaggtagtacctagtgggtgcaggccagtgatgctgctgaacatcctgcaatgcacaggacggcccatgctcatcaaagaatcatcgatccccaaatagcgttgctcttgagaacccctgaattatagttattgttttagatacttgccaaagccaagaatggttcttctctctggaatagttacttttagttcttttaaactaaacaatgagatgaacattttaggacatcaagagacacacattaattcaaaggtgtgttttttttttcccactgctcttgcaatttttaaaacctaaaactgtgttcaacagtattcagatatgacttacattggcatcagttctttgatggtgagacttctctttcttctcctcctccccctgcttaagttcacttactttgtaaggatttagatgcacaatatttcacttacattttcaaggggagggaataagggatggctgtattactttatctcccctcttccaaaatagaattattggcttccaataagagcaaactaatatctcactggtggcaaattcagtgggcaggtccctttctcttcactaatgtcaactttatacataccaacaaatttgttttatacattctttcaattgttgctgctctttgggcaagatgcacgtgggtgtaatcgtgactgccggatctgtcctgcagatcctggccgacagatgaaatgactactccagacacaggtatgcagtgtaagagcagctaggtgactgcctggctctagtggccagagaacagcagcaagaagctggagctgcttgcttttattcagtggaggcacagtgccaaaaactggagccaacacaacctgtaggtaattaacatttattgttcccgtttcagggaacgtcaggcacgcggatgatcaaaggtgagttcctggtcaacacaagtaaacaagcctgtttaagaaaaattcccccatactcccttgtatctactccttgccttctgccttagagttatagaatagctgccttcagctattctcccctggggctctgcagaagcttcctacctttcagaaggtttgtgtcctttacctatagtttctcccaccactctgactgattccccacacatgacttagctaaggaaaatagcagtcacagtaggataaccccattagcttctcggaagaaaagaccgaccatatattctgtggtgtggtgtttgtggggccaaagggaggatggagaggaggcgaacttggcctgtcaagagggatttagctggtcattgtggctggtgcccataatctcagtgactctggaggctgagacagcagtatcacctgaggacaggagtttgaaaccaacctgggaaacagcaaaactctgtccaaacaaagaagcaaacaaaaaacaggaagggaggagggatttaacaaaagggatttaacaattatcatatacaagaaataccagacattttaaatgtactgaacacacaaagccaatgaaattgtaaaaaataatgaacaaaaaccttaaaacatttagtgtaactttaaagctcaaaggaatgacatccatggaaattaattcacaactcctagagaatgtttaagaatatttgtgatttactcactagctttattttagcgggatgatatagttgcactgcatgaaaggcttagttacagttgggcttaatgatagaaaaagaattagtttgactttcttttctggagtacataaaaataagtacatatggcctttaaaatgagttttgtgaattaaatgatttatttttatacttgatttttctccttagagaatcattttgcaaatgttttaccttggagagtatatgacaaggcctaatgccactaaatatcaaaatgaagacttttttgatttattgggattcatttttgaaaatgcttacaggaattcacacacacacacaaacacacacacacacacataagaacttttttaaagaaactaccaacaaaatctcaatctgaaaactgacaatggatagataatttcctattatttcaataacaatctgaggttagaaggccaaaacaaatttgagtttgcatttgcacttggcctcatccatttctacgaggaaaagaatgtaggtacaccaaattttctgtagattgaattatagttttaatatccctttaagcatatttttggctttgatatttcatttgccagtaaagagattcttttgttgccaagcaaaagaattaaatgagtttgttttagcttggaagctaacactcctgtaacttacttgcttttctaatcaaatccagtgattattaagtatcttttatatgtgaagtggtgttagacgttggctattagtaactcttccttagaagaaatatgtaattccttcaatattcagtaaaccagttcattagtacaaactcaacctggaaccttctttcaaaagtagacctgagcctttagaaggcagtagacttttagaacattgaaagactttcaaggtaattcctgaaaatggatgctgagccaagtgaggatccaagtgcttataaacttagccaagagaatagtcaaaaatctctgatttgaaaacctaagatgtagctaagccaatataagatatgacttagaaaggagaaaatcattatatggttgacttactggtataagaaaaagaggagtgatggaatgtgtataacaagcaactttaaaattaatatcccagagaagacaacaataatttctaacgactctattttgtattaaactcaaagcttctgaggcttcatctgtttctgttgcatctatggttttatatgtgttccccagaaatgactcatttgttcagaaatgtttatattcatccaattattcacctttttattgatttaatacaccattattgagtttctgctaggtacctggtactatgctaagtgctgaggttataacagcaaataaaccctgcagtgtttttgccctgatgtaattaattacataaacaagtgtctaattatatttgagatgagtgtaataaagaaaaagcattttatgatatgggactgatttatagagaatttgatctagtgtacaggaaagagacaactgccctatgaaagtgacacttaagctgaaacttgcatgtgggcaaactctctagtttgggaaagtcctggtatcttcaaggaattaagagaccaaagagaaggctggatgataaggagtaggaagagagtggcatgacagatcatgcacagcatttcaggccaagttaaatatgttggcctttacccaacagatacccattttgtactgtgcagtgtacaaatggcacataatgtgcacatgatggcatataattggcaccatgaaggacacagaagtgaggaagacatagttggttcattcaggaagcctctggtatcgtggaggagacaagtaaaagatgccttttctctcatgtgatatttctggaagagagggtcgctaagctttcattttattccctgtccttcacacaatagatgacacctactttctgctcagcagtaaataatacatattgattgcatgatttttaataaacacctataatgtgatgataaggccttgcctttccaggtccctgatttctgtgcaagattttgactcttagaactttggccttttagaatctagagagcttgggactcaggctactgcctctgaacctttgtgattaaaccataccaccttagatatggtgggggccccacccattcaggactgagtgagtgctaggccactaaaagtaagctattgtattatatacagggtcttactagcagtgtgggaattgaacacttcggagccaaagtgctcaggatccagtcatgactctgtttctcataagcactgtgatgttttaattttcttatccccagcttctcagcaataaagtggagagaaaagcagaacctacttcacaggattattgtgaagattaaatgtgaaagttcttagtacattcctgatgcatgttaatattaaatactcaaaaatgttacctgcatttaaattattgttttgttaggtaattctcacaattcctgtgagatactagtgtttctaacatttgaccctcaatttttttttctgatcactttcactcttgactatatctggctgccccaggctttttgtgccaataggaggtttactcagttgtattcagtagcacaaaaatcaattcccctaatcccagtaggcatcctgtgcttcaaatggtaggatggggaaattgtgtctctgggcctgaaagcccatctctcaaactgggctgtaaatataaaagctatttaaagccaaatcttggaaacaatttctggacttctttaaaattgtcaccataataacagtgtgccaacttatagcattagaaacaaacagacctttgggctgtaaacaattcctacgtaagtattcttatcaattttcagaaccaaatttatgttggcacagaaagttccggaacaaccattatcatttttcaaggtggagtgagtacgcagggagtcaggattttagacccaaaactttattctcaaataaaattatgtttatgatcaagtcaggcgatatgcaccttaatttttattggctgcgagcagactgcattttatttcttccatgtatttgggataacttttctcttctggtagttttctatattttccaaaggttttataataaatttgtattatttatagaatcagaaaaattatttttccttaaaaaagatgtatatatcattacagggtaatgacgtgtacatgtatctcttctataatcctatttatttttatggtcctatgcacaatgtgttatagaaatttactgatacatgataccttgcatttttctgaaagctaatcttgatgaataccatatgaattttaattgcttgccagggaattcatttagttgtgtatgactgacttagaacattttttggcaaataaccaaggaaaatttgttttatacaaggctcaacattgccctcatttaattttttaaatatatgctttacttttgtagaaaaaaaaaatatatatagcattcatcatataggaatcctgtttttagtaagctcttctgtgatatttttttggctttgccctcaagtttggcctaacattgcttttgaacatagtcatttgctgtaagtcctaaatgtgtattcaagcacatataggtagctgaccctgagaattgtattgtgctctccatgtactctcagaattaacgatcccttgccatactcactgtgatgtgctaatgtatgtgctagtatttttggaaagacatcaatgtcttttgagcttcttcttaagactctaaaatctttgaaaatttaaggtatcctagacagaggtagtgattgctaaacatttgttaagatgaataagagctaagtaagacacattttcagtaacactgaaaagacttttagtaggttaagggtcaataattagatttttattttagcccccatactatctagaaaatattcttaattgtacgctttctagtcttcaaagtagatccagttctcagtgcttacagtagttatcctattgtaagtaaagaaataggattaatatatagctaatgctgtatctactttttttttttttttttgagacaaagtctcaatctgtcacccaggctggagtgcagtagtgcaatctcagcccactacaaactccacctcctgggttggagcaattcttctgcctcagcctccagagtagctgggattacaggcacctgccaccatgcccagctaactttttaaaatatttttagtagagacagggtttcaccatgttgaccatgctggtcttgagctccagaactcaagtgatccacccatcccagcctcccaaagtgctgggattacagacgtgagccactgcacgcagactgctatatcttcttttaatttaatgttttataatttttttgctagtactgtgcagtagttttctttcttaaccaataatatttttagtataaataaggatctaaggagctatgtaaaatttctgaacttgaactgatttgtgttatttgggactttatttcatggtattaatgctttcttggtgttggtttgtaaatgcactgccaatgatttatcagtgacggcagatagttccaacatgaccagtgctaagagaccatgatcagctcccagttgccacagttagagtggtgtctatcctgtgtaattccgagagggaagggaccatgttgaattggagagattggggaaagggaagctagtgtatatttattttctacactgtctcaggcattgtgacacgattattatatatgggatctcatttaacatgttcaaggtcatctagcaagtatgagaaagagctagaattcaaaatcaaatctatctctccagaagcagatagtcttcttatctatactacttaaattatttaataaacaatgtatttttagatctggaaagcttggtaaagcattgctcatgtagacggatgggtgggaatgggatgttaacaaggggaagcagtaaaaaatattccagtcacagtgacatggtgaaggatagagattagaatgtgtgtttgataaacacgaagtagtttggtttggccagaacaatctttggaagattggtaagagtacagactggaaaggaaggttagcaacatgttgtaaaggacttttcaaatgccaagataaggagtatggacttaattaggaaggcaccagggagctactgagggttttgtgtggaggagcaatatgattatagctgacagcagtcttaataaggcttaataaatagtacagtctataaccttaggccaactgctgagcagaagccaaacgctgtactgcagaattagcaaaccaattactgtgaggggtgatggcctgaatttaatctgagtcatccttcacaatggagtagaaactcctggcaatgtaaacaagtatgtgaagtgacaggtgacatgtctttttggagccgacttcacttatttgactccacagtggcatgctgttaaaatgccttaacagtgccataatttacttttcaccatttaacaaatctctcatccttgtaaatattcagtgtgtttttatggcttttctgcaggcctaaaatctattgccatctgtcttattagttgtaataatgttttgccattttttattggtattaataggctttgccaaaagggaagtcatcattatgttttctgccatttgatttaacagctgattttgactataagacaacattcaaatttagttctagcaactaagataattttttaaaatttagagagtaagctacataaaaacatattagtttcctttaccatttggtaattttaagactgtgtgtgtgtgtgtgtgtgtgtctgtgtgtgtactcacctacatgcatgcaagggcaggagactgagagtgagactgagagagagagagagacagagagacagagagggaattgcttccttctcgggaacagctcctggcaaaccaaaaagttacataattaagttacttataagacacactctttttaatacattttgatggttagttctactcacacttattgcttacatagtcataaatttttgcctctttgtctgcattccaatattattttgaacttatataatttatttattatagtaagccttcttcctttttccttttaactagattgtgtgtctctcaaagacatgtttatgcgtttgatgcatagcatggcatcttggctcatagtatattttcaaatatttattccatggagtttaagtattcctttcttagaactatcatgcttgggcttttgctcattccacaagtcttgagaatatcctaagtattttgccaggtaaacagaacagagtccctctcttagaaagcttacagccaaaggatcagaaaatgacaatgtagtctgtaagtgttattggtgtaggtaaacttgaggttagagaatggctaattagaggaggtgaccttttatctgagttgtaatgcaattaaaaaggaaaagtgtaaagatgagaaaacaggagctatagttataacaacatctacacagtcatgagtgtaagagagaatcatgggatcagatcacggctaattgtgtgactgaggggagtggtgagtaataaatctggtttaacacaaaaaatcagttacaaacagatttctatattgtcattttaaagctacaatttaaaattaattggttgctaaattcttgacaaaggggtcaattgctgtggctatccattggtatttctttgaaaaaataaaaggttgtctggtttaaaaataatattattttatttcattattttagaccttataagcacatttagaatctgtatggaattagagttctaatatatatgtatacatatacataatatataaaaataatagtactttcttttaaaatttgaattttcaatgagataatgcaagcaaagtgaataccatagtgcacagcaaatgtaagaattcaatttgtattattggtatgttttgtggagtgttctgtctgtattcatgggaaagatccagtgaggtatgaagcatatttggcctggtgagaatgcataaatctggccaatgctcccttgaaagctcgtcattctggtctaatattttttaaatatttgccacttggtccaaggcccttcttatttcaccattgcttatctctagattgaaacccaaagtagcagcttttgaaggttttatttcaaaataacttttttgcagcttaatcttttgtggttggtgagatggatggggccttgactcaggaattatcaagttttctcttaacttagaatgttaattaacgtgacaaagaaacaaggttgatgcataagaaggaagaatgagtactataaggagactttaggaatattgcacatcaaatatatttctgtgtgattaataaattttttaatgtattatgtttaacacacatatattgaattgtcaagttcacttctgccttatatcagctgtgtgatctcatctgaaaaatcactataatagtacctatgtcataagatcactagagaattatacaataatttatatgcatatttaacatgatagctggcagatattaaatattctattggtgttagctattggaactccactattatgcaaatgtgacatggttatgaggataaattgtgcaaataacagagaatgtacacttcttaaaactagatttatagatttatcactcagatctgagtaaggtttactatagtgtgttatgtatagtccttattctccagaactaattatttgttacttcagactgtgagtttgaggagattcattcatttcaagtgtgattagaaaatgcctaatagtctaaatttcaaaacatgtccttgaggccaataagatcatttattaaaatttctgtttctataataacataatgcatacactgtctacaaaaactcttacttttcacagaaaaatgtcttaagtttcccaatcagcccaattttgtgatgtaaacaggacccactaggagttccaacttttaccacattcatacagtgttactactatagtgcttttctacccataaagtatgaagtattgttcagtcagggtcccaaccggaaatagatggcactctcaaaactggtaatttgaggagagtttaataaagggattatttgcagaggtttggaccagagtatgggtgactgcaaggaaagtgcagtatcctcaggggactaggagcagcattggtgatggggtgggctttaccacttctaggcctgagtggccaaggacggtgagaagctgagggctttgtggagagggcttgaagtctcagacttctctcagggatgcagtagcctagtcagtatcaagtggtcagctatagtaaagggactcatcttaaatttcaacttttgacaaaagtgacagatcactcaaaaatgtatagaattttattaaaaggaagtagaaaaaagacattaaatcactgaagaggaagttcatttggagctgtgttattgtcaaagaatgaagactgcaaatttgggattttgtaaactttagttttttattttattttgtaaatgggctacttaatatatatataatatatgtctaaagataagctataaaagattcatttgcaagtatactaatatgtttgtctcctctcacctcctttctgtatatttcatggcattgccctgttcattgctgagcaaaaattcaaatgttacaatataaagtgactctgaatcccatcactcagagataaccactgtcaacattttagtgacttttcttctaacaaaatgtctgattttttttaatgatgctaaagctccttcctgttgtttgttggtcatttttttttaagagtgctttaaaatagatctcagtaatgggattcagtaaaatagtatatatccttgctatggaacataatgcagcagccattaaaaatcatgctattagtttatttatttaccgaagaggaattcatgttcacaagacaactgaaaaaaaatgagactgcaaaatagcagctacttagatgggttaatagatagttcagcgccactttgaacctacctccagacctccagatatgtatgcatgtgtgtatgtattctgttcatgtatccacaaagatgactataagaaaagtcaccaaaatgttgacagtggttatctctgagtgatgagattcagagtcattttacatttttgtatcattcaaattctttttagcaatgagcatatgttagttttcagaaaaaagttatttttaattttataaaaatgctcataaccaacgctcataaccattacacatatagcactattatcagaaaaatataataagcaaaatattccactcctatggttttcattgatggcatcactgactccattgaaatgtcaaattttctatttacacacatttgcatgtaatgttttgggaaatagaagcacaggaacactgtgagcaattgagagttgtgactgctgtgagtgctgtgggctagaacatgcatcttaccctgacgaagcatcttccttcctcagaactcacggtgacttaaaaggatgtgctcattctgcctcctaacattctggtgaggcaggtgcgttgcaggctatttcttatcctctatttacttacaaataaagaactttgaagcacagggtggtgtattggtttgttcaaggtcacatgatgagtctgtcagcagatctgcaaagaacatcccagttcctggagtctggatctagtctatagcctgttgttggctcaaaagctaaacaggtgatagatgagctcatcatatagctagaggtatgaggagtggaattgccaaagagcctgtgagacttgttatcctgcatcatgttccattccctttgtggggctgcggacggcctcccaacagggcagttagagcctaccaaagtccccagctctgtgttcctctggattgctggattgttgggagacaggcttttagtttctccctggttctttgtttcttatttgggcagtaactaattggattttcttagtcactggatgtttttctttgccagtccctctgcagtagtattagctgacagttttattttattttatggaattagatataactcgtaactccaaacactatggaaatcaacatgcgaattggactctgcattcaaacttttttcagaaaaggaaacaattcatcctggataaatgcatacacgttattttaacccttttttaaagggttgaaactgagcttttagaaagtcagtagcccagaatatttaacttcttagggcagaaaggaaggaaagcatttttatgtaaagaggaggaaaataacttgtgctcaaaaatacctttaagtataaacatgtatgaattttacagaataatctaaggggaaaggaaaaatatttattataggattatgagagaaatttaacatataagaaactgacactgaagcaaagctgacggttttaaattacttttctttgaaagttatagcatttgttaaattggttatgaattggaggtcatatatctttatttctttgtttgtagaattcatgttctaacatttatttttagttggaagtactgaagaatatatttttcttatgaatttcttttgtataaatttccttatgtatgagaaataaatatattattctttactaatatatttactctactagtagttttatttttaatttcagttccaattttacagttacttagggtttttgtcattaagtaaataagtgatgttttaaaatcgctttaaaacattgctatatgcaatctcttatgaaatcacaaactcccaaatctgtatactcattaagatagttttgtctgctggcatttcttgataaaatatttggtattaaatatataatatataatacctaaaatagcttaaagcattaagaagatatcacatcataattagtacaaccagttaaggtattaatattttaggaatgttctcaagtcaaagagaccatgctctgacaatgcattaaaatattgtgtgtgtgtgtgtgtgtgtgtgtgtgttagttactagcctttttttcagtttaccctaatttaatgctaataattgttaaagatatttaaagtctcagacaattcagaatgtaaaatctagctggtctttatttaatttctggatagatgacctacaatgaagacccacactataagggaaactgctactagagaagaaaattaacaaatgtaagcagagtcaagatcggctgtctctgagtgtttttgaggctgtaccccatcaataaaacctgtccttccaatatgtatgcatgtatttattaatgaattatatatgaactactgcaataacatactatgtacatagtaaaacatagttccaaaatagaattattaagataagcagaaattttaacatatttaataccactgccaaatagatgatttcttagaatacttggatttgtgtcccccggcccctacaacccacacacattctatagaacactagtaaagaatgctgctcttctctagacctcttgacataattctgagctgcataattggaagttaaaattggaagattaaaaattgtttgctaattgacaagtgtatcagttatcttattgccaaaatagtagaatgcatcaaactgccctagaacttaatagtttaaaaaaataagcatttataattcttcacatgtctataggttggctgccggttttctgggcccattgtaagcctgtggttagctgcagggtggagaggcagttttgctagtcttggctgggttctctcacatggctagctgtggactggtcacatggttctcacatgcccaactcaggattgcttcagttgagacaactggtctcccttccatatgcttctcacatacttgtctatcacattcctttagaagtctaggctggttatgttctcatggtgatctcaaagaggcaagactggaaacatgaagaaataaatgaataaataaacatgaagaaagaaactatatcaaatttgcttctatccattggccaaagcaagttatgtgatggagctcagcagtagactgggagaggccatgaattgtagtcattaatgccatcaatctacagcaataagaaaatctcttttccttaaatatacgcaagttgataatttctatatagctataagagtggctagtgctaattataccccagtgttctgattatttggctgtttggggtaattctctagccatagaggctagagaagttgcatctttgtaattcagttcattggaagtttaagttaaaatttaaaattgaatttttaagggggttcattatcactggcttgggtagtctgggctctaaggaagaagaagggaagaattgtgactatcataattatgcatccatttgttccacatgtggatagagcttactagttctacataggacatcgcagtggagaaaggaagtctcctttcggagcactggctgaaaattaaggaggaaacgtgctaaaattctgtaagtcagctaaagaattgataagctccactacaaagatacaaagtctgtgtcctgtagtatatattacacacatttattatttaaaagacatgtgatcccaatgggaaataagagcacctctcttcaaacgtgaaaaaaagttaattctgaatgataactttgtatctatttttgagataatataaatgtcctagattccgtgctgtgtcttagaaaaagacaataaatatttgcttattattcattatactaaataatatttgcttatttaaagcactataaaatagtaaaaaaagactaatagtaataatatcttcactttaatcacatttaataattttccatttgtttttcacttgtatcatttcacatgaagagccgtatgacttctcagagttcatacggacccttatagaaataactaccatttttagagcactcattttatgctcacaactctataaggcaggtattttaattaccccatatttgcagattcaaaaaagaagggctttaaaggtagactgcctaaggtcacagtcagttgtagagtcagaacttgaaatcttctctttgacatgaaagccaatgctcttcaccattacatttcactgcacttaatggatattaatattatagagaacttttaagaggtaaatggtctgaatagtgcctactaaagatatggtcaaaatggtctttgggattggccaggagagacaatcccctggctggccagcgtaaatatccagcattctcaaacattctagatacaataacattagttctcaagctgacccagcccactggaccacagccttggctctgactgtgttttcaactaagtcaccttctcattgtgatttgctcccataatgaatacacagactggcctcaggggagttttattacttatcataattgattaaattagcatctagttaagtaaatattaacagagaaaaacatttcaaaaaagactacaactcttatcactgtaagctcagtctttcaaaactatatagattatctccaaagtgcacacgatggataccctcagatgaaatatttgttcgaaaatgcagtcgtcaactatccttttgaccatcctactttatcagtgcagcagtcccaggtgttcactcttggaactgtcattcaaactaaatgactggggttcatttaaggagcgatttctgtatttctggaattatagctaggttatactctagaagcaatttgaaaaaaataaatgggctaaattctgacaggtaaattagctaatccaaagatggttctaaacagagtttattctctcagcctctgttctgctaattagtgtgccagaacagttgtttactcagtggatttgtgccattatttaaacttttgctaaggcaaaactagatcttaaaagtagagaaaaaattggcttggttttgatttgtgcacgtgggcagtatttaaaccactggagatgaagacaaaatgaaaaaccatacatctcttaagagttagctctcctttttctgagtaatgaatcttatcctccttcaggagcctctgctgagagaaatataatcccatcatatcactttagctaaaatatagggaaaatgtaaaatctcaaccttcttccaagcagtcttttaaatagaataatcatttctttcctaactagtcttgattttttgtttgtttttgtttttttgagacagagtctcgctgtgtggcctaggctggaatgcagtggcatgatctcagctgactgcaacctctgcctcccgagttcacgtgattcttctgccttagcctcccaagtagctgggactacagacgtttgccaccacactcagctaattttttgtatttttagtagaaatggggtttcactattttggccaggctggtctcaaactcctgaccttaagtgatccacccccctcagcctcccaaactgccgggattacaaacatgagccaccacacccagtctgattctttacagaaaaacttagaaaatacatgtaaataaaagggaaaatatcagaattatctgtaacttagtaatccaagtaaacttttaacattttatatgtattttcttaagatttttctgtaaattcaaatgggttcagattatcatctactttttcctactaaaatatatagtatggtaatttcccctgtcatgaaatattcttcaataatattatttttaatggctgcctagtaagtgggagcaaaacttccattatagattctattatgtatttaaccagtcattttggtcatacttagattgtttctaatttttcacttttagaagagcactacaatgaccatacatctgacaaaattttccaacatctaaaattatttcctcagtgtgaattcataatagtagaaattatggaccatggggtatgtaaaattataaatctccagtgaattttgtcaatttgtcctcttgcaaggtcttatctccactagcaaatttatgagattctactttccttggactctatttttgattactataatttatttttttaatttgaggagttaaaaaatggtgttatttttatttctatttattttcttattagtgaggataaatgcttttcttatgcatttttgtattcacatttcttccttttgatttgacatattttttaaaactctcctcaagattgagttatttagcgtattttgaactattgctttcatcattaatcaaaaaaataaattgaagactaatttgggattaagctatgaaagctgagtactaaatttcactctaatttgtagatatttagcagggttttttgtttggtttggttttttttttttttttttttttttttgagacaggatctcactcccatcgcccaggtaggaaggtaagagtgcagtggcatggtgaccatggctcattgcagcctaaacctcctgggctcaagggatcctcctgcctcttttttcttttcttttctttttttatagagctgaggtctcactatgttgcccaagctggtctggaacttctgggctcaagctgttctccctccttagcctcccaatgtgctgggattataagcatgggccaatgtgcccagtggtaaaactaaaaattaaacagattatttagtttttaatattaccttttatttcatacagtcttatagagaatataatttctctctgagaatgtattttgtgaaagtacaagatttgccaataagtgaagacgataaaaataatcagcaaagaaaagaaccagggatcagtaagtccgcatcattattggtcttgtttctttcaacgtctgggatggtaaaagggacacaccatctgcagtaccatggttatgtggaccatttctgtctctgaaatgttttgttttccagagtgagtttttttatcttggaattcttagcttccactctttaaaaactgtgccaaagactgggaaggaaaggaaagcaaatagagacacctctacagaagtgagttcttggtatcatcactgcacctaatgcaggaggtggagttgacgcaggtctttttattcattcattcaataaacatggggtaggttattggattgggtatgtggattgttactttaggaggctagggaaggttgtctccgatgagagaggaaagagcaagtgcaaacttcttgcagaggaggtatgtaaggaacagcaagggagctgcaacagagtgaatgaaggggagagccataggagctgaagtcagagacaaagtcaagggctggaccacaaaaggcctgagagacagacagttttccctgacttacagtggaggggctgtgggaccagatgcctgggactcctgcttactgtctatgtgaccatctctatacctcagctgctccctcatatgggataataatatttccccctctgacctattatgagaataaaatgtgttgatctgaggtacttagaacaggacctggcaccgtaagacttaatagttttttgttattgttattttaaaaattgatacctgcctctaaaggcctctaatttctggcatatccactctactttgcctctttttgatgccttgttacatttgttttttttttaaacaattgattgaaagatcataaccgaatctatagtacttatgtcttgaaaaacatttgtatttataatagctgttttctgttcttcaggaagtagagttataagtgatggagaaaagcttcagtgtggtcttagatttcttctggaatgaaagtgatatttttccattgggtcattgagtaatttctgacttcattctgtaggaatatgatcaatttaaaagtatatagtgattaagagtgaagaccctagatacaggttgtgtgggtttgaatttgagcttcacttagttgtgtgacctagggcaagtttttaaaactctttgtgcctcagtctctttataaaattaatatgatgatagtacctatctcacagtacaattttaggattaaatgaaagtgtatggtgtatgaacattatttgctaggctgcctgactagtagtaaacattcaataaatattggatactattattataatcagcgatttgtgacttagaagtatataagtgaactaaaattagaatcactgcatcaggaaatttgttagaaatatttttgaaattatcatttccttctcttctgctgttgctaagttaaaaatggtaagaaatggactcatcagatatttcctcccattgattttaattctgcttcatggctgcgcgttttgtatactgattcatgactgtattcactgaagcccaatcaaagactgcagggcaaagcttcttagaagacttcaaacaaccaggcttgcagttgtgaatgatatgggtctcagactcatctctcctcatgaatttatttatttatttatttattttgagatggagtcttgctctgtcgcccaggctggagtgcagtggcctgatctcggctcactgcaagcctcccaggttcatgtcattctcctgcctcagcctccctagtagctgggactacaggtgaccaccaccacgtccggcaaatttttttgtatttttagtagagacagggtttcatcatgttagccaggatggtctcgatctcctgacctcgtgatctgcccgcctcagcctcccaaagggctgggattacaggcatgaattgatttttaagagaataaaagagactgatagattctccaaagggctgagaaccaccactaggggcgtcactgtacattgtcgtcactgtatattgtcatcagttgctttaacttggcagctgctgttattgtgacatgattgtggctgttttccctctcttcctgaaatattagcataggaatattaattttcttaagtcttccattatctctatgaaaaatacttgattacttggggctatgtgaagactatgttctgacaggctaatctaatcctctaagaaagtgtgagaaatgtcttagatgaaaggctagtgataaatcaatatgtgatatctcaatgtagaataaacagtcggacacctgggggcacatggtcttagttgggggacagaggctgacatgtttctgcctttagcttagtgatgaaaatattagcatctgtagcattcataattatggatgcaaattaacaaaattttctccagtgctgtttaaatagaaatttctatgataatggaaatattctatacttgtgctgcctaataccgaggaacaaattattttattttattttaattatttaaaatttagttgctgtgggtggctggtggctaccctattggaagcatagttataagcaatggcttacatgagtactaggtttattttcctcacataagaagaaatctagaactgggaagcacagggataccatgggtgcctaaggatgttgtaaggaaatgagctccttccatgttcttcctcagcatccctgcctgacatttgactttcatcctcacggtcacaagatggctgtgccctggtgcatctcatctgtattttctacaggaagaaggggattgggtaaaaggtagacattttcagaaggctcttctgtgttttttccaaaaagacttttaccaacctctcattgacctagacttgttacatggccatccctgcctgcaagggaggctgggagtttaagtatttccctcagcaacttctgttgtagataaagcaaaaggaggaagaggttggaatggatatggaggccactggtctacagtttttaccatagcagacatttggctctttgtcctgtggaattccacaatcatgccacactcatgggcctggagctgccaatgtcttttttttttttttttaaacatctagttgacaaactgtaaatgacactagacttgggcttgaagactgtttagcacatagaatataggattagaactttgatatattggagtgatgatgagtattgcatttgaggaaaactgtctaatgactggatagtgtaaatggattttgaagtattaaaaacaacttagcacgtaccgaggaaataaagatataagagttagaaattgaaaaccaaaatctcaacatcagtaagcatctcattgttacagtatatacgagactcatggcctgatggaacaccagcccatgggtcaccctgggaacccccacaccaatgcttatcctctcaaccacaaacacagatttaaaacttccctttacagaacaggaaactgaagcttggagtcattacgctacttatctaaaacctcaactgctatgtgacagtcaggattcagatccgaagttggcggaggcagggaagccacggctttattgtcctgggctcgcgttctgcctcttcccctctctatgtgatctttctatgaccacatctgctcacgcttgttccccagcttgaaattcgttctcagtggctgctctgagttggccccccaatctgactctctgccctctagcctgcaatgagggagtggaggatgccggcccaagactatcatatgctcctccagagttaacagtttcttctaattgtctttagatcccagaacagcatctgacacacttaagaaatgcttactttaggccgggcatagtggctcacgtctgtaatcccagcactatgggaggctgaggtggttggatcacctgaggtcaggagttcaagaccagcttggctaatatagcgaaaacctgtctctactaaaattacaaaaattagccaggcatggtagtgtgtgcctgtaatcccagctacttgaggagcctgaggcaggagaatcacttgaacctggagatggaggttgcagtgagccgagatctcgccactgcactccagcctgggcgacagagcaagactctgtctcaaaaaaaaaaaaaaaaatgcttactttatcagataatgtgtgatatagatataagaattctcccagttttggaggggtattagaaaaatatacaaatgttattttttttttcctctttccaccagggatggttggtttgtttccagactgattttgcgtttctcagtttttctaagaaaatatgattgtaaaatttaggtcaaatttatgaatatcttccaatattttattcagtatatttaaaacttatacatgctcagtgtaaatatttttcagtaatctctgtaataatttctctttgaattgacagttatacaggctgatgttcccttaacatggaaactaagaatagaaggatttctgtagcctgtgtgtgtgtgtgtctgtgtgttgtgtgtagaactgtagtgctttcatttatataacaggttggtatctttatttctctttaagtcttttttgtaaagtcataatcccttgcaaaatgaatgtattttttaatcatccaaaggcccattacaaaaaattgaaaggaactttatgtgttatgtaaaccaatgggccaacttttagataatcttaaaagggaaatgatggaatggaattagctagcatttaaaaactacaattgtatagcacagatggaatgaatgttatgtttatcctgtgctttcttcaaatgtagattatactctttacctatctgatttcatttcagagctaagagaaagaatatttattaatatgttcaaaatgagctggttttaacagctgcctcaggaagaaaagttcattgattttataatcctgagaataaagacttcattacctaacactctcctaaacacctgctgggtgtaaaatgatgccctacctctattgaaatgaagcttctgcttattttgtagaaggtataaaactttgaaaactaagacagatccatagagtttgggatattttagaaccagtacttcagtttatcttcctatcatggtcttccagttgctggagaaaataatagagccttcttatgaatactaaactctctagtaccagtggatttcaaggatttcctggcccttcctcatctcaggggaaaataattttgcagtctgcttgctagttcctggtcagactgacaggacaaacccattttagtctatcttatggactacagtaatgcaactctgaatagttaagtgatttgctgtagtaaagtaaattatttgctactcctctcattgagatgtaaggtctaactcttcttcccttcccttgaatttgggctggcttagtgatgtgtttgactaaaagtatttgggagaattgatgctctaagacttttgaggctggatcataagaagcctttcagtttctacacacaacccaggggacacttgctgttggagccctgagctgacatagaagtccaactatcctgaggccaccgtcctgtaagatatgctgaagatatgctaagccagtgtataggggttgtagcccatagacttctgagccatcccagatgataacatgcaacagagatgaattgtccccactcatgtgagtctaaattgctgacctaaaaattcatgagatttaatgatgataatgatgatggtgatgatgatgatgaagatagtaataatgataaactgttgttttaaactggtgtggataactggaacacctgcaaaactgtaactcagagcttttgactctagtgcctgtgctcagtttcctccctgtaactgtcagctgcccatgtacctgtgatattgtattaaacttatgatttataggaattacaggaataaaacgaatgagttatatttctctcataagaaaacaaagctagaacgaatttaaaataactctgccatcatgcttcatttttcttcatatctcctaaccaaaatggcattatgttacgtatctattcgttcgtctgtcttctttctctcccaggatataaactctatgaggactttattttgctctttgcagctttaacagcacctatactagcatctggcatgattaggcactcacagtgtatttgttgaataaatgaatgaattaatgaaagatgattctcagagaaaataaagcataaatatcactgtatctgtttagagtattattcttctgggaaaatgtgaaaaccagaatattacaaaggtaataaagcaaacatttgataacctaaaaccccaatgtagcaaatgttaagatgatacatgttcacatcatagtttttgtcttaaagaaataaaatattagagttggaggttgaatttgtgtatatttttctatttccctcttcattgtcctaaagtcaacactgttatatatttgacttgtatattcttatgcttttactacatataattttatctacaaataatatatctacttggctctgccttcaaaatataatatatttccaatccattttcacctgcccttgctacttccctagtgcatccccgatcttttctcagaattactacatcttcctaaccgttctctgcttactctctcacagcatcagtgcaacactactccatcttttcttcacccagcagccagattgatccttcaaaaacaaacattggatcacgtatcctcccctctcctcactcttccatggtctccatcatacctgaaatacaacaccaatccttgccatgttcaaggccctgtttcatccaatgctgcagtgccagccctcctgttcctgccgtgctccaggcactcctggtgcactggcctctttgctgtttagagagcacaccgagcacatttcctcctctgggcctttgcgtttgctcgttctttcccttagcttatcctcccaccgtcttgtctcacgtgagttgcttacaacctgcatttgttttttgttcaaaagtcacctcccaatgaggatgggcagtaccaactgattaatagttgaactcccttcatgaacccataccaaggttttttttttctgcaaaacttactgctacctggtagaatttgcttatgtttgtatgtatgcatgcatgtaggatgcatttatctgttttctgtctattccctcgttagattataaactttgtaaggtcagggaccttctattattctattgttttggggcctagaacaataactgacataaagtaggtgcccccaaagtatgtgttgaatgaaaaaatatgggaatctagtgttttgcttttaaaactgtacataaagtttatcatactggatgcatcttgtggcaatttgcttttctcatgtcaaagtatgtccatattgagattgatctataactgcccaatgggttttccttgcctgctgcctagacagaactgatttatgaagacacgagaattgcaatggataaagagtaattcactcagagctggctgtgcgcgagaccggagttttattattgctcaaatcagtttccccatttggggatcagagtttttaaacataatttggtagataggggcttgggaagtggggagtgctgattggtcaggttggagattgaatcatagggggccaaagttaggttttcataatgtcttctgttcctgggtgtgatggcagaactgattgggccagattatcaatctgagtggtgtcagctgattcatccagttcagggtcagcaaaacatctcaagcagtgatcttaggttttacattagtgatgttacccccaggagcaatttggggaggttcggactcttggagccagaggctgcatgactcctaaattgtgatttcaaatcttgtcgctaatttgttagtcctgcaaaggcagattggaccccaggcaagaagtgggtctttttggaaaagggctgttatcaattttgtttcagagtcaaaccatgaactgaattccttcccaaacttagttccgtctatgcccaggaatgaataaggacagcttaagggttagaagcaaggtagagtcaattaggtctgatttctttcactgttataatgttctccgttacaattttgcaaaggcggattcagattgagctctttatctgtatatctaatctatctagtccagttattttaactgtggctcattatcccacacagtttattgatccatttcactattgctagattgtagttacttacagtttttcacttttctaagcaatgctgaaaggaacattcgtttaaagatagttaccttctttgttttttccttgtagatgtataacagaataagaatttggtttctttcacttaacaattacattcatgataatagtgattgcgtttaaattattttttgctttgatgattggtctaccagcaaatgttcccataaaaatctaaaagtcattttaggaggggaaacataatatcacattttttgaaagaacaagtttgatattatgtttatcctttaaatctcatacttttctgataaaataccctaattatgaatattttctcctaaaaaaaactagaaaataatgttacccatgattaaattatttgttctggtgttatatgcatgcatgtttgtgtgagcatgtatagcagtaagatcatttgaattactgtggccccagtggtaataggcaacactactcttccactaaatcatagagaaacctttcagagagttttgcattttgtttgtcaaagtttaagaaaaagctaattttgtgacagagttgtaagctttattaaactgaacagatgaggagaaagaaatgaaactattgaaaaactcattaagggttgtaattctagagtatagtatggacagtttccaaaagaatagtagcttttatgtgctctgaagaagcatactttatgggtgatgtcatgtgttttgactctgaagctatgaatgtcactaaaacagataagaaaaaaaattacttttccaggggtgataatttttccttgctcatagtcaaattattctgagagacaaagaagctgagttcactttacttaatttgtaatttgtaacagtttagacagaggttaatctaaactttacttctacatttatctgtgctaagaaaaattaaaaatttgctaatgttaaagttgaatggattcagaaaatacaatccattaattcagcaattctgtaattagtgcctactaggaatcagatgctattcctgatgctgggcatacaattatgaataaaatcattgaggtctctacttcctttgagcttactgttagtggaggatagagataataataaacgcgtttcaatgagagagcatcccatggtgagatgaccattgctatgaagcatataacacagggcggcatgactgaaggtgaatgggtaggggtggggaggaactgccttagctgtggtggccaggtgtcacctctaaggaagtaacagtcaagataagagctgaatgagggatcactgtgcagacatccggtgacagactctgcagtacaaggaacagcaaatgaacagtgctgattatgggaacatgtttgctgtgttggaggaagacaaaggtcagcgtggctgaggaagtgagggagggaatggttggtgaggttggcatgacaggaagggggccgtggagacttgataaggagtttcctaaagccgatttcgaagagctctccttggcagcaacaccttacttgccgaccttactgctcttgacagagtctctacttgaacatagaaaatgacagaattacctttgaatccgggcttgtcagtcattcagtcaggtcttctccctaatcaccctcaattgtgaggatctgcgatgctatgaaaggcacgtgcctgttccaataattaccagtacatctgtttaatcacttaaacatttaaagcctgagttattcatatgttcatgtgactttataagcacatcggggacttctgaatatgaatttatgtcccatgtaaagaaccagtacactctctctacatgatgggacggggtgaccatcaaactgtggaaagtgggtacgttttgacgtgaaataagagtgatactatttcactatagttttcctttactatctggtgttccagaacattccttcttcgccaccatagcatgtggccctatcaaagcccctctatcttctcaaggctcagcagtctcaggtatagtaaccattctttgtgtgacatatttcgtcacccttcagtgctctgatcactcactactttattggatgttgttggtcatacaaatatgaccaaaagtgatctaaccaatcaaaagtgggtcagatggatgaagagtaaagtagagctttatattctggatgctacatccattttcactatttaaggtcaccctagcttttttgaaatccacttcacattttttttcctttccaaggagaaatttaaaataatcatctcttttagtctaaaaacaaaaacagatactgtttataagcctttcttcataaaaaaaattagagctagtaattattgaaattgatagtagcaaaagccatagctaccatttcatgtctcctgtttatgtgccatacagtcacctagacccttgcatatgtcatttctggttggcatgaggcttctatcaagtatttattattattctcagtctacatataaaactggaattaagaagttatgtaatctcattcaaattttcacttctggtaattagcatatccaggtttcaaacaagatttgtttggctcaacagcccaaagttgtaatcacctcactctctagccccatttaaaatccaaatagccaccactgtactgtatcccaagagttttatgaatatgagctcaattactcctcaccacagcctaataaaaatgagtgttttgtgcctatgcaaaaaaaaaaaatgaagatgagaagttttcttcaggaccttacaatttcaagtgacagaaaacctaagttttaatggtttaatggttcatataaagtctaggggtgggcctggcttcagtcatgcctaagcctaaaggagataatctccctctcttcatctctttactgtatgtttctctctgtcagctaccttcacacatagccttccctgcagaagtagcagaatagcttccagcagctacaggctcacatcctctctggtcaccctagaagaccagccatgcctctctccctgtagttcctacagtttctggaattgagtgtcattttccttgattggcttgacctgaaatacatgctccccctggggcaggaagatcagctcaatgcaactcaaaccccaaaagaagagaagtggtacattgtaccttccccaaaaagaaaggggggtgactattggctgagcaaaacaaacaaacaaaaaaatctttctatgtgcctccagtgcaatagcagtaagtggcatagtcaggactcagatccagattcataaggctccaaaatactttctcttaccctttatgctgtcttttatctccatataattgtcttttaaaattcattgtgagactgtgaagctcctgtacttccgttaaaaaaattattaaggaagtgatgttcaaaagcatcagcatacttgtggttaatctcttttaaaatagcaagtctatcaatgtacaggtaaatactatttctagaagctagaaactctgaactttaggtaagaaaatataatgatttcgtgtctaatttcatagatatctttgcgttaagtaaaatgtccctcttcatatctccaaaataaaggatatttagcatagaatggaatttttcttaccttataagactgcactattttctgccttttacaccaatgcaactggtctttatcaacaactcacaatctttatttcattatctttgacctctgatttagaggacagtactctccccttgggagaaattaggaagcatataagcagaaagaaatcatgtaaacaatggaaagaggacactattaggaaccaagaaaccaggatcatgatcccaatttgacattggctccctgtgaataagggatggcaaatgggttctaactttctgagatgatctccaacaaccctcttatataatctctttaatggctgttttcatgctgaatgcaatagagtttttcatattagccaataaagcaaaactcattcactcagacaaaatgaattgagaatctatgacaaggtactgtggtagatacagtgaagctgcaagatgcctcctcctaggaatttgttgtcatcccctaaaatgcattgtctaatatgtgtatgacactgtgctagaagctgggactgtagagatgtaaagaaaactactgggggcttatacactagctggagagatgtaagcaaaaagaaagataaacacaacaaggcagcatatttgatgtgtgatgtgccatgtgaacaggacaaacacccactttagaaattcagcttctaatgaccagtgcagatctttagggactgttcacacgtacattgtaatatgtgtggatctctttgtgtccatgggtatcagcatagaggtaaatgtaggagatcaaggtagggacacaaggactagattgtcaaccaattatattcaaatccagagtcatctaaataaagaaagagattgggaagcccaccacaaaccagagaaatggttatatctacctatgttaaaatgcaaaacaggagtcactagtttgtattgacatatgctgtaaatgaaaaacacaccctgaatttcccagatttaatatgaaaaaaatgcaaaatatctcaatcatttctatactgactacatgttgaaatgatactattttggatatactgaactaaataaaacataattaaagttacttattttttaatgtggcttccagaacatttaaaattacatatatggcttatatgatatggctattggatggcactgggtttcctgctttggaactgtgcaaatcatttaactgctctgatattcatttttatcatctgtaaaatggggatgaaagtagtgctgttctcacagatttgttcttagtgttaaatcaaataatacttaataagtacttaccagtgcccagcttacagttaggattcaataaatgagagcagtatgttcatgatacagacataacatgttggtgcaggacgatatagcttgtccaataagtgtggaattagattagcactactccgcttcccataatttactagccttatgaccttgggccagttacttaacctctaagtacctcagcccccacctgcatatgaattgggtttattaagagatgcatccccattgctgttcttgggataattaaatgagataatccatgaaaggtgcttagaaccttcctggagcaaaatgatggaaaattatatttgtattgttgttactgcaattgttcatattcagaagatatttgcttctttaaaaattgtatttctatttgtgtttgttactgctatggaccgaatttctgcgtctctttaaaattcatgtgttgaaaccttaatcccaaatgaaatgacatttggagttgggggcctttgagaggcaataaggattagattagatcaagagagtaaagccccggtgatgggattaagtgcccttataaggagttgaagagaccagagctttctcgctaccatgtgaggacatagcaagaaggtatctctctggaaaccaggaagagagccctcgccaaaaacctgaccacactgttacactctgatcccagatttctagcctccagaactgtgagaaaaaaaaagtttgttttttaacacagccagtctatcgtagtttgttagagcagcccaaaataaaacagttgttttagtttaaaatttttaaaatttagttcaatttgtgtttttcctgatatttgctttcctttttttctgatattttgttttaaattcagaaattctaaaccactgtgtgttatgaattcccatgtagctaaaggcatgtgctggcttttaaaagtcactgcccaccccacctcaatcaccttcttatttgacatacaaacattgtggattttatcttgccctgctacctgctaggagatcgagcagagcatttgttttcttactactgaatccttaatacttagcaacatgccaccaagtattcaccaaagggttcaataaattcattgaatgaatgagaaacccgatataaatacttacttgaagaataataatgaaatcaagttttaatatagttctaattaggttctgcatttaaagctcttatgtgaataaaatccttgagaatttgtgaattttttaaatcattgactagattctggatagctgaagttaatggataagtgaggttttactgtggctgatattcggaggcatgaagaaaatttcactgaattgaccttttatttcatcttcaactaaatggaaaaaagtctgctccatattatagagagaactgagagtggtgctcctcagcggtgggactgcgttggtaattttcaaggtggacagcagttttagaaactctaggatgttatatagataattgtagtcttataatttattgatttattcccacacccacaccctaccccaaaaagctatggtctaataggctctgctttgaagaaaagagtgcaatattttctggacagttgtgctcagtgctgccatatggacgactgcacaatttgtcctcaatcctcatgtcacaggacaatcggctcaatctctaatgaaaatgtgatgttttttctatatatactgaaaagtactgctgatttcagtagtagagaaattatatggtatattattacatggtaaactatttggtatgtagttaaagaataaagaaaagatacttccattcctttctagttctgggtgatagaataatttccaactcatcaaaatttcattgttaaaccttactatagccctaggcatgcatctaaaacatatcaagccactgttgaatagattactagccacagtttccactctcattttttcttttcaggaaggcataggatttggtttgtaattattatatccttagatacagaaaattaaaaaataatatttaagagattattcagcagttgggatttttaagtaataatttagctttagtctttgaaaacatactgaaatataaaacatcaccaaattaaaattaaaataccagtatagcatgttaacctagatgataggagtgttttatcaccaatgtgtattcctaggttaaatgtataaaaataattggtacttccccattcgtaccatattcccagtattagtattagccattgcttaatttttaatagctgagcttggatttataaacttctgtttaaaattttcattgttttttaaaaagatagtatcatctgctaggatttttatggttttgtgttttacatttaagtctttaatccatcttgggttaatttttgtgtaaggtgaaggaaggggtccagtttcagttttctgcatatggctagccagttttcccagcactgttcactgaatagatcctttccccattgcttgtttttgtcaggtttgtcgaagatcagatggttgtagatgtatggtattattatttctgaggtctctgttcaggtccattggtctatatgtgtgttatggtaccagtaccatgctattttggttactgtagccttgtagtatagtttgaagtcaggtggcatgatgcctccagctttgctctttttgcttaggattttcttggctatatggggttctttgattccatgtgaaatttaaaatagttttttctaattctgtgaagaacgtcaatggtagtttgatgggaatagtattgaatctctaaattactttgggcagtatggccattttcacgacattgatttttcctatccatgaggatggagtgtttttccatttgtttgtgtcctctcttacttccttgagaactggtttgtagttctccttgaagaggtccttcacatcccttgctagctgtattcctaggtattttattctctttgcagtgattgtgaatgggagttcattcatgatttggctctctgcctgccaattgttggtgtaaaggaatgcttgtgattttcacacattgattttgtatcctgagactttgctgaagttgcttatcagttcaagaagtctttggggtgagatgatggggttttcaaaatataaagacatgtcgtctgcaaacagtaacaacttgacttcctctcttcctatttgaatagcctttatttctttctcttgcctgattgccctggccaaaacttccaatactatgttgaataggagtggtgagagagggcatccctgtgtactggttttcaaagggaatgcttccagctgttgcccattcaatatgatattggctgtgtgtttgtcatcagtagctcttattattttgagatatgtgccataaatacctagtttcttgagagtttttaccatgaagtggtgttgaattttatcgaagcctttttctgcatctattgagataatcatgtgattttgtctttggttctgtttatgtgatggattacgtttattgatttgcatatgttgaaccagccttgcatcctagggatgaagccaagacttgatcatggtgggtaagttttttgatgtgctgctggattcagtttgccagtattttattgataattttcgcatcgatattcatcagggataatggcctgaagttttctttttttcttgtgtctcttcccggttttggtgtcaggacggtactggcttcatgaaatgagttaggggagagtccctccttttcgattgtttggaatagtttcagaaggaatggtaccagctcctctttgtacctctgatagaattcagctgtgaatccgtctggtcctgggcttttttttcgttggtaggctattaattactacctcaatttcatagcttattactgatctattcagggattcgacttcttcctggtttagtcttgatagggtgtatgcgtccaggaatttatccatttcttctagattttctagtttatttgcatagaagtgtttatagtattctctgatggtaatttgtatttctgtggggtcagtggtgatatccccgttatcattttttattgtgtctatttgattcttctcatcttccctcttagtctagctatcggtctatctattttgttaattttttcaaagaaacacctcctgcattaagattttttggagggtttttcatgtctctatcttcttcttttctgatcttagttatttcttgtcttctgctagcttttggattagtttgcttttgcctctctagctcttttatttgtgactttagggtgttgatctgagatcattttagctttctgatgtgggcatttggtgctataaatctccctcttaacagtgctttatctgtgtcccagagattctggtacgttgtatctttgttctcattggtttcaaagaacttcatttctgccttaatttcgttatttacttaggagtcattcaggaacacgttgttcaatttccatgaaattttgtggttttgagtgagtttcttaatcctgagttctaatttcatggcactgttgtactgagagactgtttattataatttcaggtttttttttgcattttgctgaggatcattttacttccaactataaggttgattttagaataagtgccatgtggtgctgagaacaatgtatactctgttgatttggggtagagagttctgtagatgtctactaagtctacttgatccagagctgaattcaagttctgaatatccttgttaattttctgtctcgttgatctgactgatactgacagtggggcattaaagactcctactattattgtgtgggagtctaagtctctttataggtctctaagaacttgttttataaatctgggtgttcctgtactgggtgcatataatttagtataattagcttttcttgttgaattgttccctttaccatgttataatgcccttctttgtcttttttgatctttgttggtttaaagtctgttttataagagactaggattgcaacccctgcttatttctttgctttccaaggcaattccattcaggacataggcatgggcaaagacttcatgacaaaaatgccaaaagcaattgcaacaaaagccaaaattgacaaatggggtctcattaagctaaagagcttctgctcagcaaaagaaactatcatcagagttcacaggcaacctacagaatgggagaaaatttttgaaatctagccatctgacaaaggtctgatatccaaaatttaaaaggaacttaaacatatttacaagaaaaaaacaaacaactccatcaaaactggataaagaatatgaacagacacactcaaaagaagacatttacatggtcaacaaacgtatgaaaaaaagctcaatatgactgatcatcagagaaatgcaaatcaaaaccacgatgagataccatctcatgccagtcagaattgattattaaaaatctagaaacaatagattctaatgaggctgtggagaaataggaatgcttttacactgttggtgagaatgtaaattagttcaaccattgtggaagacagtatggcaattcctcaaggatctagaaccagaaataacatttgttccagcaatcccattactgggtatatacccaaaggaatataaatcattcttctataaagattcatgcacacatgtttattgcagcactatttacaatatcaaagacatggaaccaacccaaatgtccatcaatgatagactggataaagaaaatgtggtacatatacaccatggaatactatgcagccatgaaaaggaatgagatcatgtcctttgcagggacatggatgaagctggaagccatcatcctcagcaaactaacacaggaacagcgaaccaaacaccgcatgttctcattcataagtgggagttaaacaatgagaacacaaggacacagggagggtaacaacacccaccagggattgttgggggtggggggtgaggggcaggaacttagaggacggatcaataggtgcagcaaaccaccatggcacacgtatacctatgtaacaaacctgcacgttctgcacatgtatcccattttttaaagaagatatattaaaaaggatagtatcatctgaaaaatttagttacaaaattcttgtagaaaatgtatatgtacacacacacataccccccatatatatatacaccacacagatattagcattatgataatttaatataaatcacagtatttaagaacaaatatgaatagtttagatatgaccctgggcaataggcattaggaattcaaggagagttcttcttctagtgtttctaaatcctttgtctaatgagtctaccaacagagccatttatttacagggaattaaatggaaactgctaaagcactcctgataatctccacctgctgtcctattattaaagagccttggagtacagtgaagtagacaaacacactcatcttacgtattttatttctagtataacctcatggactagtgatacgtttgcagtcatttaagaggctttatgtagcatgaaataccaaagaagagtgaaatctgaatcattataaaacaaaccacaatacagaggtgaaaagtaccatgagtcttagcagctttattgtaagagtccattcaaacattagcattttcacagtgccaggtgaatccatctgcaggatactgaagtatactgtctggtgcctgcagtttgagaactgctcattattaactgggtcatgattcaggacagcaccccagatgcaccacttccagcttgtgctaaaagacgactagcctcattaccatgcctgtctcctatgcacgctctcacttacttaccaagtcatcatttttaccatcatttccaaccatgtccatcatctgttgcctattttagaccttatttactttttaagtatactctagatgtccacttaatcagattctatgtgaatgtaaatgttaggggcagaaatgaaaggacattcatactaattaattcgcagcttagcactattcgtactgcgaggctttagaaagaatttctaggcatggcaaatcatatcttcctactcctcttcaagtgcaagaaaaatgcagctcctcctggagaacagtggcaaaaatgaaatgtttgtggagccaggctatgtcctttcttaaaaacaagttgactttaatttcgcctgggttggacatgctgattaacagaaacagtaacaagaccagggccttacaatgtttttcagaccctactatctgcagagggaagcaagaagaaccctttcttactaggctatcaaatagagattggctttgtgaaagttttcttttccagtccaggcagatgaatgagagtgaaaaatatgagggtgatgagaagtggtttgtctccccaaccctgataccctctagaaatctgcaaggtggacacttgtgttcaaatgtggttcattaacaaataaacttgtagtctaagaacattgctgtaactcacttctacttttctttacaagttaaggtgtggaaataccctggggctatcctgtttcattacttctctgaatccacagggaacttctccacttagaaatcaaatttttgaggccgggtgccgtggctcacgcctgtaatcccagcactttgggaggctgaggcgagcagatcacaaggtcaggagtccgagaccagcctgaccaacatggtgaaaccctttctctactaaaaatgcaaaaattagccaggcgtggtggtgtgtgcctataatcccaacttctcaggaggctgaggcaagaaaattgcttgaacctgggaggcggaggttgcagcaagctgagatagcatcactgcactccaggctgggcaacagagcaagactccatctcaaaaaaaaaaaaactaaaaaatcaaatttttggccagccacagtgactcatgcctgctattacagctctttggaaggttgaggtgggaggattgcttagggccaggagttcaagaccagcctgggcaacatagcaggacttcatctttactgaaaaatacaaaaagtagccaggcatggtggtatgtgtctgtactctcagctactctggaggctgaaacaggaagatcacttgagaggctgagtctgcagtgagccaagatggtgccactgaactccaatcttggcaacagagcaaggccttgtctcaaaaaccaaaccaaaacagaaaaaacaaagaaaggaaactgaatttttgtgatgacctctggtggaagaaaacttaataagcttttatcccaccttcaacatattccttaaaagacacatagttcattctttctggtagttctatttgttataatgttgtgtaatttatagctgaagaccatgtttacaaattttgtgtatcatcatacatatctcttatttctaaaataaattaaaagtcaaacgttactttgagggcatctcaaatttttgaggctaatcagtttggtaacttttggtaactgaggctaatctctattagaatgcttcacaagaaatcattaatctactttatctgatttttcttttaatataaagggaaaatggtctgatgatataaaaagatctgaaagcaatgtatgaaggggagggaagtatggtaaagtgctgaagaagtcagtgtctgggttcttacaggacaaaattcaaatctcatctctgccacttactagttatgtaaccgtgggcaagttcctcaaccttggtaattttctattgtttattctgatcgatggaaatacgaatagcacctcccttagagtccactgtgagattaacgaagtcatgcatttaaatcacttaccataatgcctagcacattgtaagaacacaatgaattacagtgatagcaatgtcaatatcaatatacttgtgttccttggttaaaagtctgataatgggcactatctctaaatcgcttctgtgttttccttgtagcatacaaagaaaaatacacttccagaagatctttctcacatacatatctgaagagtcatcgtatttaataacctccttcgttgtacacaccgaacggcatattctttgggtgataacagcttgctgtgtgggatttgggtctctttttgccttagatgttggtctgatactagccccaccccccaacagccgggctcctggcggaggtagtgggtggagctaacgagacatctagtacggggctcacaggtaacagaactctgatcagatccgccccggctcccacacagctataaggttgcctgcctgcctgcacagaaatgacgaaggacaaaaacagcccagggtaggtgggatctatcagcctccatctgttgttacttcctgtgttatgaagaaaacgtttcctagttccattataaaatagctctctgatttctgtgcaagtgagaaatcaaatctttgtgtttatgggaccaaacagatggatttctgttgccatttggttcctggcgaagtgggaccgtgaacaaggcagactgccgaaaacataggtactaaagaaagggaaaacccttctgatatgtttgctgtgcagtattcattgcatacgatccctttcaaagtcatagttcttcgtatttttaaatgctgtttttcctaatttcagctcggcaccacctatcgtttatgaacacagttttattgtttggtgtaagcggttttaaatggcttagagagataatcataatttgtattctcaattaaaatatattaagcacatatatttcagtatgttgtattcagcttaaatatattatttaaaataatctaaaattacttgaaaaaaacaaaatcatgaaaaatgttgtctatattattctgtgaataatagtttcaaccacttaatattttaaactaataatagcataggtctagcaacaaaaaataattattggaaattcttactttcagttgttaccggcatagacctcattacaggaataggcctcattgcccttggtagatgaccaggtgctcttttagaaaatcagttaaaacaaaagtgcagaaatctaccacccccagaagcaaactacctttactcatgaattctcattattcctgactgtaagaatgcattttctttttcgttatttctgtcaggtatagataacatcattgatgttgttaacatcatttaaatttcaagattatattatgctcttatataattaaagctattttgttctctggtataaagtttataggtgggcaggtaagaaaaacacaatttttgaaagttgagtacttaaccagattacttaattagcaccctcttctgcctggcttgacatttatagttaatcatgaatttgcatcttggaagccagaaaacaacaattatctggaaacttaatttaaaaaatataaattttgcctgacttatattttaggggttgaaattgccttgttaagaattaacctccctcagctgatgttacccctctgatcacttttgactcttcgtttaattataagtaaataacttgcagtgcttcttgcctcccttccatcaatatttaaacaaggaaaagcattcatagctgtgagccaaatgcagctagctacatagaatatggtttagtcacagaaccaatagaattaccagaaacctcagcaagttattcctttagaagtagtcccagatacaacaccacttctactcaaagccaaagttattgttgaatgtaggctacacactgttctgtatgctttgcctgtgttaacggcatcatcacaaccactcctgcaaagtttgtattgttataattcccattgtaactgatagcatactgagataagaaaagagtaagcaaattatccagctccacgcagctagtaaatgatgatggtagagtccacagaagcttggtaatagatttcttaaaaattaaaataaatccaatcccaaattacttgtttaaaattccttttacatttccttcattagatattcaaattacaaaatatgtacatattgatacaaataaaagaaaaatcttaatgatgccacattaagaggatttcttttacttttttgtcttttaatttttttttgctgtcccttggagtcagtaggggccacatcccctttctaatcctactctctgggcatggagagcactttcacatttttcttcatgcttgccacatgtatgctgtctcacaggcatgcacacttttaaacaaaaataacaatataaacattactctgaaacttgatatttcatgaagtcatatatcatagtgcttactccaggccagtaaagttgtagttgagctttgcattgatgcataatatttcatgtgatgaatgaatcataatttattcatgcaatgatggatgttcagataagagaatgatcaattccttgagtgttttaaatagacacctgacagaaagagtgaaatgagctaggtgcttttaccaaagctaaggtctgcttatgaagacgttcctcataacgctgcaatttcttagtgattaagtgatcaaaattatgtctggatgcctcccaagtacacatttcttaaattactccatatcacctgaaagaatgtggtgaatcttttcatgtttgtccgtgtgctattttcagtttagattctttgtagcaaagtggaaggaattgggtacatttaatattaaatttttgttgttggaaagggaaaaaaacactaaattattgcagttctaaattatggtttgaaaaggaaaagcaaaagctatcaaaatacgaagcaggaaaagagaggcagctctgaaatcaacacattgcctaggacattctccctaagagtctgctcttcttggctgatgcagcagcagtgcactgtacacaacaaactgccagtcccaaactccttgtagtgccaactagcattccaagtaaaacagagcagaccttttaaagccacctaagtatctcttgagcataggagtatgattccttaaatgctcttatactttcattttacagagctctgaaagagggtgctttttttttttttaagttttagttttaaggcaaagcaaagctttggcaccgattgataatttgcctgtgcacctcagaaaagtaattcctttcttaagaacaaacagcttatctagtcattcccctaacttttcttgcttctagaactgaagcaaatttgctaattttgtagtattctgtaaagcagcaaactgtgatattcagtgaagttctcactgcaaattgggaaccgagaaaggatataacacatcctttgcactcctatagaacctatcaaggctaaagatgttgagcctgactctcttaacagctccagtgtctgaaataaatattctaatgtctaaatgaaattgtgctcattccctcagggtttagtgtaaaacaatatgctcttgaggtgaggacaagaaggccgtcacctgagcatgtgagttttcatgttgatactctgaacattccattctagactacctggaatcaaggaccacatctgagtgtgttatacttgcaaacagtttggcttattatcattgcaattggaaatcttacaagcatatatactggctctaatatatattttatttatacagatgaattatgcccatttaaaaacaaaaaagttatctgtagaatacattatagttttcattcttatacatggatcagaatagagttaagaatgtgttcttttagctttgccattttaagcaattttgtatatacataatcattcacttggaagccagttcagtttcaatttatataatgattgtttttaatttagaataacaggaaattttcttttttctttcaaatattagttttgataatgttgaagtatgctggttgaaaactttatgattttgaaatagcgcagagacaggcattacgttgcttgatatagtataagattttgattgttttctagaacatcgtctctgttgagattagcaatagaagttttaagtattctgcatatatttccaatttggttcaacatacatttctttagcttttattttttgcatgtcccttgactttttttaaaataagaatattcaaaaatgaataaaacatgattcctgctctccagaattttacaggttagtgggtgagactgagagttacatgcttaaaaacaaatgtgtgtaacagcaggaacgctgctactgctcaaacagtaggaagttaaaaacacgagaacgtgagatgatttggggagcgggagcatatttgactaaatgtccactgtgtgctcagtttggggtcccagaggctagccgacatattgtatgcaggacacatggaacatagtctagctcctaactccatctgcatttggtttctgtctggtaagctcatgtgtaattacagactcaggacaaagaggtggttaattcttcaatggtaaattaaatatgatacaagatggaaaccgaactccacaaatatccagaagagaagcatgatattagctgaaatttttattccattgcattttcttaaatctgtgaaatccatgtaagtctgaacttaaagacagcactatcttttaatttagcctataaaaatttcagcaaaccaaaatgtttgttaaaataaccattaaccacatatatatccaaatattcattatatatataaaatttctttaaaatatcatgctcagaaatagagtaagttttaattaacaggaaaattgtttcatatcttgttatctttaccaaaaattaaaaatcaccaccaacaacattctgtatctatggataccttttctttctgttacgtcaaagtgcatcatggaattattctgaaaatagggccacctgctctatttgatattggacttttaaagaaacaaaagtttaacttggtcaccaatttactgttcctggaattgtactttatgagaacatttcaaattaattgcatccttaaactggggtcacatttgaaatcttgtcctttgctttttgttgtttgttttgaaacttgttgaaaattcttcccaggattctttctatgtggaatccaatttacagtacattttaagggcctttttaaaaaacataaaatgaaacataggcaatcctttagtggatctgtcctgttttaggactaaattgatatcttttaatagatgtaaggccttttggattatctgccccgaacttctcccactattgataggcatcttgtactaagccatagccatatattgaaaattgccccaaatgtgctctgctctttctcacctctttgtttttgcacaagcttacctctgcccaggatgccctttcttgcatcgtagaagaatgtacaatgacttccttgtactacttcctcaagtgcctggtcagatgtgactgccccttggagatcttttccatctccagtggtgctgtgcacttcgagctcacccagttggctttactgcacataatcacattggtgtcatcacatcacccatggatctctctctccctcacctgggaagactcttctttgtattccctgggcttagcatggtgccttgccctaagtgttgggctaaccaaaggtaaagtacatggaccactttgaaaatgaaaaatatgtttgatgatagaatagctctcaaatgctttagtatatttccatcaatgtgaaggcagttgaaattgtctgctggatttctttgatcatgaactatgagcagtaggaatcatgttgattaaattctcttttttctttctctgcctgtgaccatgccttaattcaggcactcattatctctcacacaaactatttcaagacttttctaactattcctcctaccaccagttccttttcctgccttctctcctatatgccactgctagagctaacttccctcaaaatgtttctgattgcatcactcctattcttaaactctcatggtggcatccaattataatacatagtccaggcctttcagccataattcaggacctgagcctgtaagcactgtaagatgtgagacattgtcatgttttcctcactgttatccccccagcatatagcatagtacttggcatagcctaggtgcacaatgcacatgggctgagtagcccatttcatcaaatctaagatggtgtgatcagaaaacacaccattattttacacactgctaagaaaaaaacctgccaattaaactaaggcacaaagcattcttattctttgaatttttattttattcttattgaaaaaccatttttatacttcaggaaaaaagattttattatatgtcactctaatgcataaataaaagggaaacataagaaaaatacattggttaaagtaattattacaactttacattttaagtttgacctttatgaatctctttctacctgcaaatcattgagatttgtgtttttccacacagtattctccatttcatcaggagtattagagttgaagcatttcttaaaagagtgattttaggcaagtgggttgcctgacctcaggagtttgagaccagcctgggcaacatggtgaaatcctgtctctactaaaatacaaaaaattagccaggcgtggtgacatgcacctgtagtcccagctactcgggaggctgaggcaggagaattgcttgaagctgggaaggggaagttgcagtgagccaagatggcgccactgcactccagcctgggagacagagtgagactctgtctcaaaaaaaaaaaaaagaaaaattatatatgtatatatataaaatttaaaaagtaattttatttcaagttgctgacacctactttgcaagttttgatgtccatgtataggtagtgacaacatcaaaactgctaccaacccaacagcatcttcatttcagaggtgttaaaatgttaaaaaataataataactaaagtccgtctcagaattgatgatattaattgtcttattcgtggaatcaatatatggtatttttagtctgtccccaacatactcttccagtttcctcttcccactactcaatccctcacacttttactccagactatgagattttgtgaactggggcagatgcttttttgactctgtgttgttgcattcattccaatgtaattgccatcttcaagcctttcttacttccccagatggacggggtctcttccgccttgccaccctctgagcattttgtgtatacttatttgaatacttctgacaatttttagtatgcatgttgaaagataagaactaacactatagtacttttgtctgtacccttgctgcttgcacacagctattatttgataaaacttgattaaatatggtttgatatatttccttccttttatttgcttatggagtggtttagagttccagagttgtccagggaggacttctgttactattgcttttatatgacttggtgcccttggtcaagcatcatttaacaaaggatttgttattttgagttagtcagaatatttaagttttgtgttggccaaggcccatgtcttacaaaataaacaaataaaaagctcactaacccaatatttttgtgcatttcatcaggattgaacaatctatttgataaatgacaatttatatcttcacaatttttacactaaaatcatcccagagaccggaacctaaataagacaactaaaagcaattatagaactttcaggagcaagtgtaaagtctcagttgaaatactgtctattgataaaaacattagccaaggtcaaatgcatgtcctttaaaactgtcttctcatttcattactgagtgttaaaattaagagtctgtgtctgaattcctgatgttagtcatgagtcattctatttatagatgttaatgtaattctcaaagagttgccaacaaaggaacaggtgatgaccccctagagcagtgttactgaaaatattgtcagtccaatcagtcacctggcatactgggcagaaatgcagttacctggggtcagagtcatacctttggactcttttgactcccaggattctgagtaattcttaaagaaaaggaagtttgaaagtttgtatttttagattatgatccattgaatctgataccatgaaagatatatttagtgttttcccaatagacctagattaatacccaaattccaatagagctcttgcttctggactgtacaattcaatgctgtttagtcacataattcaaaaactttaaaaaatattttctataacatttttataactagtttttcactattaaattctgtaaacttaatgacatttcacttcaatctatacaggaagttaataacttttcctttgaatagatagaagaaagaaataaaaagagatcattttgtattgtatgctttccagcggaaatgatctatgatatagaattaaataaaaaactttttaaaacaattctgagtcactgcaagcactcagagagatgtgagtcaccataggtcacccagaggatgaagatatagctgggaacagaacgaagatactgtctttctgtcccttacccacttgcctgcttcctccaacaattcaaattcattcattgagtcatatgaccgtctcatagtgttgttgtttcctgaatagctttttattaaggattttctgggcttctagtatactccgcagaagcagaattaacattatttatcttaaaaaagcattggattatttacgaaataaaaacaaaacttgaaaaaatgatcaaataatggattttgatacatctagcaccattgccttgttttatttttattgataaaataagtatgttggaagttatttaatgccatcaatgtaatttgaagaagaaacaaatggaatctatcttgatgagcaactattgtgggttttttttctccacaccatgatttcacctacatgttttctttgcagcttgcataatctatagaatatccatccatgataacataacaatacattggcagctatttgattaccttttgagcgttgttaatccctctgcccagctcttctttgaactggtcatgaaatgaaacattaagtcccatgtcaaccaaaggaatgatagatggatggagactcaggaatccaggagaccaaataaagaaacatgtgtgtgcatgtgtttgtgtgtgttgtatgtgtgtgtgttctttctgaaaattccagttgcatttattatttgcattgtacataataacacatcatcaaattgacctttaattaagtggctaagccatctgagtggcattattgtttagacagttctcatcaaaatttttagtagttctccatttcttgagctagaatttattagttgaatgcctacttatctattaaagacatttgataaatacctccaatgtgccagtcagtgtgccaatcactgtgctaggtactgggattcactggtgtgcacaataattactttggattaggtcaccttttattaaaagattaatgctgttgtcccagaagtgggttagttagttgtcttgggataggtttctgataaaaagatgattttggtccctttccctgtgctctctaatgttttctttacattctaccttctgtcatgggatgatgcagcaggaaggtcctcacaagttgctggcaccttgatattggactttctagtctccagaactttgagaaataaatgtatttcctctttaaattacccagactgtgttattctcttatagcagcaaaagccagactaagacagaaaattggtaccaagaggtggggctgtgccatcataactacctgaaaatgtggaggcacctttggaactgtgtgacaaatagaggctggaagaattcagaggagcaggctagaaaaggctagattactgtaaatggagcattaaggacaattctgatgaaggcatagaagacaggagctatagggaaacctaaatcttcttagggattatttaagtggttggtctcagaatgttggtagaaatatagacagtaaatgccattctgatgagctcccaattagaaatgtagaataaggtattgggaactgaaggaaaggccatccttcttacaaaatggcaaagaagttggctgaattgtgtccgtgcctgaggactatatggaagacagaattgaagagcaataaactaggatatctggtggaagaaaatttttaagtaaaattttgacagagctgtgtagctgcttttaactagttatagtaaaatgcgagtggagagaaatgatttaaagactgagtttatagctaaaaaataagaacagaaaaatttggaaaactctcagcctggctgcataaagaataaaaaagcatgttcaggagagaattctaagggtctgaccaagcaactgatcactaaagagattaatatggatagaaggaagccaagttctatttatcaagataatgagtgaatgaccccaaaggcatttcaaagatttttgaggcaagctaggaacttgagggccagatttccagagaggttcccttaaaagctcaatatttgctgcccaggtctgccatgggactctgctccctgcattctggtgcagtgctctttggctgccccaactgtggctcagttgggcctagatgtggctcaacctgctgctctggaaggtacaagctgtaaaccctggtgggtgtccacatggtgctaattctacagacatgcagattacaagagctgtggaagtttggctccctccaccaagatttcaaggactgttgtggatagcctagtggcccaggaagagatttctcacaggagtagagttactgcagagagcccccattaaagcaatacctagtggagccatgagagtggggccacttccaagatctcagaactgtagagctaccagcttgcagcatcagcctgggagaactggaggcatgagactctaacctaggagagctgctgggtggactgagcccagcagtcccacaggggtgggactgcctgaggccttaggagcccaatgcctgcctcagtatgcccaggttaattctggaactatgaggcaatgttgttttccctattaggttttggacttacttgggactagttagccctttcttcttgcttagtcctcccttttaaaatgagaatgtatacccaatacctgtcctaccattgttttttggaagcatgtaatttgcagacttcataggctcattgctagagagaaatttatctaaggatgaattatgccttgagtctcagccatatctgatttagatgagactctggactttgggcttttgagttgatgctggaatgagttaagacttttgggactgctgggatggaatgaatgtattttgcactgttagaaggacataaatttggtgagcctggagtagaattctgtggtgtgaacatagcccccaaagttcatgtgttggaaacttaatccccagtgcaacagtgttgggagatagggcctagtaagaggtggttatatcacctcttattaaagaattaatgctgttattggggagtgggctagttattgcgttattgggtgcctgatgaaagggtaagtttggcccccttccctgccctctcttatgttttcttccccttctgccttctgccgtggtatgacacagcaagaaggccctcataagatgctggcactgtgattattggacttcccagcctccagaactgtgaggaataaatttatttttttattaaatatccagtctgtatttttccattatagcaatacaaagcagacaaagacaagcgcattacctatacataaagccagcatactcttatctgaaaaaaaaaataattacttccttctaactatctagcttctagcacaggttaggaaaaatcttctttattcctgtccccatctacaataagctaaccattatctgttctatgcaggagctcttcattagaaggaaggcagtcctaaatcttgaaaagcccaggacatagcatatctgttgttccttttgcttaatatgtctgtcatgatatagcctcatttataaatttcttgtgtttcctattgcatcagctgccacactgtgtacttattcactaatttcgtaaaagacactccttatactaaaggctgtcagaaagatgatacatggttaactctcatttttcatcaggtgccacaagccagcacatgttacaatcaagggaagatggagcatccatacgtttctcttcctctggctatagagttgactgttgactgtcaactcctcacagtcacttattcattaattcatttacttgttttaaaataaaatgttttttgagtgcctgctttgtggaagcactgtgctaggtacaagagatgcaatagttgacaaggcagggatggtcctagccttaggaatttcagtttgtcacttgctactcacgttaaatttacttttaacaccattgctctcaatcactgacttctaagttgacagttacccaaagaatagatcactgagaatctctttacacctagaaatatctgtaaagacttacattacaccatcggagtctgccctatcctttaaaagctgcctttgtcagtttccatgcacaggattaagtgccttcatctttttatatatgagaaacatgactcgcaatcttatattctgcttccaattatctgaggactgcacagaagacaatgatgtggattctaatgagacacaaagacctgtgttctacttcctactattccattgcttggtactttgaaagtatttgcaccaagtaaagtgatgccttggtttcagaagcagctctaatggtggctaggggcttaaaagtctctaaaagtggctgtgcctcatgcctgggcaaaaccaggttcactgctggtgaaacaatttgtagaatattgtcattttataaaagtaagttaataagcattcatctgatggtatgtttcaaaaattctgggcatgttctccttaacatgtctcgttaaggaaaagactttctgtaaggcaaaatcgttccctgtactgagaatgtactagccatgtacactggtctaagacagatgactgatggatgagccaaaatcatagactaatatgaaaaggatgttttacagctatttatatacatatgtaattacgtataattggatgatatatttctatattagaagttatatataaagtgcaagtaagttaatgggcacgtgtatattaaattaaaatctatattagttatatattttatatttatatatttaagacatgaagagctgaacaagcagatgtttagcctgaaggaaagaacactagggggacataatagcaaagcacgtgtatttgtgaatctgtttattcaagagcagttagatttgtcctgtatggcctcaaaagcaaattagggctagtggtttgagattacgggaatggattttagctcactatgaagaaaaattttctcaaattcagatctggctagagtaagagtagtctcccctgggagacggtgagttctctttccttagatgtacttaaatataaaataattctagagagaaattcaccaggttcagtggctcatgcctataatcccagcactttaggaggctgaggtaggtggatcacttgaggtcaggagttcgagaccagcctggccaacatggtgaaaccccatctctacaaaaatacaaaaattagccaggcatggtggcgtgtacctgtaatcccagctactcaggaggcaggagaatcacttgaacccaggaggtgaaggttacagtgagcagagatcacgccactgcattccagcctgggcaatagagtgagactgtctcaaaaataaaaacaaataaataaaggaattttggagaggaatcaagcattgggaatgcagtttaaatacatggcctttaaaactattttaagcctggaaatacaggattcctgctgattctcagtttctttatttgtaaattgacaataatattacctgtcttgtcacctgcagattgttttgcagatcggaacagataatatgcgcagtgtcacaaaaatataaggaatgagtgtttctattgcaccaaaggaaattactcattaatgagtgtgaatcagatgtgactaataccacaggttattcattatcatctataagaaacattcaaattaaaacacctaaagatgcaacatgaacttgcatttttgaaactatgtttagagaaaaggatcctgactcactttaaagggacttggattactagtgaatttatttccattttgtgtttaattttagtcatttgtattaatgtcttctttttctaatatgtttaagatgatgggtgaccttacagactggtttttgttggtttattggtctgttggtctgttttgtatgtcttacattaaagaaattatggaaaaggataataatctgtcccagaaaatcctacctctgcaaataatatggcagaattaaaaccatttagagaacttaagttagatttcccagatttatgtattcacattcctataatagtttttattaaactttaaaagttacaaggtttacctgattgttatgcttcaggcagcgcacagatgtatacatgagatattatgttgttcctcttaattgctctttctgcattgaatatgttagtttgttttttcacctctgtttaaatcattacccattcatatactctacaattcctgggtgaactttgggaaaacactttgcttctctgaatgaatagcaaatgcaacacaagaccttggataagctatttaaaagtcaaataagagcctctgaagaatgaatcagtcagcagaaacattatcatggtgaaaacatttcctacttttctcagcatcatcatttattttgttttcctaaaactaattaatatattcaaaagtcaacaaaattttacttattaataatgtgcaataaacagaaacatttgccagaaagcactgcatcaggagttagaagacttggttctgatagttgctaattttgtgaccttgggagatgcattcacttccctgaaccacattttttctcatgtgttcaagagaacaaataatgatcaacccaccatatcttgaggaaggatcagtggggacaatatagataagtacacttaaattatttctgtagttcagtaatagtaagtgaaaccacctacattctttccaataataataatacctaacatttttataattctttattacacctcattgtttattatttccattttataggtgagagatctgaggttcagagggtttaaaatgatctatcaataccagtaaatggttgacccataagtcacctccactcttttgagtgaatacctgtttccctaagcccatattttatacactttggagaaacagaacagcaagccaaggagaacacagaaaaaattatggggagagaggctggttgtcagccttaataaagctcgatgctctccttacttaaatgactgtttcatgtgaccttcaactacaatagtattctaagtggagttaggaagagatttaatgggaggggggtttattgaatccattttcaatgtaatgcataaacatttagtttttctctgttaagtcaggtatcaatcgaaggcagtatttctcaacatgttaataattgtgcatgcctctcaaataagaagagttcttagacatgtttttcataatctccccttaataaaatgttaataacacaaatatacttcatgtctgtttatgttctttggccctttggagttccagaatcattatgctaagattttttcaccccaagacctaattttgtatgatgagaatacatgatggaaggctgagcaatgtatctctgcttagagaagtggcatagatgttgggagcacagcgaggctgtatcagtctgtcttgattcaaatcctagtttagccacttacctgctgtgtaaccttgctaaattacatatctgatctttgtctaaacgagcctatccgtgaagtagggattgtaagagcagcagcatcatattgttactcatataaagtgcttaggacaacactggcatttaggaagagctcaataaatgcttttttgctatattatggaatcctgatttagaaataggaaaacctgagctctaagcctgacttatctgtgtagcacagagtcaattattgctcagagcctcagtttcttcatagatacataactgatttcactcaaaactacagatcgttccaattgcagaatgtagttatagggtctcatctatttatctctacggttaagtgaacttacctatttttttctgttacttatttattaattttattttagcctacgaatttctaaaaatctctgattatattctcatagttttgtcttattgtagcctagtgacctgaacccagaatcttcatagaaaggtactgtattccacaaatatttcctttggaataataatagcagttaatgctttaaaaacattttcaagcccaatattgcactaatcctcaaaacatcttgtgatggagatatttttattcttattttgtgatgagaaaactgataccatagttaatggagtgaagtcaagctatgaggaaggaaatccaagttgtctattcctagaccgaaaatattaattaattagatatgtgcatctgtgagaagaggcttattgcccccgtgacaattttttggcattaaaaaatgcaaaaattgaaacaaagacataaagaagaaactattcatttcctgacttctattatggtatttttttttctcttcctccttgagtgcaggagctttcgacgtgacaaatgtcagcctatcgcagctatccttaggagatatccccaggttgcttggcactagtgcagtagaagtagcagtgagacagactcttggcagtcagtccatctgccttttctgttattgacttcatagttgttgagtggcaggtcttacttatcctgtagctggaagaaatattttttaaaaaacattcatttatttgatgagtatttattgagcacgaagcatatctcgggcttcattacgcaataaccatggactgtcatctcttatctgttccttgttctgtatcactgaggatgggcctcttctctgctgtcactacatttatactcattcattcattcaatgagcatttattgagtagttactatatgctaggtactagggataaagtagtaaggaaaacagtttgatcaaagttcctgccctcattccaggaggaaaggggagataagcaaggtaccttaatatatagagtatgttaaataattttcagtattaaggagaaaaataaaaaatggaagggggatgtaaaatgttgggtggggtgacattttaaatgattggccatggaaagcctcaatgtgaaggtgatttgggatcgatactggaaggaagtgagggagttagctgtggatgtctgcgagatgagcattcccagtggaaggaaagtaggtacaaaggcctgaagtgggggcatgcctgatgtgcttgaaggacaatgtgattaaagtggtgttatcaaggtggcaggaggggtggaggagtaataggagttgagttcagagaggcaataagaggtcaaaccatgtacagccttgtagttcattgcagagactttcgctttaacactgattgatatgggaagccactagaggtactgaacagaagagtgatgtgatcagatttacatgttaacatgatcattttagatgcagttttaagagtagactaaggcaaagcagagagaccaggtaagagatgctgttgacttgggctagagtaatggtagtgggaggatgagaagtcgtcaaattattgataaattttgaaagtataccctgcaagatttgatgagggaccagttgtggagtgtaagaaaaagagaaagaacaggaatgataccagggtttttgttttcagtaactagaagactagagctgtcattagcaatatgagaaacatcatgacctgtcaacatcctttctcttatatcactagatttagagtggataacttcaccaatttgaacataatggcaggatactattatagtactttatccaagagagaattctgagattggtttctattcttgagtattccatgaactagccgtatgatgtatgattcaaccacttactgtaagtctcaaatttattcatttgcaaatgagactgactcagacattatcttctctaagaagccttctttaatatcattgtccaaagagtattcatcaatgtctctactgacctacttctataccttgtataaacttctaatagtccacatattttgtgcttgatatatctgttttccttactataccatttggtcctcaattgagtcttataagtttttgcatcctgtgtacagcaacacatgatagacacttaaaatcttactttagatgatttctgaatttaatgaaaagatgaacatttgtcattgtttcatgaaattcagtgttcatagtataattttagaaaatattatagaagtaggaaggaaatattaatattattgttttgaaatatggattataccacccagagtcactttttttgtggggagagtgtggcagacaagagggacttctttttcaatgccaattcttttatccctaatagtttacattaaactagtgtagtttgatcatgctcgtgattattcttcagaagttaaacctttaacttagaaatcacatggttatctttggatttttttgctctcaattcaaaaatttacatcttataaacttaatttataagaatgtaatgtatttccaatccagtttacatttattgacttcccccccagaagaaatacatttttataataagtataaatgtagaaatagaataatgatgaaaggctcaaggcctgccactaagaaaatctacagtttgcatcatgtaatttagttatactggaaaacacataccacagtgttgcgtcatggaagagcctcaacagatgtcatttttctgtatacagacaatatcctcataatggatattgaatacatgtaaatatatgcaaaatacaaccctgattaagcatattaaaatataacttatactattgatggctaatagatatttttatttgatattgtacagctgataaatgatgatacttattgattacttacaacatacctgatatagtacttggtatttcatatttgcatctttattccacaacactataaactaaggagtatcctttccaatttttagttaaagaaagttgctgctagtgataatttcaagttttcagcccaagtctgttcccaaagcctgacatttttttcacttccaaactaccttccagagtatttcatccactgttgagagatgagatgaccaagacgtctcaaggtcaggtcaccagctgaaatccacttttcacttacttccttcattctgtctagtttagcaaacaacaagcaattattatcatgttcatgaagagtgggcttttttgtactaatattttcagggctagtcttggtgatggaagctgtattctgtgactatattgactgaacttgaatacttgctaacaaatatagtagtgggattcatcgggtctcaaagttgcttttaccctatttgcaagttagcctgtcactgcttcatggatgaccacaaagagctttattcctggtggcttgataggcagcatgaccctcagcctaagtccttgcttctggcctccatatctcacagggatgatcttgatggaagctatacttacaaaagaatattgagctttagaaatccactcattttattgtaagcagtaagcaaacctgctctttgtctggaagggtgacattatctcattaatcaagattgttcctggcaaatacactctgagaagtggccagggaaagaaaagccaaggccttacttacatgctttgcactcctaatgagatgtgtaggagcacaagacatccatggaggatatctctccccactggattcttgtatttctgaacttcaagaatctaatctttcttagagacaatgttgacaaattagtaaaaccataatttcaagtatccaaattgtaccaatggaagatagtaacgttttgctaattatttctttgtgtttagatattaatcccaaatggcctgggtgattaaattaggttaaagtatgagggaaaagtatgtttagagctagaaagagagtgacagagatggagatggatggataaatttttgatccattagtctgtggtggtaatgattatgggaatgagacaggaagacaggaagataagtagcattgtgtatttattcattctttatctatttaatgataaatgtttgtccaacaccagcccccattctaggtcttggagagaacagccatggacaagaccaacaaggtcttcaccctcaaggagcttacattttaatgagtatagtaaggaaacaaacatgcaaacagtaaataggatcagaaagtgacaagtgctatgaagaaaactaaacaatttttgagtttactttagttaccatgttcccagaagacttctctgaggtgccaacatttgagcgagtatgtgattattagaagatagctatacatatactacatccacacacacacacaaaaaacaacaacacttcaggatgagtaagtattctgggccaaaggaatacatagtcaaagactgtaaagcagaagtaagctgggtatgtttgaaggagaacaagtatgtcaacgtggtggaaagagagtgaacaagggtaagattaagagaccatggagaaaaaatattagtcaaggggatggtcaggtagtatctttggggaagtcatggtaaggaattttgtttgtcactgaaagttttaaattatgatgtgatatatttggatttatggttaatatgggctacactggctccttatggcttggattgtggaacggattgcagttggacaagaaagaacacagagagtctaataatgtttgcagaacttgagccaagagaaagtacattttagggattacttcgtcatgagagacaaaaatatattgaagttagttgaaacagcaaagaatttatcgtaaggaagatagctcatgaaaatcaagggcagaaaggtagtcagtcgccataagaaactgactacatattccttttgcctagaatacttactcatcctgaagtgttgttgtggtcattgtttgtttgtgtgttgttgttgttgttgttgttgttgtgtgtgtgtgtagtatatgtatagctatcttctaataattacatattcattcaaatgttaacacctcagagaagtcttctgtgaacatgataaccaaagtcaacagaaagctatcaggaaccaagggattcattcgtattcatactctctttctcgtcctctttccctccctcccttcttgcctatagactttctctgctttggtaatctatggccaaccagaagttcttcagctccactttacgtaatttcccagtttgaatgcatgagaatggttacatatcttctctgaatctatgttcaaatttcactgaagaaactcttcacttgatttgccctgggccatatgtctacttctgatccaattggtcagaaatgagctgagctagaatacttaaattgggatggcaggagctgtgagagcacagttatacatacaagagcatgtacagtattggcttatagctcaattaatttctgcctcagctatagaaatataaaggaacaaatgtgttggctgttagtagacttgaatgcttggctagggttgacagaaagtaacaggttttgagtaagcagcacaatttagtcaagtaaatgggcagcttgtgattaacagtgtcagtatcatgagttgtataaattagggatcctcaaggtctcccttggtgttcccacatgtagaaaggttaaaacaaaagtgatattcaaaaacaggcaacagatatatcttacgatatgttggtaaagcctgaaataggcatctggagtgacaagggtaaaatcaggttgcagtaataaagaagttggtcagacaggtctgtagacctcattgaagaaggtgagtttaagcaaaggtgcaaatgaagtgaaacaaaggcatgaatgaaagacacaaatgaatctgcgaaacaggtatctgtgggggaagcattttaggcagggcaagtaggtagaacaaaaccccttaggtaggaatatacttgatcagtttggggagcagcaaagaagccagagtggctacagtgcaatgagttagtgaaagaatagtaagaaagaaagtcagtgaggtaatggagttggaggaagtatctcgtgattggcctgtaggctccctggactttggttatttttcagagcaaaggatagtcattgcaggactttgagcagaagacatcatctgtaaatactaaattttctcatataaacctattaaaagtacatacatcctatgaagtttgtatattaaaaaccagaagatgcactaccagaaaaatataatggaaaccattcttccagttatttccgtattttgaatgtagagctaagttttggtggcagattggaggtgagtgtgaataaaagaaggaaatcaagaataagtccgagtattttggcctgagcaactgaaaaaatggacttgccaccaaccaagatgggaaagactggggggtagaatagttggagggaaataaaagtttagtttggacatgtgaaccttgtgatgtcctttaggtgtccaaatggagatgccaataggtttttgagaattttggagagatctggtctggagatagaagtttggaaattgtttgcatataaatggtatttaaagccatggcttcactgaggcagtaagtgtagatagaaaagagaaggccaaagattgctctggggcatccaacattaataggtcagggagaagaggtggatctagcaaaagagactgagaagaagtgatcagtgaggtatgaaaagacatatgagtgtgacatcttagacattaagtgaaggaagggtatgaaggaagagggactgataaactgtgccatctgctaaggtaagcactgataactgaccattaggtttagcaatggtgattgctgaccattggaggtcattgctgaccttgatgtgggcagttttggtggtatggtaaagtgaaaacttgaccagggtggatttaaaagagaatgaaagagaattagagacaataaatatgagtccatgcttttgaggtgttttttggcaaaggaggcacagaaatgggactgtagtggctggggaagtgggatcaaaagaaagtatttatgagagtaaaaacagcatgtttatatgctgatattaacagtttagtagaaagggaagggtggattatagaggagagaggggaaattattagagcaatgggcttgaatagatgataagaaatattatctagtacataagtagacgattaataattttaatattaataattagcaataatttatctgggaaagtgtttctctattaattgcttagagagtttttcatcactgctcaaaaaccttttgtagcagcccattgcctattcaatccagcctaggaacctcagcccagcaggcaagatggttgtactctgacctcagtgtaccttactggcttcatttccttcagttctccctcctgtgcctaagttaaagaactttcacattaatctttgtttctttgtgtattgcatgcgatagactaggttattcagtaaccatagacctggtgctgaagctacaatacagctagattgcattctagattgttcccaatgttgttcccatgttcaaggatctcatgtatataaggcagcataccaagctagtgcttctgattttaaagtaataagagatttttttaaaatttgctctgaaggcaattctgaaagataagtttcaaaaatatttgaaacaacaacataatcactggggcattttcacgctacgtgcttttttttggtctttaccattttattttgaaataattttagacttagaggaaagttacaaaagtagtcacagcattgacgtatgtcctttaccctgcttcacctagtgttaatatcttacattaccatagttcaattattgaaatctggaaattgttatcgatgaaatactgttaattaatttaccaaccctaagtaattccattagtttttccactactgtcttttgtgtggattaggatctgattcaggatcagtttgttgttatgtctctttagtatcccctaatctgtgtcagtctttccttatcatccatgacgttcccattttcaaagagtaagggtcagttattttaaagaacgtttgagtgatgtttccacatcacgggattcaggatatgtaggagaatactctctggaatatatgagccaggatgcatttgtgcaaaaagtagtaatatgttataggcaaacaatataatcttaaagaccacattttaacagtttggggctggtttttttccccagtttaaatctactgaggatttcctattcacaaataaaaaggtgactcagtaaatcaagcaaaaaatgcttgagagtatgaagtaaaaacatactgttacgtgcttcaggaaatacaaggaaatatatgacataatcctttacttcaaatactgtacagtcaggctatggtgacaagacatagagaatatgttcattgttaatgaatttcttcactattaaaatgtatatgcacaaaagtttaaatgaaaagcattttaacagacaaatttactgctacagtaaaaggtatgtctacatgcagacaacttgctatcccatgcttaggtaaaggaagagacttatgcaattaaattacattattctgtcatccgtgtcactccagtcttttttctttctaatgttaatatccacacttgccctccatgtaaatatcagtgtccagtggttctatttctcaggaatttctctttgttaagccagagtaatcagtagtctcactccctatggtcttttagtctggactacaggtgactaaatttttacagctgttcttcttaaccttatactcttgagttttttgttttgttggttgtttttccctaacagtaagccatgttgcaaacttcctaaccagtttctccatcattctttttttccccagcattacccaaattatacattacttgtatgtagtataaaatctgcctttcactgcctttcagttgagtttaccataaaacgtttgactaggaaggatataaaaatttgtttacactatttggaaaaggagagaaaattctctgaatggggtaagtggattcttggttggaagctcatgttggataaaatgaccactcaagtgtttttttcagctctaagtcaggatggaacttaatggcacagcacaaatcggctgttgccacaactgggcaactggaaaatgccttttgatgatggtgattaaataaaggtcaaagaatatcactgcatcctaatggtagtcatcacacaacatcagcctttctcctggtgcctttgaaaatgtcacttgaaaagtctaaaaaatgctatgtgttttgtttaggcagaaaatgccctcattaagtacctcatgttttcgttagaaaaatcaaagaaatgttagggttctgagtactagattgtaggtttaaaagaaaattaaatgtaaccttttgttatgtaaaataataaactcctaaagtaaccataaaggctttatttttacacaaagcgtatgtctgttttctaaaaggctctaaaaagagccatgtgatatgatctcaaatctataggatgaaaaaacccacgttactgaagtagtagttaaccgtgaataatttctagtggaaagtgaagatttcttaagagagttattttcattttttaaggtatgaacttgagcatttgcggtcttgtcagggacagtagttttagttttgcctactcagtactcttaagaaaaatcagatacggagcctcattttctttcatattctgtctattcctctttttttttttgccaccattataagtactatagcccttatcaatggaaggcagaaaggatgtccaatttaaaagcaaaagtttacttagttgtactatgctatcatgaatctagttatatattatatatattatatataatatatgtattgtatatttatacacacacacacacacacacacacacacacacacacacacacagtatttcatgtaaatttcatgctaatgttcccttaggactgacaatatgtggactacgtaatctaaagttttgtttttttttttaatttaccaggtaaattgacatccccatgtgacaggggtaaatcttatttctcaaagtatgcttggaagtcatgagctttcgaatgtctgatcatgaacagcagcatactactggatgtgtagcttccagtgtctaggagggtttatggtaatctaaagaagcacattttaaagagatgcctatgtacattcaagtatgagaagtatttctttagattacagtgttttgggatacaaacactggaggtgaattacctgagagtaatatataaactccaataatctcaagaaggtatgtcaagggtagacaaatgatagctgcaattctaaatctggcctattgactatttttgtatggccttcaacctaagaatagtttgtactttgtaaaaagttgaaaaaaaaacaaaagaatattttgtgacacatgaaaactacataaaatttaaatttctgtgttcataaatgaagttttattagaacacagccatactcatttgtgtattatcaatggctgcttttgtgctacgtcagcagaggtgagtagttgtgacagagaccccatggtctgcaaagctgaaaatatttactatctatccctttccagaaaagcttttccaacccttgagcaagatgattttattcaattacttagattctctgtgcttcagtttcttcatctgcaaaatgaagataataaactgtacctatttcatagaatttttataagagaatgaagaggcagtatagtgtaatgatcacagacatagattctggaacccaaactgtctgagtttaaatcttggtcctctgtttaatagcttttggcctaggcaagttacataacatttctgtgcctgtttccttatctacaaaataaggaaaatatagtactagtacctacctcataggatttctgtaaaatcaaatgagttaacataggtgactcttgtacagttgacccttgaacagtgtaggagttagcggtgccaatctcccacacagtcaaaatccatgtaagacttttgactccccttaaaacttaactaatagcctactgctggccagaagccttacttataacataaatagtccattaccacatattttgtacattatatgtattatatactgtattcttacaataaagtaagctaaatgaaagaaaaatgtttacgaatatctaaaaaagagaaaatatatttaatatttattaagtggaagtggatcaacctaaaggtcttcatccttgtcttcacattgagtaggctgaggaggaggaggaagaggtggggttggttttactgtctcatgcgtggcagaggcagaagaggtggaggaggtggaaggggaggcaggagaggcaggcatacttggtataactttctggaaatatatcatagtttctgtctgatgttttttactttttcagtctctaaaaatgtttctgtactgtactgtaccaatccttcttccactgtttgctttagtttcagtgcccatatcttatgagtccattttgaaaatgaatcaaagaagtcttgaataattggaacccttctgccagattttctaatgtcagtttgttttctggcattgcttttcttatgccttcttcctcattgtctggcactggttcgaaagcactcatctccatcaagttgtcttctgttaattcctgtcttgtggtattgattagctctttcatttcttcaagattcatcccatgaaaccctttatttctcacctttctttttttgccatatccacaatctctttcatgagttctttgattggctctgtcataaattctatagagttgtgcacaccctctgaacacagtttaatccaggatgaatttcttgctttgggctttatggctttcacagctttttctataacaatgatggtagcttcaatggtgcagtccttccggattttcttgacattctctttatcagttttctcttgcataacactgacaactctttccatagagtactgtgtgtaatgaaatttaaaggtccttatgaccttctgatctagaggctgaattagagatgttgtgtttgggagcaagtagagcatcttcagttgaactcatggaggtctgggtggccaggagcattttccgataccaaaagaacttttaaaaagcagtccctttctggcaagatacttcttgaattcaataactcaaagcgttgatgaacccaatcaagataaagggttatcgttgtccagaccttcctgttgtgcagccaaaagactggtagctgatgtctatcatttcccttcaaggttcagaggttagcagctttatagataaaggcagtcctgattataaacctgactgcatttccacaaaatggtagagttagcctaacccttcctgcctttaatcctggtgctcacttctctttctcactaataaatgtcctttgtggcatttttccccccagaatagggcactttcatctgcactaaaaaaactgttcaggcagatatcctttctctagtgattttcttaatggcgtctgggaacttgtctgctgcctgttggtcagcagaagctgtttctcctgttgtcctgacattttaaagccaaacctcttgctaaaattatcaaactgtcctttcccggcacctcagttctccaactttagattcttcaccctccttttcctttaatttgtcatataatggcttttctttttctggaatcctatttgagtctgtagctatgcctttcttatagcaatattgtgcccacatgaaagcctcgaggcattttgcaaagtgcagtgtttctgtgtttgccaacagagctgcagccacgactacacaaattttcttttctcttttcacaatggtccctatgctggattcacttatcctgaaatggtgggcaacccagctgcagacctcaatctacagtacatatcaagcaattaaacttctccttgtaatgtcatgacttttctctgcttcttgggagcacttcagcatcactaattacactttatatgggtcctgtggtgttattcacagtttacggtattgtaccaaacatgatgaaaagtacactagaaccatgagaaatcactttttccctgtgacatgtaatttactggagagacagactgctcacacagagacgattaccatctcatggtgttttaaggcatactcaatacttgcaacacttgagctcaccacaataacaacaggaggtgggtacaaaattattatagtagtacagtacatacatgtattactgttaattttatgcagttatgattgaatactgcatctttatgtttgtttacttttctctagactttgaatggctctgtgtagggtcttcaagtgtgtaagttttaataaatttcaacttttataatagatggtgtatattttatggtaataaatgataaaatagactagtatctaaacatattttatgcatttgtgacatacctttttatttttttcaatatttctaggttacaaagttcatctacaagtttttttaaattatcacaaatctccaaaatattttccagtacatttattttttaaaattcacatgtacctggattctcacagttcaaatccatgttgttcaaaggtcatctgtagtgtctggctttaatagtgtaatttttttattattggtgatagtattgtgattgttttcatctacctcacaagattattataagaattaaatgtgataattcatgtgaaacttagggctcaataaatattagctgttattgtttgttattgatgagacacatttccagctgtaatgtacaggtgtatctgtgattctcatgttgactggggattggatggctgtcagaataaaagggagtaaaagggaagtaaatttaaaggccttccatatgattgatacaatatttattcctacatttaaaatcatcggtgacactgaccttaacttgacagtaattattaactagtgctagtgtccttattgaccttgttatataaatagttgagaatagtttattatcagtgtgcgaattttatgtaactggtcattctacaaagattgagtgtgactgaaggagtccttaactttttgtgtttatatcattatttcacaaagcacactatccttaatatattaaaaaaaataaactgataagccttctagccaaattgccgtgaattcaaaattactggagtcaaagtagattactttttattgtattatatattttaggccatctcaaatcaccagaagttgacaaagattacattttaattcacacttgcaaagtagaataaaagggcaataaaaaaatctcatggttgaattcttttgtgtcagaatagtaagtaaggaagttcttggcaaagagagtaactatataaaaaaggatgaagtgaagtgcttggctggtagagaattttttgtttagagataaatactggacttagttaaatccagaaaaacagaatattttaggatgacagttgggtaagttagagtgagatgtcaatgcctttgaggtaatcattaaatttaacataatacgtatgattaattctaaaaaataatttgtactattatttaatttttcctactgcttgcttttcattataaacccattatgaactttagcagtaagaaaaggttttcctgcaagcaagatttaaaaattagaataggtttctaagaaaaattggacagtgtgtatatacgtatatgtgattgtgtgtgtatactttgttataaagtaggaaattaaatttaactacatttaaatagtctatgatagtttgtttcttatccaattctcttccagtcccatacttttgataattcatagatatcctccattaaatactatagcaattcaatacccagaggagaaaaagtgtgacttcctcagaggagaaaaagtgtgacttttcaataggttgtttcacttttacaattccatcctaactaaatactacattaacataaaaaactacaacaacaataattagctttttggatctaaatattggcctaaatatttagaataatacagtgttagtatctgtcttatattgtctgtttctctaggattgtgcctgtttaaactacttttggaaattagtaccaacctaatgctgttaataattatgcatgccatcatgtcatgatacctaatggaatcataagttaaagtctttcattcaattcccattaacatagtctatgcactgtctcatctacctaataagtctttattgccttctgtagtataactttggattttctctactgctaataggaaacaattacttccactaaattcacttacactgttgcattgtataattccagagagcactattgcatcattgctccccaccccaatccccctggtactgtgcagtacacagcctgcctgaccatccacagcagccatgacattgctttctttgcacaagcacagaggaatacaatttgaggtatttatgtttactatttagagacagacaattaattgacataggatttacataaactagcattttcataaagatccagaatttgataacatgacttagttaatataaatttaatcaatattcacatctgttttattctttggcagttcatagttattcctaaagtggaagcggcacttgggaatataaagatttggactttataatttactctccaaaagattatagagtttttactttgatttaaggaacaaacgtgaaagactttactggaatgtaaatagttttggcatatttacagtgcaatgttttcagttgtgaagttggttagttatgtaggcgggagctgtaggagttgtgatagtcagtatattacaagcattttgcaactccctgatttctctatgtttttaacaactatggtagcaatgcctcaaatttctgggatcctctgttaccccacagtggttccaaaagaactgattactttttcattaatcctcaagctatatgtgataaataattgggaggatggaaagatgatggaaaagaggaaaaaccttgaaagatcaactgattttgttaataccacacaccaatatgcagacccagctctgatctcttttttttctgcattgtgatatttgtccaattatcttgcttctaaaattcaaacctattatagccatttcattttctgcattttttctcatttcagtgtaaaggccttgtgggagaaggttttactttagtctttaacttggcatatggaaaaatattaactgctatgtgtataataattctcctttttttccttaaaatgctatttcctttgtactactaatgtactttgattggttgactggatattgagtgttaaactatagaagtatttcagaccacttgagtgatagctttgcttcattctttcgtgtgtttctatatggttttataaactagataatgctacacaataagggtttactgtgagccctcagtaaacccttattttgtagcatagcaaaatgtgctccaacaatgggggaggtatctggctttatgcatcccttccgccaatcaccagccatgtaaatttatacagtcacataagatttctgagccttaaattcctcatagaaataaaaaatacctgccttgcctatctcacaaaagtttgtgtggatcaaattatttaatgtacatgaaaaaactctttagaccaataaaatgtcatatgaatccaaggaagagaatgattgaatacttctcaaatgaattaaggtgacagttatcatataaaaacttcattgcttcaggtcactgagtaaaaataaattggtaactctgactcctacgtaactatccccagcactgttaggacagtgtatggcttaccaagtaaataaagaaaaccaggtaatagctagaactaagcaagaataatgaggtggataacagtagcctctcatttctttgaaaaatttatgttgtgctgatcataagacaggcaagtgctttagtaaaacatactcagatcttagaatcttaaatagttgggccgttgtcacacataagacccttaatgttacagactggagattgaatgggaaggccttaccatgaagctgtataacatggttttctgctacctacttaattcggcatgttaaatttaaacaaataagcttttagaaaatcatactaaagagtttcaacaataaagagaggctgactctcagaaatataagacaaccagatacagaaggcttttcaatattgattttttaaacataagaaaactttctaaggccatattaaatggttctccaataaagtgttttaatagctccagtaagaacatctgactggctgctttctatgtgagcaggacttgattgaaattgaggaaaagatgaagcatctttaagctagagagcccggagggtaaattattaaaatgagctatggagaattggggagagcttgcactcaaatttagtttttgagaaggaaaagtacaaatcattctatacatggaccaactcaattttgccacctgttactttaaaattttaacctgttttactttgaaaacaatgctaaaacataacttgatggactcatagtttgattcctactaggtcgatattgtgtctcagaattaaattgtccattaatttttattgtattctgtagcatcttccacctaatagtgatgcaaatgaattatgggtagatgaagtaattctaattttcctatatacttataattctcttgggcttccatgagcagaatatgtaagataatacatttgagatactgttatcagaaaattggggataggagagtacacatgaaaaaatgacatgtacatagtattcaaggatgccttcattcattcattaaacagacatttattgggtgccaaatctgagacagaccccttgctggtttgcatttaaatatatcgtgggtatttaatgaggaaaaaggtatgaaattgccaaaacaacttagagtaagtaacatcaagctgccctcatggcctttctatacttccgcatcttggtggaggaagtattagtgataggggctgtgaagggctgtggtatgggcatgcctgctccaagcccccagattatctggcagaaaagaacgaagagcaagaattaaaagccctccccaagggatccattcaagtaaatgttttagcaatgagtgagtgagatgatgaggcagtgtgggatattgggaagaacaagagttaggaactgggggaaaaaaaaaaaaggctcaaatcccatccatggcccctgcaaagctctgtgatgttgagagagttacatcgattttctgaacgactatttcttcattatgaaatggagtttaaaaaatacctactactcaagcttgcacacagtgtcccgcatagtttttggcccatggtaagtaattaataaatatgatgtaattaataaatatgactttccttattactgtattgacacaacaatatcagtagtatagtttgatgagcatcagatatccatagacttaaataacagacaaaatacatctccttcatctatcttattaactgtagaatttcttttcactcattttgattcaaattaagtatggaccatctgttccaggcttcaaaaactctttcaaatgagcagtggttttacacatgtcatgatgtgtaaaaatttagatcaatttttttagtaatgagtacagagtgtcttaccagatatcatttcctaaacacttagttgtatgagctttaagttactatgaagataaaataatcttcacagttaatgacaccgaacatgtgaaagtgctttgaaaattgtcaggcaatatcctaggtcacttggtcatctgactccataggaaaatatggcagcaacagcttgctctaaccattaggggaaaagaaatacaatataccaataggtatattggtatattggatattgtaaagcaaatatcatgcttcacagtagtcagctgagaatgattcacaggcaagctttgacttgaggttatgggcatttctatacaaaagaaagtgtcagtcagtagagagttagtagcaatgaaaagacaaaatggcaactttgtgagggacgcttgacctctagtgccatctggagtgggggacagggtggatatgaccatttaaacatgattgaatttagaaagtatttcctgataatgtcattattaggaaatactttaatgtagccattaaaaccatccacttaactgggctcggtggcatgtacctgtaatcccagctgtttgggaagctgaggcaggaggattgcttgagcctagaagtttgaggcaagcctgagtgagacctcatctcaaagcaaacaaaaaatccacttaaccccatctgcaccaagaagtttccgattataatatagttatgaattattagtttgcatatggtccaatgaagtatctggtccacttgaaaacatttctatttataaattaatgacttggcattgtgatcttaatgtattagtcttatggtaatttgattatatgcagattttctcccatggatgaacaaccaaatttccaagcccacagagttgaggaacagattctgagaaatagtgatgtcattataagctaagggagactatctggggaaccaacctcccccagataaccttgctgaaaaccttctcattcaaaatgaagctattatatcctagactcaaataaaatgattgaatgtacatttgattttgaagaactcagcccaagggaatttgaatcacttgttagtctctcactctgtttgtaaaaatgtatgactaggaaatctagattcccttgggtatggtgatgatttctgaggtacaacactaatgacatgatccaaggaagaaaaaaaatgataagctgaactttattaaaatagaaaaatgtctgctctgtgaaagacattgtcaagagaatcaaaagatgagccaaagactgggagaaaatatttgcaaaagacatacctggtagaggacctttatccaagatatgcaaaatgctcttaaaactcaagtataaggaaaaaataggacaactatagttaacaattattgtttatttcaaaataacaaaaagagtagaattgcaatgtttctaccataaagaaatgataaatgcttgaggtgatggatagcccagttgccctgaattgatcattacacattgtatatgtgtaccaaaatatcacatgcgctccataaacatgtattaatacaactattatgtattcataataattaaaatcttttaagaaagcaaacaaaagaaataaaataaaccaattaaaaatgggtcaaagatcttaacaccacactaaataaaatatacagatggcaaataagcatatgaaaagacgcttcatatcatatgtcatcaaggaaatgcaaattaaaataatactgagataccactacacacctattagaatggccaaagtccagaacactgacactaccaaatgctgacaaggatgtgtgacaacaggaactctcattcattgctaatggaaatgcaaaatggtacagccactttgggggacagtttggtgtttttttaaaaacaaaaacaaaaacaaaaaaaaactaaacatatacttaccacatgacccagcaatcacactccttggtatttatccaaatgaattctcacagaaacctacctactgatatttaaagcagctatatttataattatcaaaatttggaagcaaccaagatatccttcagtagataaatggataaataaactgtaatacagccaaacaatggaatattactcagcactaataaaagagctctcgagccatgaaaagatagggaggaaacttaaattcatattgctaaagaagccaatctgaaaagactacctactgtatgattgaaactatatgacatttgaaaaaggtaaaactatggatacaacaaaaaaatccattgttaccaggggttcaaaggagagagagataaacaggtagagcatggataatttttagggtagtgaaaatactctgtatgatactacaatgttggatacacatcactatacattcttccaaacccatagatgttcaagagcaagagtgaatcctaatgtaaactatggactttgcattattatgatgtgttagtataagtttatcaagtgtaacaaatgtaacattcttatctccccctaaatgttcagcctctttagtagaagagccatgcctcacttagtttttgttttgtaggacctagagcagagcactcaataaatgttttttagttcatttatcaaatagttattccattgattaatcaagcaaaagaaaactgttcacctatttcagagtgttagtctcagccatttgttttatacatttcaaagaaatgttacttaccatatggtccagcaatctcattactaggtatataggcaaaggatgcgaaatcagtatgtcaaagagatatctgcacttacatatttaatatggcactatttacaatagctaagatatgatctatcaatggatgaatggatggagaaaatgaggtatatatacatgatggaatacaattcagcctttaaaaagaaggaaatcctgctatttgggataacatggatgaacctggaggacattatgttaagtgaaataagccaggcacaaaaagacaaatttgcacagtgtcactgatatgtggaacctaaaaaagttgatctcataggagcagagaaaagaatggtggttaccaacagctgggacagagggggtgggggtggagtttgaggagatattgttcaaaggatacaaattttttattagacaggaggagtaagttcaagagatctattgtacaacatggtgactataattaataatatactgtattcttaaaaatgctaagagagtagattatatgtgttctattacaaaatcacgagatatgtgaagtaatacatgtgttaattctcctgatttagccattccacaaggtatagttgttttaaaacatcatgtagtacatggtaattatgtaaaattttatctgtgattttttaaaaaataaaataaaacatttttaaaagaaatgttacattacaacctctaattgcttccacttttacatttagctaatttcacaagctgcacgccatgtttcaaattggttttcttctagcaaattgtgcatgtgtgtattctctcagatatgaccttccaggttttagagtccactatgtcaagaagtaagacatattaaggaatctgatcttggtaaaaatttccagagtctacctacttgtcttttctaaatttgtttaatcagatggaataaattagagaaaaatactggtcgttttgtgaatttttaacaattcctttgtcttttttgcagtatttcaattacataagtagtaaaatttgtgtttatatgttaagttgcctgaaactgtggaaaatagacctatttttatttatattaagagtttttgagatttcttgtttcaattttcatttatattcctgtttaatttacatgcataaaatgactcttttcgtcttgtcatttgttatttaggaagaagtaaaatttgtgggtttccagtatagtacagcagttaaattcatatgcagagtaacttactgaaatgacaaggtagatgttattgtattataataagttataataattatatggtaataataccttcaacatcaatgtagtttttaacctgaaaaattttgaagttcaacgaaacaacagctttgggtaatagtgggtaaatatcccaaatattgtgaggccttccttgaatattaatccagacacttttttttttttttttttttgagacagtgtctcactctgtcacccaggctggagagcagtggcaggatctcagctcactgcaaacttcacctcccgggttcaagcgattctcctgcttcagcctctggagtagctgggattacaggtgtgtgctaccacgcccagctaatttttgtatttttagtagagacggggtttcaccatgttggccaggctagtctcgaactcctgacctcaggtgatctgcccgcctcggcctcccaaagttctgggattacagatgtgagccaccactccctgatctaaaccaggtatttcttttttttttttttttatgctgtttattttttaatttttatggatacataacaattgtacatatttatgggatacatgtgatattttgttttttttattatactttaaattttagggtacatgtgcacattgtgcaggttagttacatatgtatacatgtgccatgctggtgcgctgcacccactaactcgtcatctagcattaggtatatctcccgatgctatccctccccaccccccaaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttctggctgcatagtattccatggtgtatatgtgccacattttcttaatccagtctatcattgttggacatttgggttggttccaagtctttgctattgtgaataatgccgcaataaacatacgtatgcatgtgtctttagagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagttttcctatttctccacatcctctccagcacctcttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctttttagtttaattagatcccatttgtcaattttgtcttttgttgccattgcttttggtgttttagacatgaagtccttgcccatggctatgtcctgaatggtaatgcctagattttattctagggattttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagttatgtggcattatttctgagggctctgttctgttccattgatctatatctctgttttggtaccagtaccatgctgttttggttactgtagccttgtagtatagtttgaagtcaggtagtgtgatacctccagctttgttcttttggcttagtattgacttggggatgcgggctcttttttggttccatatgaactttaaagtagttttttccaattctgtgaagaaagtcattggtagcttgatagggatggcattgaatctgtaaattaccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttaaccaggtatttctaatgctgctgtgtgatttggcagagacgggataagccctgagagagcacaccccagcagtaccctcacttgggtgagtttgagcaattgccaggaaagctcagcattgtaagttttcccaggagatagatttcctttaataactatgatatgtgccaaaaatacaaacatttgatattagtgtatctgacatatatcatatcttatatgtagtagatactaagtaaatatttattggttgcttgattttgccattttgaggactgtattgatatgtttggaatattaaataaattagtgatgatatagacaacacaaaatatttatatgtattaagggaattgttctgatatggtttttaaaaaaatttcaaaaactatttcattttttgaaatagtcttctgtacttatcatgtttagttttatgaaaaatacttgcattctgttggcttgagttttgtgggctttattaacaagggattcttagtccttttatgtgctgtgattttgggaaaataatttaaccttttctactgcatatatttctcacctatcacataacttttttcctgtacataaggtgatcatataatttttgtccagattgaaatagttcagagagaatgaagtattattaaaaattataccaggacaactggcttaaattaaaccatcccaggcaaattggaatgtgggatcacccaaccatagccccattttcattaaataccacaaatctttattgagtactgttatttccaagacattgtgtttcagaccacagatttttaaaaaggaatacctttccccttcaccagccatcttcgccaccagccagcagtgttctgctttgatgtagtattttatttgtttttctttcaacaatacgttacctgcttaaagtatttgaaagccactgatggattagagtgcaggaatatggtcagtgtcatgagagagatttaaaatgctatgataaacagaggtaaaggaaagcatgtcttgtggaaggtaggaggatgcggtatttgattgattgattgattgattgattgatttttgagatggagtctcactctgctgcctaggctggagtgcagcagcatgatcttggctcactgcaacctccgtctcccaggttcaagctattctcctgcctcagcctccctagtagctgggactacaggcctgcgccaccacacccagctaattttgtgtgtgcatatttttagggaagatggggtttcaccatattggccagactgatctcgaacccccaatctcaaatgatcctcctgcctcggtctcccaaagtgctgagattacaggaatgagccactgaacccagctggatgcactattttaaaagagtgctttttaggatgatccttgagggatggtgagaaggactgaagatggaaatgtaagtgggcaagcaccccggggaaatatctctggccaagagtaagccttctattctgtcaccttggcttggaaagcacaagagaaggataagatggatttggcgtgtttagcgtgtgtggaggggggagctgtaggagataatgccctatagcattatggagggttggtgagccaatctgagggatatatacatttatatatttatatgatttatttgttattaaacaaatgatagtgctcagccccttcgcttgtcctgggtgtcctatctgcctttatactgactagtgtaatctcaatctggggttatcattcatttccctctgctcttttcagatctgcttcctcgacgctccgctcaatatgcaggcatcctgatttctactgacttgcaatgtgatagtcacagactttctcttgtctgcctcctttctgggaggagttatctctgccaatcttacttagatactggccttgctttcctttctttttcattttcttctgacttctaatttatctttgttcttccatgagtattcctctcaacagtttttagttgacattttatttcatttaacacacctgtaattaatatgtatgtgcagacaaacatattcatttgcctacagacaaacacatacatatacccatacaccagtgtgagcatgttgtttttccttgtttttaagtaacctttattttcacattttaactaatctgaaatagaactcttttaaccaatacataccattaatgtggtgatatatctcatcttcctaatccccataaaaacttcctatatgatctgtggcattttagaagtgtgcaaatattggtagtgtgaaatttctagttttcaagcctgtgaaagcaagcagtggctagttgaattatgtgtcacacactttgatacacttctgccgggtgaggaccagcaatatggtggttagaagaaccacctccaggggcacatggtctgctcctaatgtgtgtgacttctggcaattgtgtcaacctcatgtgcttcatttctttcctgtaaaatgaagctaggaatgagaaattcataggtatcaattgaggtggtttacgtgagtgtttagatcaatgcttaacacatgctaagttatctttgtcacctttagtatgttacctctcaatttaacaatgaaaaataaatgaaaaaaacaaaagtgatataaaatgctatctggctatattttattggacacaccagaggttctcaaactttctgggtttatccttatctcagaattttgtatggggcccccaaactaaaataaatacctaacattttgtgtatgaaataattaggtccagacaactgaaagataacttttgcctgatgtccatctgatatcaatgtgttttctttgaaaatttaaaattcccctgataccctgaggtgcctgggtcacagtttgggaatgacagaggaactcatttgttcagctcttactttctgactgctatttaactcatccaactttcagcaagtgctatgtgttgctaattcatgacttccctgtctccaaaacattttgatctctttagatagttagctcagaaggccctcagatgaaaactttaaaaagaaagctaaaacttcgggtaaagtgttgttttgtgtccaatagcctcagagaatctaaagcaaaatgggaggaaaataagagactaaattctcagtgtgttcactatatcagttacagttgcccttaaaacctgggaatacctgcttttatggttctctgaggttctttggcaggcgtaccaagtaggagctacttgaaggtcacctgcacaatgatgtgtgtaaaaggaatgtcttatgtttaccattcccccctccaggctctggaaacagacagcaatataacattaacattgtctgcttactgtctttcagatcctttacaagcttttaagttactgtctacaggtatttggggtataagaagctgattaggtctttgggataagaagctatgcctcatacaccttaaactctcaggccaattaacctctcaaatagtatatgttccatattaatgcttaccaaattgtgttaagacttcaacgaactttcaccagtccagaatcctaaataggagggtctgtgtttatgaagatctgggggatagacagggacacaagcctttatatatgaactgatgttaaaaaatattttttttctaaaatgcattgtggattttcccacattctggaaagctgtagttatatgtacagaagtacctggagtagaccttcaggctaggagacttttttttaaaaaaattgaactagtattcatagtaaatttttctaaaatgcattataaattattatacattcttaaatgctacagctacagctatatgggtagctaactggtggggaccttttgggttaagcaatgttgcaactatattacaatttagagaaaagctattttagcctgcagaaccatattgcttgacatgcagatgttagcatgctgcctctgtcgggttccagtatgcatttgtcatatacctgtattccctgcaggtgtcttctcattcctccttgttttcctttgagtgtcctccttttatctcttaccttttcccttcttaactcattttacacactttgttaccaccatagccaagaccatggtctatggaccatctgaaaccagacgggcctgggagcctatttaaaatgcactcccaccaaatcagaacctctgaggatgggccccaggaataagcagtgtaattaacttcccgtttgattctttcatgcttatattaactaacaatgtcgggccacactgaattctccatttgaaaaaaatacgtttttgctcttttgggactctctacacatgaatgtgtttctctcccttcctgagatttcactatcttcccaagccatgcttatgtcttctgggggcttaggatcggctaattgaatatcaaggttatacttgtttacattctacatttatatttatggttattataagagaggatattgaaagaaaaatggagctgggaatgaaggctaatttagtattacattaccaaaatagctctgtgaagcagtgtaagctaaaggtaaggacacactcttagaaggctgctttctgaactgggtatcaaagtagctctgcaagtttacatggtcttgactaatatattcaaccaccctaagcctcagttatttctttataaaaaggagatgatgatacctaccttgcatagtcattatgagatttataccagaaaatgtttgaaagagtttaaatctctgaaaattgtaagcatgttattattactaaacccattttacagatgagtcaaccgaggacagaggaagtaagagaacatgctgcagttcatagctcataaaccacaggaccagaaggcacctttcacccctacctgcccccttctacaggctttttcttgccagataattcattgccctctaggagctgaggattctgtagcatcaagtttttgcagtattaagattttagctctttttgtttcagtttttgtagcatttgatgaaaacttaaagctgattatattgtgtgtggtctcactaaaaacagtggcttttccctattttttaaagaaaaatttatatttgacgacctttcaccacacacacagtaggtgtgcactgtaaggaatgaaaggagccctgaaaatgatcccagttcccttaaagcctgaagacaggtgtctgtaagtcctaaccctccccaactcccatcagtatcctgacttatccacctgcatctacagtatgtagttggcttatgaatattgactgggactaaatgaataaatattgaatacctactatgtgcaactatatagtcacttataacagtgcttctcatttatatataaacaaatcttctgggaagtgatcaaaatgtaaagtccagttcagtaggtgtagaatgggacctgagactgcacttctaacaagctgttagatgacagcagagctgctggtctgtggacgaggtgattctggtgcacatttaagtttgagacacgctgtggtgtcccattctgccttttaaatctctgtgtaatactttttggcatttcttcattgttcatttgttatttattacttacatcccccagtagaatttaagttatatgagagcacagacgtttctaccttgatcatcactgtgttcccagcacctggaatagtgccagacacgtgtaggtactcacagtagggtagtggagctgatagccgatttgcccctgcacaccactgctcagtaatatttgtgattcagtacatgagtaaatgaatataggtattggtaatatgcatagatatataatagttatctattatttaatatacatagatatataatatttatatattgtttacataatccacataacattttgaggaatctattatcaaccacagtttgtaaatatgcaataatatgtgtctatttagtattacgggcaaatacaataaaacttactgaaatcaggtaactattgaaagtgttaggaatgaagagctagagcttgcactcatcctggaagaagacaggcaattctataaatagagagagaaaaggagaagagggtattccgtgtagatggaatgtagtgggataattttctgaggttttattcttaagttttattcctcttgacatctccatatttctgatcaattatccagttccctagttttcctgttgtagggaattttgagtgcaaaaagcagaagttactagaagtttgttctttctacgttttgtaaattccaaaatttgctgaaattatgctgtgtatcctggggtaagatagaagagagatggcttcttttgcagacagctagtggaaagagaaattttcccaagacagcaaagaattcggtctgagtgagaggatgataacttcaaatattaatcctttctgcaccacaatccccttcagcagtttgatgaggatgtcaaaggaagcattatattaaaaattgtttataaaatactttagagattggaataagtaacttgtgtgtttgtttattaattcataaaatattaatatctagcagcagatcaagtaattaaccttcatatagtgatgagcacagatttttaactataaaattatataaaaatctgctttttattcactgtagatttatagttactactaatactattgtggttcattatctgcatttataataaaaaataaatattaaattttcagttagaggttaattaaaaaacggacattattattttcctactcaagtccatggacccctgaggatggaccccaggttcagaagaagggcttgtacatcactttgaggcagtgcatatcagtcaggatagtctaggtcagtggttctcaaagtctaatccctggaccaataatatcagtatcatctgggaacttatcaggaatataaattctcagttccaatccgagtgttactgaaccagaaactctgggagcaggaccaagtaatgtatgttttcataagctctccaggtgattctgatacatgctcaagttttagaagcactaagctaaattatacttttgtaaacaaacaattaaaaaaaacagcctcaaatctcagtagtgtaaaatacatggtttattttccatttgatcttcattttcatcacagatagtatggacttattctgctccatgtctcctcaatccaggaacctggttgacagaacagccatcatctccaacattactagtactataccaggatagaaagagagctggagagtctcacattggtgattcttggtgcagaagtgatgcatatcgcttctactaacatctaattggccagagctagtcccatggttccagccagtaactacaaggagaggaagggcctggaagccagggagctaatgatgactaacacactatcaagatacagcaagatctcagagaagatggtctgctaatatccctagggagactattacagtcgcacttatgattcccttgcttgcagcaggcacagaaacagcagaatcacagccatgaaggatcagctgagacagtgggtgaactagtgtggcccaatgtgttccatgcaatctgtgacggaggtagaccaatgtaaaccaaagactgggagggtcaaggaagggggcacttccttttgctttagagatacttaagatcctgggatttttgcaccattctgggcacgggaggaaagcacaaaagtgattgagattgaatttcctgccacaggacgctcagtgttagatttaagttgattcagagaaatgtgatatttctgacacacttcaacacggggagaaaagttcatatccactagagctgttatctgtgtaaagtgcactagttcagcacttaacatggggcagtttagaggaggatttcataaatgcttggaagatgataaactcttcatatactttaacactaaattgacatattgacttagaaaagcctgagacctataatttttgtaaattcatattggggattcaattaatggagaaatatgagtcgttggtagttagtcactttttgtgattgtgacagttaattcatttttatctattagaaaattttacaggcattcagctagtatttttctgttatataattttccctgcctgccttgctttcatctcaaaataaagagaaggtattagccacgtagtgatgagaaagtagtcatagtaaaaattgaaataatacagtcttgggaaaatgtctggctcatgtggtgaaggttttattacttcacacttttggaaatatttactggagtcttagccactatgacaccataaatgtgtatttgatgaagatcaaaatctacctctgaagtgcacatttgtattgaatgactctgatgtttgtttcagttgcattgtaatgtgtattagatgattaaacccctcttccttgggggaaaggtttatggtagaaaaatttatatggtcaccatatgtgtgtgtgtgtgtgtgcacacgcgtgtgtgtgtgtgtcttcattgcatgtcagagagtgaggccaaacatatgtttcaccttctcactatgaaatatggacattttaatttctgcccacttgtggccctgtttttttccccattcttaccatgtatgtgtattgctcaggaaaactgatttatgggattaattaatgtacttttaactgggttcaaatgtactgtctcatctctgacttttgtatgtttgacttttgtcttctgattataattccatgctagaaatttgcttatagtcgtccttaagcaatagccaccaaaagttcttatggagactcctggaaatatgcttctgttgtttgctataaattacatttcacaatattgtagtaaaatataattttaggaaagtggtacaattgcatgaacatcaagtatctacacttattaacaccaaacatttttctcaaatgtatttttgaggtttattgcctagataataaatctatacatggagtattcctttaaacataaatcccaaaaccattttgctttgcaaataaatcaatcaagcgtgtgactcagatacaataaaaatatatggagggaaatattatatgtgataaatagtaaaaattttgcttactaatgaagaaatttcatgagacaatttgcagcccacatattgtagttttgatcaaaaagctttatacgaaatccagaatcctttaaatcacagcatggaccatagaaatgtgttttatttaagagactttaattcaagactgttgttttaaatcatgattgcatctttatgtttcattcaactcacatgttaagctgtgtgtgtgagtgtgtgtgtgagtgtgggcgtgtgtgcttgtaagtgcatgtgtgtgcatgtgtatgtgtaaattacatgatgcatctgggcactcattgcagtatgtcacttaaaaactttaaaaaaatgtttggagttaattttgttccaagataattttatgtgccattagttcatctcatcgtcttatataacaaggaaccaactgatgcaggttttacctttttagctaaagaattaggagatggccgggcgcggtggctcacgcctgtaatcccagcactttgggaggccgaggcgggtggatcatgaggtcgggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaagaattaggagatgtttaaatgttatatcctgttttccttgacaactataattttgcttgggagatgattaccagaatgactgctaaattactatttttctattggtctaatattttattcttatgaaaaatgttatttctagtggtctttattgaagaccagttgatgagggtcctcctaagtcaggggaaagagtgtatacgtttcatgtaaaatatccttcctctttgtaacccaaacctttgtatagcttggtttctctttcttagtctatgttgacagcagtacaaatagcataatagattcttctctgtatatttagagggtttttttccataaacttatgtgatactttgcttttactgtgtaggaatgatgaaaacacacaacagacccaccaccacctccaaaattgctgctgccattaatcaactcagtgcatgacagaaattatgaacaagtttcacaattttctcttttcttctttgacttttgaataactggtagagttttattctatgtttcatgtcacgggagaaaggaaccacaaaaatataactaatatgagataaagcaatatttgggttctgactccagcaatacccttgaagtcaaataggagcatgtgtggtagaaaaaagacgtgttctccccctaaaactctgacttgcttgtcactgtctcagcagtgacttgcaattgcaaatcattgcctgaataattaagcagcatttctgtggcctgtgacgctgagaagtgaatgctaaatatgtagtcactgagctttcatttgcttactgtgccaaaagccagtgacccaggaatcacaagtgactactgtctagctgctggctgtatgctgtatggatttttgtgctacaaatcatcatcaagtgtagactacttaaaggagctcctgtgaaattaccaaagaaataaaataagttagtatagtcatcaaggagaaatatagcatatattatactgaaggaagagaaagaccctctcatattattttatattgttttatactcagtacctgttttaagaaaaaacaacaaggaagtaaaaccaaagacaggcagtccggcgccaggcccgaaaccaggcctgggcctgcctggcctaaacccagcagttaaaaatcaactcatgacttagaaaccgatgttattcatagattccagacatcgtatagaagaacattgtgaaactccctgccctgttctgtttctctctgaccactggtgcatgcagcccctgtcacataccccttgcttgctcaaatcaatcacgaccctttcatgtaaaatctttagtgttgtgagcccttaaaagggacagaaattgtgcattcagggagctcggattttaaggcagtagcttgacgatgctcccagctgaataaagcccttccttctacaacttggtgtctgagaggttttgtctgtggctcatcctgctacaatacattgaagcgttacatccaagatgtcaatcttttccctgtatatttaaaatctctgcagagaaactgtcattttttaattatagcaagtgcataatgttttccttttagttaatgcagagtgaaatatgtgaatgtgcaacaaaattgctatatcatctaaatgtctgttctaagcactggggataaatcagtgaacaaagcaggcaaactttcaactcttacatcattagtaaaagggttaaggtcacagatgattcacaagaaaatgtatcattgataagtcgtctgaagaaaacacaaaattgggtgatggagagagttgacaaattgaagttgggtgatcaaggaaggtctttctgaaagggaattgtgagttgagaccagcatgacaaaaagccagatgtgaaattttagggaagatggatttcaagcagaaaaatcttcttgtacaaactcatacaactgcttctttgttgtttttttaagggacagagtctccctctgttgctcaggcagtgacacaatcaaggttcactgcagcctcaaactcctggactcaagggatcctcctgtctcagcttgccaagtagctaggaagacaggcaactgccaccacgcctggcttgaagttggtgcaatttctcagaacagaaaggaaagtgtgaacagaacagagagagggaggaggagcatagagatgaagccagtgaagtaggcaggggccaggttatatgggatcttgcagagtatggtgagtggtttagaatctcctctcagtgggatgagaagccaatggagtgacggacacgatctgaattatgttttttaaaagcactttgctcttcgtttgcagaatggaatgagtgagaggaaagagtggaagcaggagaaggaagccacagtggtatccaaaagaggaaaagtgggttagcctagggtgatagccagagcactcttttaggagtctcccaatgatccttgttctgaaatgcctcctgcctctgcagaacaaaatcctttccatgtaaatagttcgtgttttaatgcaaatgggaaggatggtgtacttcctccacatctgtttcctgttgcagggcttgggactgtcagtgctttttctccacatggaggttattttgaaacatccaggtggttttgatcaaatcatgtattcttagaatattattcttaagcttcaataataaccctacagatagaaagattaacataaactgactaaagaaatgttaactgccaggagattaaggcaatatctcaattcataatctatagtactttggggttaagctttgacttgcaggatgtaatttactgaccagtaacaaagactccacctagctggaacctcattccagaaatgtttcttttgataagattcttagatactgaaacatcatttttaaaaagctgtgctttgggaaatcaatttgggggattgtatcaggaattacaggcagcaatagcttcataaatgtgcaacccatgcagcttcccagggcctgtgcttagcaaggcttcacacttggtttaatgctgtgccttcattgtcttgaattcctaataattttttaacaaggggcctcacagttttcttttgtaccaggcaccacaaattatgtagccagtccagaattcagggctcaaaacactctatgaaaatctgttcgtctgctataagatatagaaagatagagacaggaaaggagcagacttgaataaaggaattctcagaaaagcaaattcatcaattataaaatttgagactttttagtctagtggttctcaggtgcctgtttacagtccatgcccaccagatttttacctctccatagcaaaatcacaagaatgatgatgccattgggttcttattttttagctaaatgtattcaactcaaatgtctgctctttattctgagattagattcacctataatttttgctgtaaaaatattttcgttttatataataacatgttggcaataggtagaagctttttctttgtatttaaagtaccttctgtaaaagaaaacttgaccatctcatttcagctcaatgcttcttggcagaaaagaagaagtcctttatcccactcctgtacctttacctgttttttctaatcccaggctcacttttctcttattgtaattattctcaataccaatgcctcaccattcacaaataactaaactcagttttgtacaactgagtaaaaggtaatcagaaacaaatccacacgaatattagaacttctggcaaggcaaaattgaaattggggaaggattaccctcttgcaaccaaactacttatctttttttatagttttattttataaatccatcctttttatgccccaaaggatagcaacatttttcttttcatctttgtgtctccagcatttagcacagggcattgtactcaataatccttcaatgaatatgtagaaactaaataaatataaataaataaaaattttaaactagaaatggaaggatgtctctcttccatttacaccttctttggcagtttcaacccttccttagccagagaacaataatgaccgtaagaaatgttaataaagatacactacatctgtaacaggaagttaaaattagacattttctctatttcagctaaaactgagaaggtaccttttactccctcatttcaaaatgaggcatgagcccaccaaataaagccttgaaaagctggtagacagggactgatttcatgacccttggctgaccgcccaatacaacagtgtggagattagagcaaggttttcagagagggctgttgttgatgttctgggaatcctgtcctatcccaacccttaagggtaaggggtgagggatgcctttaccttatcccaaataggtaagagccttcattgaaacaaaccaaagagcttgggggaaacaatggcttagactttgagtcaaatacgagaaatgaaaagggggagagactacagctgcttggagacctgacaaggggatgtaaagagctgccatccggtgagtatgctgaaacctgcggggcaaagaatgtttcgtgttggcaagatgtggccttacaagagagaactggcctgaaagagtcttggatcttgtccagaactgtcctgcaagaatcttagttctcttctacctgggggagggaggtaatgcgagcagaaagaacatggaggtctactgtcagagccctgggaaggagctatgagtgaccagtgggaagagctgctttcagtcacaaagagcaaactacagatatctctctagtgaggagaagacaaagaactcctaaaatatcccacccaacaagagagagtcagctttaaacacctaacaaaatacaaagagctgatgccagcaagtaagatccctggaatctagtacagtgctttgaacatagaagggactcaacagatgttggggaacacaaagacctgttccctcgttgggctaatgttgcaggaatgattctcagctttgtacacatgaaggaattatgaggttcaggttaagtgcctcacttcaaaatttaatttttagtccagaccagtgttgttttaattttactacactcacagttaagaggagtccagaggagcacccttgaaactatagtgctaatatcaagtttgtgatgtagagcaactaagtgtttctgagagggcttcaaggcatcctttcctgtgctgtttttacgttccaggttattaagcttatcttaggtgaagtcaagctttaagtggtagttactatgtgcctggcagaatacagggcactgaaggctcaaatgagaataagacaatccctgacctcaagtggctgatagcaaatggattaaaggcaattgtttatcatttacttaatgtatagcacgagctcaagaaatcttacatttctatagttacattactgtcactataacattaatagttgaactaggcttcccaacagatgtaaaagccttctaatctagagataaataaagattgtactttttgttatcatcagattttattattctttgatgatgattgactaaatatactaatgaggattgaaaaatatactgctttaaatagttatgtcataatttctatcagtcatgcaattagaagtacatatatggatacatattttttctattgccccttttttcctggctttgttaatgtataatatattgcttttctgcattcactctccatttgatttttctcctaatgtaatttaccacctgcagaagtatgaggcctggaaaatgcaggtgtgaaatgctcattagcacaataccaataaatcaacacatgtttaaaagaatcttctacctaaccctatttcttaaactgtgtattcagtcataattttcagatttaaaaattggtccaggttatagatcaggagatagctgtatttttacataactattaggaatgctgtggttttctaaccagagaaatatgacagtaatttcttgcgaaagatttgggacattgtgactgagccaaactaagaatgaaagaagatggagaaaataaacataaccacatgtcctataagtcttctgtatgaagacaggtgtgaagcctatgaggagggggtcattgattcatgaactgattgattcactcatttattaattcatatagtatatgtttttggtgtgcatataattgcaaagcactgtattggatacataaaagaaatctacttccttttgaagtgacttctaaaagacactccccatcagagtgtctaatgaaatgagagagacagaacaaagtggacatgaacaaatctgttggtagactttatgataaacaccatgagaagcaaatgagcagaatgcagtgctaaagagtaacctggggtgaagtgggagctagggaaggaggatgagagacaacctacttaaaattgtagggatggtctttcagaggagacttaaaaaataagaagcaatcagcaattcaaagagcattccaggtggaggtaagagcatatgcaaaggccctctggacagaaagagattcacatatttgggaatcttgaaggatatcaaggcaactaggacatgggcaagaaaagtggcccaagactatcagggcactatggaccattgaaagatgcttagaaattcatccaaccacagtggaaagccattcagttctttaaagtcagagaacaacccatttgcttgatgtttaaaaatgcttgctctggttgctatagcagagtaggtagtaggggaccaaggtctaaccagagagagcagcatggaggctttggtaacagtcgagagaaatgatgactaggaaatgaagaaacttaagatataatttggaggtataatagaaagggtttattgatgaatcagagttggaaagtgttacaaaggaaaggatgaaatatccttcaaggtttctgtcatgagcgactgtgtaggtgcctgctggtgccatttccagagattgggaagacaaggaggaaagtcagggtcaagtttagaaatcaagaatttgttttggacatgttaagtataaaatgtgttgcatgtaatggataatgccaagtagctagctgaatatttaagttccaagtgttgaggaaaactttggaggtaaaaacagagagttttggccaggcgcggtggctcacgcctgtaatctcagcactttgggaggccaaggtgggcggatcacgaggtcaggagatccagacaatcctggctaacatggtgaaaccccgtctctactaaaaatacaaaaaattagccgggtgtggtggcgggcacctgtagtcccagctactcgggaggctgaggcaggagaatgttgtgaacccaggaggcggagcttgcagtgagcctatcacgccgcagccctccagcctgggtgacagagcgagactccatctcaaaaagaaaaaaagagtcttcaggatataaatgtttaatcccaaagaaatagactacaatatctagggaaagagtgaaaatagagcagagggaggcccaactggaccaagtggattaggcccctggatattccaaaatacttagggattgaatcaaaattacaaaatatttagaggtcgaatagaaaatgaggacttgggtcaggtgtggtggtttatgcctctaatcccaacaagttaggaggctgagatggaaggattgcttgagctcaggaattcaagaccaagctgggcaacataatgagaccctgtgtcttccagaaaaaaaaaaaagttgggcacagtggtgtgcccctgtagtcccaggtccttgggaggctgaggtgggaagatcccttaagcctaggagttcagaggctgcagtgagctataacagctgccctccagcctaggagacacagtgagagcctgtctcttaaaaaaagaaaagaaaaagaggcttattcaaggaatagtgaaaaagggaatatttggagaattatgtcagggaatctatgaaagtagaatgtttcaagatagagggagtggttaaaaaaagttgagtatttatatgtgccagtgtgtatcatgctgaatactttatctggatggtgttatattatccctcctatagactattgagttgagtactgttattagatccattttacaaatgaggaaactatggagagattaagtaatttgcccaagatcccataataagaaggcaagtgtcgaatgccaggcattctaacttcagagtccatagtcttaacccttgtgctattctcttccacaaatacacccagcaggtaaaagactgagaaaaataaatatcaaaaagtaccttttgaaattgactacatgaagttacgaaaacctgagttgttttgtgaaagcggtgagtacaaagcagtattttggagagggttgtgcagggaatcggagatgaagctgtgtgctgaaaaggagagaagaaattagaggaagggaatggtggccttacagagaaacagacttgaagtgatgtgaagtgtttgcgctgggtgaatgctggcaggaataagtgagcagggagcgagtgaacaggataagagagatcacttcggagtaaagccttgaaaagggagtgtaggaggaagtttttctccctttcctgcatcccttcctttgtgcgtaaaatagaaatgttcttcctttctgaaggatttcaaagagaatgttggcttttctttcattctccctgactcatgcctccccagaggaagaaaagtgacttctgaggctgtgaaaaggaaggactctggctgcatgacccagcctcctctggcttcttcttttgggacctgatggccctcagcatgtccatcttaactcctgctccccctggggcaatctcaccaggacactgcttctccaagtgccagcttggggtggggtccttgccccctgtgtctatttctcaattagttcaggacttacagaaggaagagagtggttagtacattaaaacccccagtataaagagggaatgcaattaggtttagagaacatgtggagagattggctttggcaagaagaggatcatgttctcttctgtaatagaaagaaaagttttaaaataatggggaaagataatgtttatagagtcactgctgagaagaagaaaagtgatttctgtaatgtaatttttaacattttataattttttttctgaataaagtctgaaatccaacttggttgtattgggagcactacatagctttcatgtgtgaagccactatcatctaagcagaagaaaactagaacagatacacctagtgattctcaaactgaggaagaggatgtggcatgccctgtctagggtagctaatccgaatttcgatagggcagctttcaaaagaaatcatttcaatcaacaatgtaatcagtaatgcaatcgtacatttttaaaaaccacaaaatgtcatttttacttaaaacatttataatgacttaaggatgttttatattcatcaataggatgatttagtttgaagaagtcaagaaacaatgggttacccagagtgttttccacccaattcctgaattaaaatgtagctaagaatcatattttctgtaccttcttttcctgtcttttgtgtcttcttttggggaaagttaagagggtagatcgttggactacattgtcattttaactataaaccactggactttggcccagattattattacctgcagaagctatcttgattaagtttggagttgccttatgttgtgcataagcaaaactacattttaatcagcttgtccatatgatttatagagatagtttgtaataggccttgttaaaaataggtatctttaatcagcaatattggataaaagcctaaagtcttaaaatagtcatatttattctgattccttcttcctaaaatgaataaacagaaagaaatcgatgtggcaatagcgtgttacaaatcactccatcaaaggtaatgaaattaaatttcatctctgtgagttactgcaaaagactgtttaacatttacaagaatttgacttccaaatccttcaagccctaatctttggatttacataatgtgttcctactttcagccttttccagttgaaagactttgaagttccaaggcaaaaactgaaataaattggaaatttgtgtaatttcaaagtgaatgcttgtgatatagtgacataatcagaaagcacatgagggaaaacccatacaaattttgctactattaactcagtgtttgaaactttatagtagaaagatgatatgcaaaattcttaaagattgctccaaggaaacatgctacatatttctaatcaataaaattaaaatatctgatcactagtttgttgaaagcgttagatcctggacttaaatctagatctttgattttagagcccttgccctgttttgtcccccagggcactatagaaaatttttgcatgatgatatcaatttatcaaaactgcagagtgtttatttagaaattataaaatgacttagtgaataaaaaattgaggtattatttggatttatcttagtattaatggtggagaagaaactgtttcttttatctaagctccaacaaacattctttattttttctttaatcagagtctcgctctgtcgcccaggctggagtgcagtggcgagatctcagctcactgagcctctgcctcctggattcaagcaattctccttccttagcctccctgagtagctggcactacaggtgcacaccaccacgccccgctaatttttatatttttagtagagatgggatttcaccatgttggccatgctggttgcgaactcctgacctcaagtgatctgcccacctcagcctcccaaagttctggaattacaggagtaagccactgcacccagccccaacacatattcttataatgggatagggaggaggctatgttatgtggatgcattaatttaatcattatatccactaccaaatatcaagtcttttttttagtttattttcataggtttttatatgtagacatgctttcttctttgtggtttttcccctgtaatgaaaccattcattcattcaacaatttatttcctaagtgcctactctatgactagctctgtgctaaatcctaggaatgaaatgatgaacagactagaatttccatgaatgtagtaattaagttgatctggtggtgtgcacttctaatagaaaatgcttctctcatattacctctttctctgaactgatgcaagaattggaatataaacaaaccagctggcaaacttagatgatttagatgtccttttcattaaaggtcagtaagaaatgctaacgttttatgttagcatttattaaactctgaagaggcagaattagtttggggtttaatttctagtattcatagcataaaattaggtataatagcagtgaatctatgtatgcttctatataattattattattctttatactggcctagcccttcacagagttaaattcaactacatttaatgagagaatttcttgtttttttgttagaatttctagcaaaccatttctgcatgtcattgcacctgtggcttaattcttacattttctgttctctgaatttccaagatagaaaagcataaatttcttagagtgaatacagggttagaaacacatcttgttataacaaactatctagtttcagcatcccattaactgttccaacaccaatttgaattcccaaaggatacttctgttgaagcatttttgctttggtttggaattgcaaaagtagattgagtaattcccgattccacgttaatgagactttctgtcttaatcctcctgtttaagggcacaaagaatagtatggccactgcaattactgagtgggctagaattggaatattctatacccccaagggattgttttcttcttttaaagcataagtttccaatctatcatttcttctgtggttgagtttctgaacatgcttgggttttgctgattttatggtttgtttttagctgctgatttttagtcagactgtataggaggggtaacaaaaacccttaattttgcaatgtgaaaattctttatgcatttgctcccgaaagcttatttttgagtaacttgagacttttgcagcagccacagtatccaacttggaaaacctgcattctcagcagctttcctactttaaataatattcttacattagctcttttaggaagcaaagagacagcttccctaacagtaacaagatgtgcaaaccacagatggtcttcttgctggaaattactggaaaggactacgagtgttcggcctttggggcacagtcattcacatgcattcatacacctcacacacacatacacacacactctctctcatacacacacacacacacttgtgtgaatatacaaatgaataaggcaaagtgagaatgtgtatagctactactagtatatagatttctgtggaattttatacactgctttaatagaaatgaacatattttatgtttacaatagctttcttaggtagagcaggcagatatagcatgaataccattattgtagataagacttagatagtccaggtccttgcccaagtgtaagagctgaagtttatctatttctcctaattccagaatgtggcctttggttcaaaatgccctggttgtatttcagcttttctactttctagttccattactttcttaaagcctcagttgatacctctaccaataggacatatgctacctacctcataagcttgttgtgatcagtaaatgaaatattgcgtgtataacatgtggccttttacctgatacattataaatgctcaatgaatgttcatgtttgctttttcaaagcaaacatttatacgatacttatgccaaatctaagtactttttcaaatattagtctaatcttcatgtcaattttatgacagatattgttaatattcccattttacagatgagaaaatggaggcaaggaaaggttaagaaaattgcccaattgcccaaggtcacacagctggtaaatgccacattatggattcaattccagataatccagtccccatgtccatagtcttaaatgctattctgttattctcaatgtacacagtgggatatatggaaatgtgagttgtatatgctaattttatactgctttaaattcctaaggcctagggaatattcccatatgctatagtgggttttctcaactgttgctactattaccaccaatatcttaggactataataagtggatagaagaagatctgtttttttttccagacaactacagaactcaggaacatatccaactagttataatccaggcacaatttgaattccacttgatgggagaggtgattccagtgaagaactcaattaaataaaaacacttttttatgcgtttcagtcatatcatgatgtagtttaggctcaaggtagagttgtatcatgtagtatttagaccagattacaaaactattaagagatgcagagcatgatagacgaggaaagatgaaaagcattgcttggttatgacgtgaggggatgatgatagaagggtggagatagtaggaaagagaaaaccccacagatgtgagaggaaaagggaagataagacaaaaaaagtaagacaagtgataaataatggtttataagggctaaaagtgaagaagcttgaagaaagatttgctacaaagaaagctattgaaataaagaattgacccagatgttgggagaaaccctccacagtgagcagtataaagccacattcagtcactgttggcgtttgccctgggctttgggatgtacgttcattcatttaagccaaaaagtgcatttatcctactcaaaaagtgatttagaaaatgagtgtaagatttcctatgcttctagtaaaatagaaataaattatgcaagagtaaaattagctaattactgtaagaatcattctgttaaaattagtgagttttggatattttctgccagttctttttttcactagtttctgtgacttcagatttcattatcaacctaccaggcctttcctgctccttggagagctggttgaaatgggattgaaccctattttcacagagtaggaaagtcaagatccctcctcaaattgcattaccacttcttgtccttactttttcatggttctctggtttccatctatgctcctgagtttgctgtctcaggtcaaacctgcgtggatttatacacacacacacacacacacactcaggtgatctatctgatgggtttagttgttttctgaaagatttggggattgtcgtgaaagaaataccacattgcataccacataagggacttgtattcagttagttctcttgttatccttcactcctccctcaaaacccacactccagaatgagtcaagcctccttcaaaatgcagtgcagtccctgcaggttcagtgtttatcgaaagtggtacaggaggaaagaagcctgagaagcggatataatttcctcagcatccctgggaattgtgcagaacacaattatagcatcttacatactcttacaaaatgattggaacttgcatttatagagagcttcctgtgtagatgctgtgctaggcactttcacatatggtgtttattgattcttagaacctttctgggtatattttatacccgttttatagatgaggagagtgagtctcagaaaagcacccagcattgttaccatgctgaaggaaggcattggaatacatgtgcagaggaataagattgttcttttcttctcaaaagcagaaggacaagaaaaagcaaaaattaagacaaaccagtctgcttataggagccatgccaagagagatgtcttcttttccttatttcctagtctctgtctaaggcttcagcacccattttcctttgggaatgcaaagcacattcaacaaagaacctcgcagtgcctattaagagcttatttttgtcttcatttttaatgtttcatttattatcaaatagggtactttatctcgtgcacacctatatgttccattatgccatatttacatttgtttaacgcatttaattaagaacattgttaaaaatttaaaaagacttcccctttcacgaaatttggaaattgaaggtagcatttaacgggtttccttgtcaaccacaatactcatttttagaattgttagccagtaattcaattacccacacagttctgctttctaagaatgtgcaaatggaagtcttgtcttatgcaagccagaaaacctactagcagtattctaaacttagaacaaaaacgtgatgcccttcgagtcttggttgggaagagtgtttggtgaggagggggagaaagaagaaggggaataatagtgtcattttctgtttgtctttggccatctggagctcagtgccacgtcctttgctcattctacggagaatataaaaagggcaatgagatgcttatatattttgtagtgctggcagagcatcatttgttataatatctatccctttatcaaatataagccatcatataagccaatatgagactttagatcaattctaaaatgggccaatgtaaaatacaaacagtttctggtgataaaataatctgctatgtgaattgaaggtaaaacatttataaaatgtaaataattgttaataatgataattattgctgagaacaaaagagcagctggctttttgtataatttcacacctttcctttaaatatttactcctctgaaactgccttcccccaaaataacttactttatattgaaacttaaatttaattttgaaataaaatttataggatcaactatagaatattgacattttgtatgtcaaaaatggttgaatattagggatttcatcaggttcaacataatactgttagtgcagtctaagtcttggcgtgtgtaagtgtgctctcctggaaagccatgctggtccaaataaactttgttgccttggtgatctatagcttatttatcttcttttttattagttgaaaaataaaaattatatatatttatagggtacaaaatgatgttttgaaatatgtatatgctgtgcaatggcttaatctaattaacatatgcattacctcacatatttattttttgtggtgacaacgctgaaaacctactctcagcagttttcgaaatacactacattggtatttaccatagtcacccatgttgtatagcagatctcttgaacttatttctcctgataaaattttatatcctttgatcaacattatacccatctaaattccttatatccttcattctactctgcttctacaagttaaactattttagattccatataagtcacattgtgtggtatttgtctttctgtgcctggcttatttcatttaatgtgttccaggttcattcatgttgtaaatgacaagatatttttttcaagttcagtagtattccgttgtgtatacatgcaagttgtttcttaaactgctttttttattattaatcttaatgccttcttaggtgcgtatagtacttctgtagcttttagctctagtctgaaaacacctaagataagaatggtgttattgggaggaacaaggcattaggaaaaagtagataaagctatacagtgtaaatccatgtttcctcaagtatatgacaacataggtgatttttggttactactccttgaaggactccattcagcttgcttaactgtgagatacagctttcaccctaatttccacaaagcagctcagagtgattcttttaccatgtgatgactgctttgctcaaatcctctcttggcctcatttaagaaccttgaagctctatatgatttggcctcactcccctgccctcaggaccatcttgtttaacttcatctccagcttctcactccctctttttctctgttccagccattgtgccctccctgctccactaacatcacatacaagtctatttctgaaatgctgctccctcataactgctccctcagttatgatcatagctcattccttcagtctcttctcaaaagtccaatggtctatgagccctacttggctgtcccatatatagcagtacaaatgcataccttcattccctatctcttttactgtgcttgattttaatccactgcactttttgccacctaatttgttatatattggcttgtttacttatcacctgtctccctccataagaataagggctctaggactacagttgttttgcctgtgttgttcactgtgtatccctggtgcccagaacagtgtagggtggagagtagccattccaggaatgaatgaacagttcatttcagctcatgagaagtagggcgctggatagggagaacagccattcccagtggaaaaaaagggttgttcattaaatgtcactctactctgtcagtttctaggagtctggaatgaaaagagcttcactctatttatttttattaccacctttttgtggcaagtagtcattggcaccatatataatcttcattgtaaatgaatacagtagtaccaccttatccacagtttggttttctgcagtttcagttaactgcaatatagtacaatatgatattttaagagagagaaagagagagacctcattcatgtaacttttattacagtatattgttatagttgttctgtgttattattgttaatctcttactgtgcctaatttataaattaaactttatcatatttatgcatgcattgaaaaaaacatggtatgtactgtatagggcttgttactatctgtggtttcaagcatccactggaagttttgaaatatatcccctgcagataagaagtgattactgtatggtaaaagtcaatttctcatgaaaatgttttattgaaagtataacatatacccagaaaaatccaaaaatcgtagatggttaaatgttcacaaagtaaatacatcctggtacccagtgcccagatcaggaaacaaaacattaccagaatcccataaaccccttcatgttgttgtcaatgtaataactccccaatgtttagcctaccattttactatcatagatagtactgcttgtgtttggacttaatatacgtagaatcatagggcatgccctcttttatatctggattctttgctcaaaactatttttatgaaaatcattcatgttgctgctaatagtcatagttcatgcatttccattgctgtataaaattccattctaccattgatagacatttgaggtttttttcaatttttgtgtattacaaatcctgctgagattaacatccttgaatgcatcttttggttaacacataaaaatacatgccttgaacttcattcaaaaatatattgccagacatttttccaaagtaatgttaccagtgtgcaccaccaccagcagggcagaattccaatcgcttctcatcactgcactttgtatcatgtcttttacattttagccactgtggtgggtgtggtgtgagtgcaatgtagttataatttgtattcctcaggactactgctgttgaacacttaaaaatgtacttgttgccaatctgagttacgtgaatctattttcatggatattaagataatataggtcgtatatggataaggtagaaatcatataggtcataatttaatgactaaaatttagtagacattgctttcattaatgactcttttagtacttgatagattgtattatcttcacaaagcttttgctgtggaaaattcagttcaatagaagctaattgtgggttaattatgaataaccctccatgctgaatggtgtgaggctaccaaggtccacgtcatgggaagcttcccagatgtcacgttgaagctatgtctaacaagcatgaacagggtctgcaagcaaggcagaaaagggaagccaacgtactagaaaagcctaaatcatatttgaaggtatgaagaagtatgaaacttttaggaaattgcaagtgttcagaaaataaagaaaattgccaccatcttgtttatagggaatgaaagacttgaaaaatgacacttaacatcagcctgcagaagtaccaagggccaatagtaaattggacttagggtttaattacattagttgtgtagcttgaaatgtttgaagttaactcaccatcatttacaatgatttgtatgccaaaggaaatatgcatgagcagggaaatatttcctggatagctttttgctttccatgttaggccttatgtcagctatctaaaatgtagaagtgagcaacacatttattgttactgagaatgcatagtaaaataacatgaattctatcatttttacagctaagatgctgtatagattaagcagaaaaacactggcagcctctgattaaaaaataatgattttattattctttttggagttaacatttatttttaactaatgtttcactgtattaaaaaattcctttcagaactaaatactatagtcaaatacattatctttgacactatattttaattggttattgaaaaaataaaagctctttatcaccttatattttaatgcaatctttcaaaatgattaggcagaagatatttttccttctagtttcaaaaatatttgtagaatttttcttaaaatactgtagggaatgtctatcatttctgaatagatgtggttctatctcaaggttaaatataactcaattgttgaaaaaaaattataaacatggaacaaatgtgtctctagaatcaggattcatagcatgtggtcttctttacttgtaggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattggtgagcaccagatgttttatgcaagtgaatagatgaaatctacctaaatggcattgagaatttctgggtctgtttagttaagtggctccttgttataaaacatgtaaatctttctgatggtttatttggacattttcttatgtggtctgaacataaagatggaaaactactgaaaaactttcagcaaagttaaataaaagcaggcttgaggaccttctatatcctaacctaggggaagtaaatatacatatacgtacatatacgtacacatatactatctctctctctcttaggtttttcaatttttaactttgtgtgctattttcattttagccattgttcagccagcacctttcttgttttttgtttttgttattttcattttcccttcaggctcccaggtctctgaacctgttccgtcaggttgttaagactgtggttgacgttagcctgtaactaacaaagccagtaagaaagtaacgttattacattctgagagaggacagattacattgtgggtctattttgaccttgcaccttgctttactttggaaaaattgaatgacatccaggcccttcatagggaagagtaataggatatggcttgggttgtgcaggcattacattatttcccccagatataatgatatcctgtaatttttgtattttaacatttaatcagacagttgtaggcaatcagtccaaaccaatcaaattaccaactttagtgtaccatattagcccagcatgtctttggccttgctttttaatgaacaatagcagcttttagtgtcttcagtctatctgagacaaaagttactaaacatctagtatatgggaaagaatggtgtgtaggggagacaaatccacccaaaaagagtgtggctgctttggccttgcttgttacttcaatttggagagatttggtcacatccaaaagctgtaatagtagagactgtggcttaatgggttaaccagtgttacatcaaagagggcctgttttctttaaaatttaccatcctcaccactccagtatgagactgtttgctttaagatgattgaaatctttttctttgattttttagtagccattcctagaaatgatcatcaggagaccagatttctagttctattgaaatctttttctttgattttttagtagccattcctagaaatgatcatcaggagaccagatttctagttctaattcctacaacaatttcctgtgtgactctgtcaagtcattttccaatgtctttgggttaaattccttccttcaagctgaagaaatgcctccatgtaggtttagccttatttcagaatttggctgctaaaaccatgctttctctttccaccattttatgtcctcttcttatatattcattctcaggcttcctttttccagatggtcaagtcttattttctaaaaggcaacaagtatggtgtcaatgagactgtccatagtcaggtaatgagaattaataaaagtgtagacaggcacatatttccatttttaaaacctatgctagcacagttcctcaaatcaattgactagaaaatctcacaaagtctacataactctctccaattaccactatccttctctcctctgcaacatgtctgtcgccttctattgcttttctaattagcgaaaaagacacaattagtattttttccttcagcaaataaagcttatcctacaaactcaatgttccttaaaaattagaaaaaaagggagagatactgaccaacttggccaccatgactaatgggctaagcctagaaaatagaagtctcaaaaggggtggattgcaaaaagatgaacgatgagttattttaaataataccaccactcatgaattcttcactattgaattggtaacaatttgattcataatcaatgggagtggcatgtctattgtgttaaaagagacatctgaactgttaaatatactctatctatataacccttttagtaatttggacctggaaacattattttcaaggctaacatattagcaaccgtataatcaccggtattgaaagttccctttacaaaacaaatgtacttctatgtctcttagtaaaagtattagtaataaacaataaaaattttcatttattgataatttcatatgccaggggcaatttaagctcctgggttttatcctcaattcaccctcacaacagcttggacaggtaagtgttacaccctatttttatagatgaggatagagccatagatcatttaaagatggggtcatgagctgtagagagcaggctctgcaaattaaatctatgttctcttgtgacccgtcagaatcaggctttctctgactctcaaaggttgccatccctgcgctataataagctggaggagtgttgttgtttgagacggagtcttgctctgttgcccaggctggagttcagtggtgcgatctcggctcactgcaacctccacctccagggttcaagcgattctcctgcctcagcctcccgagtagctgggactacaggcacatgccactatgccctgctaattttttgtatttttggtagaaacggggtttcactgcgttagccaggatggtctcgatctcctgacctcaagatctgcccacctcagcctcccaaagtgctggggttacaggcatgagccactactcccggccagctggaagagattttatggataatatagtggagtgatatttttaccacaagtcccagagaatctcagtgaaggaagccttgccaacgaacgaacccgtctacaagccaatatgctcattcattgaaagatatttttcaatatctcagtttagagtttatactcctggaaaactctaggagccctcttgtggccaagtaagtgcatttaaatttagcaatgaagtttcatactatagttactatatacattcaagcaataattttagggcttaaaggattttcaaataaaaaataataactagaaaaatgttacagccattgaagtgtcttttagtggctgcagtggcttttctagaattattttcctagaagtacagttattctttagtattcagggagtagaggggattggttccagaaccctcacagataccaaaaatctgcaaagcccaagttcctgatataaaatggcataatatatgcatataacctatgcacatgctcctgtatactggaaatcatctctaggttacttataatatctaatacaatgtaaaagttatagaaatagttgttatactgtatttttagtcagtattgttttatattgttgcattgttactgtttattgtttttactctggaatattttcaatcagtggttagttgagtccatagatgcagagcctacagatatggagggatggctgtataataaaattccattgatttagaataagtaggggaaagctagtcactattgatgtgaaataaatgaatcttcagataaaaggaaagtaatcaccatgtcaggctgtggttcaggaaagagcattttctgccctgcttccatcactaactgtgtaatctggcacaagttatttaccatcattttaccttaatacttacatgtgtacaatgaaagagagaaaccaaatcttgtctttcagagttgtttttcttcttactctctttttatgatcacaactgaccatagaaagtactgtataagttttctattgctgtgaaacaaaataccacaacgttagcagtttaaaataacaccgatttatgaactcactgctctgtagttcagtccacacggtatgactggattctctgctcagggtgtctcaaggctaaagacagggggctagctgggctgtgttttcatctggagtttcaaccaggggaaaaattgcttctaagctcattcttattgttggcagaattcagtcccttgcaattgtagggctgagctacccgttccttgcttgctgtcaaccagggaccactctcagctcctaggggccacttgcttttcttgtcatgtggtcccctccaccttcaagtaaagaacttcacatcaaatctatttcatttggatcctctgcctcaaccaaccaagaatactctctgctcttaaagaattcatgttattgagtcaggatcacccaggtaatttttctgtcttaaggtccacacaacctaatcacaggaataaagtccatcataaattccagaccctggagttatgcaggtatgtacaccagaggggtgggagatcttggtgaccattttagaattctgcctatcacattttacagcaccacctgatatatacacatgcaaataccaatatatctcagatgaaatttcttaaaagcacttccattactattttgactacttatagaatggaatattctatagaatatgaaatagaatacaatattctatttcatttttttaaaatacagtctcaactcactaagtttatttcatagtccattaatgggctatgacctgaagtttgaaaaatcactggacttgatatttgaaatccttcagatacttaaacttctattattctttgaaaaatagaatggttaattagagctagaataaaaaacattaacttagtggagtagcactaataggtaaatagaagaaaatggagtggaaatttttttttttttttgagacggagtctcgctctgttgcccaggctggagtgcagtggcacgatctcggctcactgcaagctctacctcctgggttcatgccattctcctgcctcagcctcccgagtagctgggactacaggcgcccaccaccatgcctggctaagtttttgtatttttttagtagagacggggtttcaccaggttagccaggatgatctcgatctcctgacctcgtgatccatctgcctcgacctcccaaagtgctgggattacaggcatgaaccaccatccctggcctggagtggaattttttaccactccaattattgtttgtgttacataaaaccatttgaatttgacagtgagcataagaaacatatccttcaaaaccacagcccctacttaaagatagataatgaagccaaatagtagactcagatatttgtgataatcagcttatttcactacccttcattcaaagaactacatataaggacttctgaaaaatattgtaaattaagcatggaggtagtaaagaaaactgtgcacacaggaaccaagcatgtacgattgctccctaaggtatacctgtacagttctatgtgatattgattcctcacttcagggaactggagctggaattcatatatcacggtccagcttctgcaactattagtaaaagctcctgatgtttttctatatggaggacttttgctggacagttaggaaataggaccactcttgaatgaatatccacacgatcagaatcactcagtgacacaccaaacagtgattagtccctgatcaatccctgctgtgtgaaggcctcatagaagatgctgctcagaatagaatgaaaaatgaaacagagagagccctgctttcaaggcagccatcgtatgcgttgggaaagagcgtgcctggttgaaatgagcacaccggtaagcaaaatagacaacagagaatgtcctaaatgccatagagatgggagagagggtggtgtgtaatgaatgagggagggggcagcaggagccaagggatattcagagtaccctggaatccacaaaatggagaaatctcagattgtatagatgctcagagggcctttatgggctccatagagcaagacaccctcaccatcctcctctgtttttgcttatgagctcccctggcatctgcacttctctgtgcctcctgttttcttgtgttggcatgtctgtctccatactggttctcagttcttaggaggagggaatggtgcctgcaatcttattaatcccagcacttagtgcagtgtgaggcacacagttaagtgccaaataactatggagggcagagaggatagttagaaagggttatgaatcttgtcctttgaagtggaagaggagaggagggagtctgctcagaattcagttggaggacgagcttaacatttactgtgtgccaggatctttaagcaatttattcacattatctcactatccaaagctcagtgacacagggtaatggcctcactttcatgaaaatcagaagtccagagaggttaggagatttgtctaaggtcacagcttccccaaatagcctagataggatccagacccagtttaatgtaattgcagagcaaaggctcttaaacaccacaacgtgctatctgtttacccctcaccataagtatacagctaaaagattcttctgtctgtagtccattagagaaggattggaatacctggtgtagcaaacaataagtaagataattacaacctttatgtttattttttaaaagtcctcttttattacttatgccacctaaatgctctctgcaacttcgtagaaaagccagaaaagctttcagtttagcctttcctcggcagggctcctgaataggtccaaaaggggggctcctcggctaacaggtgtttgaataatacctctggaactttccttcagttgaaatctctccctctcagtttctcaccttgtcaagggaattgacagtctatttgtcccttttaatcttgtttgtcttcaggatcaacctctcccttttatcctatctaaactaatctcactgtaacaccttcttgtaagacacagtctacgattaatcatccaatgttctttacacagccatttatagtcatttagtttcagataaatgaattaaataaatatgtattgaatgcctactatgttccaggctgtgttcaaagtcctgtgaataaaagattaaactaaggccagccctcaggtgcttatattctagttgggaaggcaggcaataaatatacaatcaggtatttaacacactgtcaagtaatgataagtttttaaagaagaataaaatagattaagtgagagaggtgatatgttattcacgtaaaatatgtttaaatcttatacaatttttatggacattctagatgatgaattgtctcagctctaactgggaactcaattggctggattcgattacaggacattagacgcattaataatagatttttcagagttgtttttcaccttccttggaatcagattagcttatgaaaagactaatggaattgatatttgcagcatgaaggagaaaatgattgaggggaaatttaatgaccctcatgcttccccacattgttttcaagaggaggtatccagatgtccatttctaccaacaatgaataaggagtgtggattaagctataatttagagtattgaaattaaatatcagggaaaatgtaacaagtattagtatatacagggaagttggttttttgtttgttttttgagacggagtctcgctctgtcgcccaggctggagtgcagtggcgcaatctcggctcgctgcaagctccgcctcccgggttcacgccattctcctgcctcagcctcccgagtagctgggactacaggcgtccgccaccacgcccggctaatttttttgtatttttagtagagacaggttttcactgtgttagccaggatggtctctatctcctgacttcgtgatgcgcccccctctgcctcccaaagtcctgggattataggcgtgagccaccgcgccatgtatagctattgtctcttcagagtggtttaggtgtcagcttgccagagggaaggagaaaattagctctcaaagatcctaatttttttgatcaaggccatgaaagctgtgtagtcattcagtgggtgtttattgagctccttcttttgctcaggaaggcaggtgaatcaatggtgaggaacttggccttgagaatctaaagtccaagttggacctttatattcctcctgctagttatgagaccataaacaaagtagttagaatctcaaatcccagtatgcctctttataaaaggaaataaaactgttgcttactgaaagggctgtggtgaggtgtaagtgaggtaatgtatttaaagtacttatattagtgcctaggacttgcaagttctcagtaaatattagtgagcttgttgttgttgtgaattaaggatagagtatgaatgaagcaccatggtacctgctctcatggagcttatatgaaacaagcctcttgtcttgacctttgtggatctgatcaagtcatcccctgtttaaaacccggcagtggttccccacttccacaaaataaggttgttactctatagatctttcatactgcgcttacctttcatcagcttcattgcagacctcagccctacactccagccaagctaaaaactctttgtggtttctcgaagttgtaattctgtatgatgtatcttgggcttttcctcctgcctagaatagtgatacctccgcctcttttagccttctgattaactattcatttgccaggattcaatccaaacgtcctttacacctggccacaacttctctaaatctgattaatatgaatacatttcaagcattttaatatacagattgtcagtcttttaggtgactaacatattgaatttactaaatttaataaatgcttataacatttttatagagtgagtggaattaagtctctggaagttaaatgacttattcatggtcctactgtaaatagtttcaaagccaagggaacaatctaagtaaaatggccagtggtaaagagctcatcctctacattgattttcagatcaaattctcttttcaaaaacaaaaatgaaattagatcattgatggagatctcattgagtggttccccaagtgctagtctataccattgatggtgaaaacgatgcaataataaaagaacagtagtttttcataagacgatacttagttgaagtgactgtcctttccattttttctttcttttttcctcttttgtcccctccctctttcctttctttctcccttctgctctttcttccaccctgtttcctctctttttccttctttccttccctccttgtgttaaaatgaatggtcttttgtgaaatgactgcttagttatggtatcagtttaggatatttgtttaagtctgttcttttaaaattattttacttgtcaaaatattaagttgggaaatggtccctaaaatattctcttaaaattgtgatggtctgtgaaattgcaaattctaaaatccaatgcaatgatcctgtcttttgccctgcttgcaggatagaataccttcaacattccaaacttaacgatgcacagttaaatacaaatttgtatcttactaaccccaggctgcttacatattgaaaagagagcctatggaattaggggttccctgggaattcttctcagtagtaggcaaaattaaaacagtaataactagtttggaagctctgaagagaaaagcaagacacatatttaactgctttttaattgcagtacaccagacactttaaaatatcatcacataacttgtacgcctctcatttaataaaaaagataaccctaaagtaacaatactataacaggaggttaaaaaataaaaggaaaaaactaatcttgctagaggtggcacattctgcagtgtgaaactaggtcaccactgacctggaacgttctctccaagttagaagattcttcatggaaaagcaggaagtctctgtgatttaatcaacagaactatcttggcatgcaggtcactgtctataagcacagaaactaaaacacatagctgctctgaggattccaattaaattaaattcttgagaactatgactttgtttgaattgaaatttgttttgacagtttgatggctttttacattttctggatcacaaaaatttttagggaaaattatttcatttgctgaggtttcttgttacacatggaagctaaaagtccctaagtggacctgggcatttcacagcttttgaagagtggttcaaagtttgtgtaagtagccaatatggaatttttttttatcaagatagtggaatttgaggatatcaagatttcaagtttagttttttggttcatttgtggattaataagaccatgggattcaatatatgtttctgacagtctacatctccatgtgcatgtttgttgggggcgatatttgattgggattttattttacaacatttttcatttatttcatttaatatctactttaaaacatgagattaaggaaatcccacaagctgaaactactttcaactctaaaattaatatgaaagctttatttctttcaagataaattagattttttttaaccaatcatttatgtaattttaactaaaatttaccaaggaaccggaggtattctcagaatgagaaaaaatatgtttgcttgatattcctataaatttgtagtgcctataatttgttaaataagcttgccaactctagttttatagcattagtaccttattttatagatttgctttattcttttttgccctgattctgtgattgttctctgtcagaagtaatcaacccagaatcaagaaacacagcttaatcatggccatgataaacagattaagaaatgtcagtaaccctgaggtctccttgagcaaatggttttggtattatgtctgagctacagcctaatagtcttataacttattcaaaaacaaattatatctgtcaatttatttaatgatttctaaactgcccaattaaacctatactggtttaatttatggaataattaaaatggacattgttcatggttgagaaataagcatgatcctgtttgaaatttcctaaatcactattaaaattagtctttcactgctgttagcaaacaaaacttgcccttttaacctgctaacacgtctatgaacatcccatttcactgaataatggtgaggggaagaaaatgacaaattattaagcaagacctactctattttaaacatttatagatagaactaatggcgatttgaacagtgaagtaatatgtctacatttcccaatgttttcatttttttaggagtatgaatttaaagagcttctaggatcttgctcacattcagaaatgaaactattggtatctcctgattttttttaatttgcttttcttcccacgttgtacctaaggatatatattttcttatttgttttttcttcttttatgagatgaagtctcagtgtcatccaggttggagagcagtggtacgatcatagctcactacagccttgaattcctgggcgcaagtcagccttctgcctccagggtagctgggattacaggtgtgcataaccgtaccgagtcaagatatttctttacatgtaaaaatactacaggatttatgctggtcaatgaaattttgaccatgttaacagttatgactgaaagaatattacttatgagaatggaaaaataggtaaaaaccagacacaactggggggagaatcttctattgctgtttctaccaaagttttgaaactacttttactatagttaaaaactgtgaattcaactgaagattataaatgttacagtgaccattcatgatacattccctatatattatgtgtacatctacatagaagcaagctattagtaaacagctttaaaattcactaactgaaattttgtgatcatctgaacaaactgagataaaaagtctttgtgttagtacaatatgaaaaaaaaatctatgtgggtttataactgaaacatgatttcaggacacagaagatattaggttcagcaatttagcttagaaaactgctttttggtagggaaaaatatgtactaagagaaattaataagttggttttaaagtaaggttatttgttagtttattttatgttaccatatatgtttgaaaataataaagtgaaattcctccaaaatattacatgaaaaagtttagttaatttagattggtatcttttgagggagaaagcccataatgtgtccttaattatgaccaacaaatcttagcattctgtttgatcattaatttgataagcctctttcataaatctgaaccttctgtcttacagaaaaagactaatatgctttgtagaaaaaactaatatgcgttggatttaaatgaactcttttaactaatgtaacataaactcttaatgaatgaattattatatttataaaccctcttagtatgagaaacactatggattaggcatatagaggcagctcaacccagtatacaaatcagtaagacttttaacagtatttgcctccctgctgcatttcaatgttctctatttgctaggatttgtactcaaagattcttggaggttattgtgttgcttaaattttcatacatgttgatagaaagggcattgatatcctctcttagttttctgagctagagggggcaaaaattatctttgataacatattgtagataaaatatcataggtgcccacagagagttgaaccttgtgactctgatttattgagtgtcttacaggccaattcaatagaatttcttttccagttagatagattccgttttgaagtctttttcaagtactatttcaagggaggcaagatgtggcaaaatcagcacaataatatttactctaagtaaagaaaaaaggtacgtggtgtgctgtttggggtacaaagtttttacttcctgctttaaataattctctcaagttgcagatcttttgtgatatgaaaaacactcgtgtaaataaacgtatagtgagtgggatggaatggggatagccaaaaagatgcacttaaggaaaaggggaatataaataataactctgtctctccatgctttcttctttctttttcacctccacccctatataagcctgggtaaacctcaattcagtggacaattttaagaatgcttactcattcatttaaaaatatgattgaatgcctacattatcaactaccaatagttggaaacaaggcttgagagagaggagagggagtcttgtgtgctacaccatggaatttgggcttactcttggcgtcttaggaacttgtgaagggctttgcctaaggcagtgtcttgatgagattgctttatagagagatatttctagcatcacatggagaatggttgggaatttatgtgcctacaaagagaagaatcttttagccatatagtgtaagagctaaaaagatagcatattatgttatttaagagccttggctctggaattacatacaattggatttggatcctacctctgctattctgggcagctctgtaaccttggacaagtcacttaatctctctggacttctgattttcatgaaattaaggatattacctggtattactcagatttgtaatataagataatgtatataaattgcttaaatgatcctggcacacagtaagcacacaataaatgttaattaaaaagcaaattatcagaagaaaaataaagaggagtaacaagaaccaaaactaagaggcagcaggacaagcaaaagattccagacagatgcagtatataaatctagatgaattcatgaccagctagaaataagtaagaggaagattttccagtcaatgctgtgatttcaggctttaaatacttgaagccatagaagctaaccttttcatttaaaaagatatatcctctttcatgaacaaaataaatatctctatgggccagaaaaaggataaaatgcataacaataaatgagtgttgaagctatatgccttttgaattaatatacattgaatttaaaataaccttatcataaatatcagaaacatcatgcattgagcatatggaggacagcctgttaggcacagtgttgatacattgctattaattaaatccattcttcattcatatttccttactttttacctgacatcgtttttcttttccaggatcctatccagggtactacattatatttagttgtcacatctggggtttttctcagctgtgacagtttatggtgtccttttcctagttacaatgctagagttgagctcttggctgcccctgactatttctggaccagagccctaaagggataggaagagccaaataggaaaggacgttgagaaccaatgatcagagacatagaaggcaatctttgttgtttcttcctgctctataatccaataaatttgttaattcttagcctctgctagtaattaggaaaacaaatgaaactatgtcattcatatgatgaaaagtacaaaagaagacgattaggatgggaccttgacatcctggaattagagaataaaggtgtttatgaaagctatgttgggaatggtagcaggagaagactctttattcaaagagagagaggaagcagcacattggtttggtatctattagtttttgcacttagtgtaaatcacacttaggattcattctgtttaaacaccctatgtattgcagagtcataccacatcacacggcctgagacctttctcctatattattttgggacttatagaagtcttaaaggcaaggcagcagagaataaatggctcaggacttgaaggcagttttatgatatgctacctgaacagggcagcagttgagtttacttttttttttttttttttggagatggattttctctcttgttgcccaggctggagtacaatggcacaatcttggctcaccacaaacctctgccctctgggttcaagcaattctcctgcctcagcctcctgagtagctaaaattacatgtgccaccacgcctgactaattttgaatttttttagtagagacagggcttttccatattgatcagtctggtcttgaactcccaacgtcaggtgatccacctgcctcagcctcccaaagtgataggattacaggcgtgaaccaccacgcgcagccaggtttaccttttatcagagggactcagagaggaaagctttaaagcctgaaatctattccaaagaattgcattccaaattttaatgtgcacgggggatcttacaaaaatacagatgctgactcaacagatctggggcggggcctacaattttttctgcatttgtaacgagattcaagatgatgctgatgctgatgctgccaatcctgggtagcaagactaatttaaagagcctgaaggctttcatcatcgaacagcacacataaaatacttttcactatttgatcccaagttatcatcctgaatcaagaatctatttatcttaacacgtgtgttcctttcccagaacaaactacccagttcccagtccttaacacctgtaagaaacctttagagtaagaaaaagaatatggatattattacagagacatccctgtagtttttatactataaaagaaatgaccacaaagtagtaatggataaaattgttttactaaaattagagcatttgagacacattagcagttagctgtgacagtatagtgtagtgtagagcagtgaaaataacacaggttcagatgtacagacacaaaaacattagaattagcaattcactggctattttagctctatcagtcattggctgtgttggtcaagtttgttggtcagtttttcaactgttaaatgggaataaaagcactttcttcataggatttgtgtgattattaaataagatagtgcatgtaaatctcttagtactgaatctgactagtaagtacttaacaaatacttgcaatttcattaaagaagcagaaagaaaatggaaagaggttaatagggggaagtaatagctaatcaatagtaagtggttttagcttgggaaaatacattattgataagtttttaatacctatattcatttatcctgaaagctagcacgaggttttttttgttttgttttgttttttttgagacggagtctcgctctgtcgcccaggctggagtgcagtggcgccttctcagctcactgcaagctccgcctcccgggttcacaccattctcctgcctcagccccccaagtagctgagactacaggcacccgccaccacacccggctaatttttttgtatttttagtagagacggggtttcactgtttttgccaggatggtctcgatctcctgacctcgtagcacgaggttcttggacgagaactatgatctgcagaaataacagcaggctggctcccccttccccagtctccaaggcgatgcaatgaaggtagatgtcagctgtacctacagggctttctactgcaaaaccgctgaaattatgaatctggacatctgtagaggagctggacagctgccctactccccctctggaaagaaggagagaaacttttgtccctaatgtaaaagagtcttctctgggaaagatccctaagtttttacagtcctttggaatataagaaaaatagctcagggatttagcctcctttgaaatgtaaacacaaagccccaaggagataaatctctgtttctctcctgagctatctattctatcaccatttcacccagttgccaattttctttgctcagaaagcctgaccctgtagcaacatgaaatttacatcatttcctgataattataaccctattataaagttacattaatggagaaaaaaattattaactacctcatataatagaaaaaaagtaaaaccatccctagcaaatcctcccctactcaaccttcatttctgataattataataataagaaaaacccaggctttctataaatttccttcaaatttttcattattagtgtgtgtcattcattccatacctcctaaataattcctaatgtgtgaactattttccttgtcattggatgagtagttataaagatagaaaacaaattttcaggctggctgcagtggctcacgcctgtaatcccaacactttgggaggccgaggtgggcggatcacgaggtcaggaaatcgagaccatcctggctaacacgatgaaaccccatctctactaaaaatacaaaaaattagccgggcgtggtggcgggcgcctgtagtcccagctactcgggaggctgaggcaggagaatggcatgaacctgggagacggagcttgcagtgagcagagatcgcgccactgcactccagccagggcgacagagcaagactctgtctcaaaaaaaaaagaaagaaagaaagaaagaaagaaagaaaacaaattttcaaaaatgtaggaagcagttctctagtttgaccacaaggcagataacacctgaccaaatgatgtggctgtgctctgtatggttcccaccaatgtacaaaccagaatggctttgagtagcaaggctatgaatttgcagtctccctaacatcagcatcaccgagaacacatggtcattgccaagcacagaaatgactgaagactaatacccaagcaattgctaaaggatagttgccaaagggaaattgctaaaggacatgtgtctccatgaacatagtcagatgtaacttgactaagctaagggctactaggaaatagcatttacatagcaatctcgccagccattttattttttaaattttttttttaatttttgtgggtacattgtaggtgtatatatttattgggttagccagccatttttaaataggtggtgctgggtcactcaaagcaaataatctgcaaacatgataggggaaaaagcagagacaaaagcctaacaaatgctttaagattctgagactgtctctgttgctcagatttgtcagccatttgttttttgattgtattttttctaaccaaactcacaaaggaccctgacaccagtggaaacattcaatcctcatgagaattcaaatccacaacattatctgttatctgaaaagcagttatcttggccagtttgaattgttatgacaaattaccctagaatgggtggtttaaacaatgaatgttgatttttcagttctggaggctggaaagtccaaaaatagatgctggcagacccagtgtctggtgagaacccacatgctggtttgcagatggccatcttctccttgtatcctcatgtctttatagggcattaattccattcatgagggcttcaccctcataatataactacctcccaaaggcctcattacttaatatcatcacattggggattcagcttcaatatatgaatttcaaagggacacaatattcaatccatagcagcaatgcattagatgatgcaaaagctagtaagacaaggcccctttctttaggagctgactgctagtacagtggagcaaagagagtgagggtgcagtgattctaataacacacaggatgtaaatgtcccaaggcaagtgcaaaatgccgtaagagtttaaaaacggaggagctcatatgtaatttaggaagaataaagcatggctccagaacaaaggaaagtctgaggtgggtcttcacctatggaaaggatttcagtaatagttaagaatcctagggttgggggctgggggagggatagcactgggagaaatacctaatgctaatgacaagttgatgggtgcagcaaacgaacatggcacatgtatacctatgtaagaaacctgcacattgtgcatatgtaccctagaacttaaagtattttaaaaagaagaagaagaagaattctagaggccactattgacagccagtcacagatttctacagtgaagataatgaaggagttccaaatggagacttgacgtagataggttcagggttcagagaggggggaatatactctccatcccaaaaaagaagaatggatcttgaagtagaaacctgaataaagagaggaaggagagaggaaaaagaggggagggtgaaattatgagaatgctgagccttacaccaccttcccacctcctctatctgtgactcctgaaattttagcaaagtttatacaagtcatgaaattctggctgtgattggattttctgtggaaactgatgacaggattaagttatttgtcctggctgaattaggcataaatagtgagaaatggttactcctagccaaatgtgtggtcctggacctgggtcacaaatattcagtccatagtggccatgtaggtattctcctgggattctaaatctcacatctggcaaattatgtgatttaatatcctgtgatcccaaagacccctttaggcctcaaattcttgaattttaatatttttaactgagattcattttattagtgctgtattcaaatgaaattattactttttaattttaatttttggatacaagtaaaaatgaaattatcttcagcattgatttgattttttagcacaacgcctctctaaataaagctcaaaataacatttgtttatgaaaacatgttcgatttcttgtatcatctcttttctactattttttttcccctcccattaagttttgttgttccaaatctaggcttaactcattttccaaaatgtaccaatttaaggttggacttgtttattgctcattcataattctaaccattcatcacattttgttgttttgcagtttcataaacttctttatttagcacaactctattgctggattaaaatgagcaacctttgtaataattaaatatctgtatagaaagggatcttttctcaacatgtatgctctttgttttggtttcatgcccccagatagttctgacaaactcaacaattgtgaatagcataaaaacaggctttttgcatgcagtaaaacaaagttaaagtttgctcaaaaatgcatgcagagtgaaattcttcaacgtggggaaaaggaaaaagtatggaactgcatatgctggatgctatgcattattatctcatttaataatcttaaaaaccttatgccgtaggttttttacatcttcattttacatgtaaatttcagtgatattctatggcttgcccaaggttgcctacctgtaaaggggtagagtaaggctttaaatccacatttgacttcaaagcctgtcttccttccattaaattttactttctctgggtacatgtcatactatcttgtggccacttatttatcagatgagataatgactgtatcaactctgtataaaccataaagtgctacataactatcacttatgttgctgtagttgataaaagtgaataagccatttaaacttcctaagtaacaaaaataagtaattgataagcccaattatgcacttagtcttactgccgtaattttacttctcatgtgtatatctaaacagtattttgtaatcaatacattactgccactgaagcattgaacatgcccgttccatattgtcaaggtttgaaaattcattgtatgatttagttgtgctggggaattgtgtgtgtctgtgttcttcagtaaaaactaaatacgacttctataatttgcatattttactccttagtaaattatgaactgataaaattacagtggtttttttgatgaaaatcaaaattaagctcggtaaacatattgctaaggaaatggtaaattagaaaaaccaaaagaaaaggttaggatctgcagtgggatgtagtatgaattctttaagagtgaatcatgtccaacaacttttcttaggaatatgaaaatgccatagagaagtatgttgattttagcagatccttttacaaacttatggctgtcatttagaaagaaagagaaatgcacatgagataatactcctagttttgaagagtaataataaggggtcagatgggacagtggtccctagcgctgagccaaagggcctgagtttcgggctgtgtctcatctagaattcattcatatctttgactcatagagaaaagaatgaacacaatgctgagtgagatcaacatatgacaagataagttcactttcaatgatagctgtaaatagaaaaaataatatttatataattgattcaaactttataaaattgactcaaatggaaaagttaatatttaagaaatttaaatatttatttcttttctgtctttgaaaaagtcaagtatacatatacagatttcagaacacttggactagcagcaatttgggtaaaaaagatccagtgagttcatttggaagcttgttctttgggagtgaactgtcaataaagtgacatagcaagccaaaaaaggaaaataaagttaaggaatcaggagcacagagatacatgttaacagtggaacacccgaggagcaaagatcaaccattgtttgtatgggttccataggtaaatctaaagcccgtgggtaaaagttccagaaagatcactatttagcttaatgttaaaaaggactatatgaaaataataaatatatataagggattctagacaactctgtcctagagtgaatctattttattcttttaaaataacatttttcatttttgcacaaaaccatgcttatatctgcaccattccagtttttagaatacacaacgttacaatcaacttgtttgcattttgatacacttctgttttcttttccctctagtacttctgcatttctgccctcaattagcattataaaagaggctaaaagccatggctgttgtattagtctgttttcatgttgctaataaagacatactggagactgggcaatttacaaaggaaagaagtttaatggagaactcagagttccacgtggctggggaagcctcacaatcatggtggaaggcaaggaggagcaagtcacagcttacatggatggtggcaggcaaaaagagagagctcgtgcaggcaaactcctgttttgtgaaaaccatcagatctcgtgagactcattcactatcacgagaacagtgcaggaaaaaccatcccccataattcaatcacctcccaccaagttctttccatgacacagtgggaattgtgggaattacaattcaagatgagatttgggtggggacacagagccaaaccatatcaggtgcacagccagatatatcctgatttaaatccaggcttaccatgtactatgtgatgttggaaaggtcacttaatttctctgaccctcattttctacatcagtaaaaagatattctctatatcactatgttgtttcaggacagtggactatgtgctttttaaattaggatatcctttaaaatatgttaaatatttaacaaataatacccacaagtaacagtttataaaagtatgataattcatgttttaaaacatttagtagtgtgtcagacacatagtaagtggtaaataaataaaagtgaataactattatgttaatgtgaaacaaattcgtataatgttgctccttaaacagtgtttcaaatttgtgaggacctgacacaaatcatttattttcacttcatgtgcctctaccaacaagcataaactcatgctatatgttcttcttagaagcactgtattgtttacattaacctctaccaagagaaatacaatggtgaagaaatgaaagaacgattcatttaaaacattggtgctagcatgtactgcatgtttcaagtagtatcataaaaccatatctaccctgcaaatatttcctcttttagtttgatcccaaaccaaaccttttattcttgcttaccagtacctcgccaaaactgagtttagtaaattggtggctgatacctgagaagcaaggaagcagttccccagggtgtgattagctatggaaacagttgatttcagtgagggttggagaagcagggagaggatttaacactgagtggttaaaaatagttcccaaggggaatctagggaggaagcagagatcttcaaaagtgctagagaagaaacacataaaatgaagtagggataagataccaacattttacccaggcccagtgtttactgtatgtatttggtcctggctacctgtatcattttgtttaatctcaagtatctaacttatgtgtttttcactttcatttagcaaatggacaaaattaaggctcagacatgttaaggagcttgccttgagagcccagttagtaacctagagtaaggacttgagtctagcttctgtacaaaagctgtgctccatgtcactgccttcagtggataaagtgaccctttcttttacaaagagggcacaattatttcacaattttaataggtaggcagattttttcccaagacctttagagataattttttagatgtaggcaaagtgttcagcagctaagtttatacttggagattactatgaatatcaaaatcctaaaatgaatcaagtttacaagaaagcaaaacaaagcaacaagtagcctaaaactagtgtttattaaactggtgttgcacttgactggggaaaacactcccccctacacctagatggatttttgttcatcttcaaagggcaactctaggaaaatttggaggcagagcttcctaaacatgaaattcttattaagaacttaaaaagttcttaagaaaagatgtgttttacttcccaatccatatttccaccaacgtttgttaagaaaattatatatatgcatatatcacatatatgcaatcataaaattattctgtcttagtaaatttccagtacgggttaggcacctatttttttttcttttttaatttccattcccttcagtaaaactgtggtagcattattgcataaaaatagattcagtttaaatgtttcaaatatatcatgctgttagcaataaccacgaagtagtatcgctgcaagaaagtaaatttctcattatttagcttgatgcctagggtcatgagaagaaaaaaaattaatataattatgtgtcagttctggcatctcagaagaatcttactttaatatttttagcaaactctcaccattctctggtttgttctgcttttcataaatagatagtttgtgtcaacgattgcccccaaagagttgagggtatgctatattattttttgcccttaactgatttcaaatttaggttgtaagtccattagcttttgacttaagacacaattctgagctcctatttttatgagtcctattttattttctgtgataaaaggggctgcacctattgtagcttgctctgaatttgtatattggaggagtctacagagcagaattgaggaaggagaaagagacttcctaatgagcactgcactcatcattcacagaattccatgaatgttttattgattaagtactgtgctttgaattaatttaactagtttaatttatgtgtgttcatgtcattgttttttcatcctttttttaattccccacctgagatgcagtgtattcatctttgtttttcttccatgtttatttcatttttgtgggggttagaggttaatgattctgaacactgcattcacatcaaacaaaagataagaccaacaaaaaatcctgtagaaattgtgtcattcttaaccacaactggtatggtatctttaaaattttatgaaaagctactgccttccttccttagagaggagagttgatttcttcagatacaagtaaggtgaatatccccagatgaatattcattgatgagctgatactgtgtgtcagctaaggtttgcttaggaaaactgaaactgctctagatatttgaccaagaaataacttcttaatacagggaattatatgcctacaaagctatggaaagggctgagggtcaagttcagaggaattattgctgatttttagacaaacccagaaatgtcaatatggcaggaagctatagccaggctttcagctgcctgcagtgctaaagtgaataatttgttgagacctaaccaagaagcctttgaaaacctcccattgccatccagccctaagtctaccatgtcacaaatggaggaaaggaatgacttctccatatcatctcctttccaaatcttttatgaataactctccttgatggaatttaaatggagcccttactattaggagaatttggaaaatgtggttttcaagcttctaactctttgggtcattgtgcttaataggtcagggatgacactgcattgacatatatataataaaaagcacactagtcagctcctataagtcttatgcagaattttatttttttcccaaagcactggcctgagtaatgttgaataaattaacactctgaatgtttatgtacccactcttatcctgtctcttaattgtagaaaggataagctttttctttttctttttttttttttttcatttataagatggtgttcttgtcaaggcataaatccaaagggaggcagatgtgcaacacacaggtaataagggagttccttagcaatcaatgagatttgaaatgtccagcttttctttgcctgtatgagcatttttgttagaaagtttgatcacattaaaaggtgaagcatgcagaaacctatttcagtgttttcactttatcttgctttagaagctaaaaggttatacctcatcatggaaatgttctttacagtatatctgatttgttgtctattggaaagcgattatgtctataacatcagtgaaaagagctgtagggaaaagagcaatgctcttcttgtgatgtttcattctttttgactgacatagcactacgaaaaagtattctgttttcctctgcaaataaaaataatggaaaaaaatatataatgctgaatctcgtcatcacaagagacggattttccctgaaagtttgtattaaagattatatggttgtgttggaacaatttgtaaagtttggaacaagacaatagtctcaattagctccaaagtatctcctattatttaattaattttttttgtgactatcctattataagaaccttcacaatggccagcacacttacatagactggaatttcgccatccggatttggattagcttattagagtttattactgcaaaagtgattatccagaaacaatattgcccatcttttaccattgttatttaacatcttctggaagtttgacattagacttttttaaacttggcactaacgtcattttgggccatagaattatttgctgtgaaagcggtcccgtgcactacaggctgtttaacagtatccctggcctatacccactagatgccaacagcactgctcccagttgtggcaaccaaaaatgtccccaggaattgccacatgtaccctgggggcaaagtcacccctggttgaaagctactcttctagacactgccgtataatacaaaacagaagtttgaaacaaaggtactgaaagggagataaaaatgattattttagataatgtgattgattgtctgaaaacaagacattcagctggaacgttatttgatctaatgacttaaataaagtagccaaaacaacataaatgtacaaaaatcaataactatcaataacaagttagcaaaggtaatttagaagtccgttttatactgggtagcaaaaacaaaagaaaaaactataaagaacacaagcaaagtgtgtgtggatattataaaggagaaaggaatgaaaatcatttcactcttccagacacacaagcatactgtaaacctataataattaaaacggtggtacacagatgaagtaactaaccattagaccttcatgaaatcttctttaaagtatatctgactagacaagtagaacagaattgcctcaaaactgactttgatttacataacaaagttagttttgaaaggaagccccacagatcaaaaggtaaaggaaggaaaataggcttataactgtaatcccagcactttgggagactgaggtgagtggatcacttaagcccaagagtttgagattagcctggtgagcatgcaaaacctgtctctattaaaaatacaacaattagccagttgtggtggtgcacagctgtagtccctgctactccggaggctaaggcaggagaattgcttgaacccgggaggcagaggttgcagtgagctgagatcgcaccactgtactccagccttggtgacagagtgagattctgtcaaaaaaaaaaaaaaattgaatgatgcaggtataattggttaatcatttggaataaaaatgttaaacacttcacacattacatttcaacaaaataaatgttgactgtcacgtgtcattcggtagggtctcattctacccgagagtctgtcttgtctttttcaccaggctacaggacattcaccccaaggcgtagctgagtcatttcgtgctttacccaccacagtttttgttagatacctctggcatgtaattccacatggggatatgcttagctttcatcgtgaatgtcccttagctgttgtccctgctaaactgtgctcactttggggagacttctgtcattgcattcccaggatctaacacagtggacttgttatttgttaagtacatttataaaaaggatcattcatttttaaaattgtggtaaacatatatgtaaaccaacatgtgtctgagacaggtctcaatcaatttagaagtttattttgccaaggtaaaggatgtgcctggaagagaggtctgtacttttctccaaagatgattttgagaccttcggtatttaaaggggaaaagcgagctggaaggaaaagaggaagggtatggtcacattactgaatcaaaatgttgcaagaaaaaaggagcagttaggggaacagtcaatgatgtattcccctcatggtcagtaaatcagtgctctacataaggtaaggtgaacatagagaagctacctgtgcagacagttaactttcatctgcagctatttgcttaggcataaaaggaaaagcagttgcttgcgtgactcagctttcaacttaattttctccttttggcatagtgaattggggttccaagtttttattttcctttcacatacataacatgaaatttactattttaacctgtttgtttttattttttagacggagtctcactatgtcgccaggctggagtgcagtgatgcaatctcggctcactgcaacctccgcctttggttttaagcaattctcctgcctcagcctaccaagtagctgggattacaagtgtgcaccaccacgcctagctaatttttgtatttttagtagagaccgggtttcaccatgttggccaggatggtcttgacctcctgacctcatgatccacccgcctcagcctcccaaagtgctgggattacaggcgtgagccaccatacccagcccattttaaccatttttaagtgaacagttcagtggcatgaagtacacatcgccaccattcatctccagaacattttcatcttgcaaaattgaaactttgtgcccattaaactccccattcccgctccctccagacactggcaaccatcattctattttctgtccttgaatttcactattctaggtacctcatagaagtggactcacccagcatttgttcatttgtaactggcttattcagttagtataatatcttcaaggttcatccattttgtacaatgtgttagaatttcctttctttctttctttttttttttttttttttgagacagagtgaaactctgttgcccaggctggaatgcaatggcgcaatctcagctgactgtaacctctgcctcccgagtccaagcgattcttctgcccagcctcccaaacagctgggataacaggtgcacatgaccatgcccagctaatttttgtacatttagtagagacaaggtttcaccatgttggccaggctggtctcgaactactgacctcatcacctgcctcgtggatcacctgccttgtcctcccaaagtgctgggattacggttgtgagccactgcacctggccagatttcctttctttttaggaatgaatattattccatcctgtgtcacattttgcttactccattcatttgtcaatggacacatgggttactttcatcttttggctatgtgactgatactactataaacatggacgtacaaatacctgtttgtgtccctgctttcagttcatttgggtatatacccagaagtggctttcctggatcctatggaaattctatttttaattttttgaggagccaacatattgtttctcatggtgggaattttaattctcaccaccaatgcacaacagtccaatttttcgtatctttgccaatatttcttattttctgtttgttgtatttgtttttaataatagtcatcctaatgagtgggaaatgctatgaatctttcatttttatacctagaatgtatctcagcagttgtctcatttgacttactcattacaccttaagcaaacctagactcagattcatgggatttactctaggttaaacgactacttaacatctttcctgacccctggtccagtgctcctcccaacaagccaaaatgtccctatggtcatacaagtagacacaaagaggaacaggccagaaactttctattttaactttatctttgcctccctcttgctttatagctaaacattttctaatatctcactataaaaaagagagaagaaaattataaggctatagaggcaacaactataaaaatgttataatatataaaaagctcaaaaagaaacatgagcaaatattatttcctccacaaactaataagtaaggatgaattaaagagtagtttacactctcttgctcaacaataaattataagcagccaaagtagttttaatttattagtatactgtatgtttaggaactcgatgaagtagtttggagggaatggctacatataaaggagtgctcagcatattagtgggatgtgtattgactattgctttgtcattttctattaatatgaagagatttggatttgatttttagagttctcaaaatatttgggaattcagaggtaatgtagtctgtgaatattataaaatgtgccatttctggcagcctaaaaccagctgcagaaaaagaattgcttgtctaaacatccaatcacagaatctttccctttcactgaaattgatcacaacacaaaaataacttccgcacatccatgaatatattaaagtggcataaagaagaaattctgttgcctgcaaagattacacctgcctcaaagtcatgatcaccggaaaaaaaaacaaaaccagtgaaataaatctaagatatggctatttcctccagagaattgaaacagcctaaatagaagcaatgctccttgaagcaaaggaaattcttatgtcacaaatcctactgcaaaacccccaggcccccttgtattttcccatcacaaacatatcaaacatttttttttttttttgcagttagctacatccttatctagaccataagctccaggaaggcaggatttatggctacttcgtttattactatctccccagcactttacttgagactagacatataggaaatagtcagtaaacacttgttgaatttgtgaataaatattgaatattagcaaatatgtatgaacacaatttagaaacttctaatttttaaaagctttgaagttttatttctgcacaggacacaaagggttttttcttactaatttcctcatatctatttttaaaatgatcactatcttaatccgttcagactgctataacagaatactatagactggatggcttataaacaacagaaatgtatttttcatggttctagatgctggagagttcaagatcaacgcacctgcagatttgatgtctggtgagggctgcttcctgattcatagatgactgtcttttcacaatgtattcacatatgcaagggatgaggaagctctctggggtccctttataagggtgctaattccattcatcatggctctgctctcaggacctaatcacttctcagtggtgttaccttcatataccatcactttttgtgttaagtgtcaacatatgacttttggacaacacaaacaatcctattttatctcctgctttggagaagagcattgtttagcagaggtcaccttgaataaaaacaactgatacttctcaactcttagtgtctgcctggcattgtgctaataaacatttcctggatatctaatttaatccttatagcaatcctgtgaggcagatgctattgtaattcctatgccacatatgagaaaaacgtggcttgaagagcttaaatatctacccaaagtcattatgccactaagaagtggaattcagtcacctgtggtgttaattttggttcctactggtaatggactcatcagatgttcaccagcagatagtcccagagtgctgtctctgaggattccaatggagaaaaatgttatagccactactctgaaaacacggagtgtacactagacaaagaagagcaagggcagaaatcacagtgtgttcacacaacagcattccatgcaattgactcatagttttgcatggcaggggaggcctcatgaaacttacaatcatggtggaagggggtaagacctccagaagcctcactcatttggatttcacctatggtagaaacaaatcccctgtgatatggtttgactctgagtccccacctgaatctcgtcttgaattgttattgtcataatccccacacgttgagggagggatgaggtgggaggtgattggatcatgggggctttttctcccatgctgttctcatgatagtgagtgagttctcatgagatctgatggttttataaggcagttttccctgctcttgatcattctctctcacctgttgccatgtaagacatgcctcttccccttccaccatgattccatgattgtaagtttcattaggtctcccctgccacatggaactgtgagtcaattaaacttcttttctttataaattacccagtcttgggtatgtctttatagcagtgtgaaaatgaactaatacaccctgtctagaacaattaacagtccaaactaagtgatgaccaagcaatgcagaaaagaactgttaaaatgtttaagtactcaattgtttattctagaatggccctttcttttatccttcagctatctagacctgagagcttattaatgttctaaaacttaatttaaatgctacctgtcctctgaaacgtactcccagtcccaaataaatctttccttcctcagtgcatccattctgttatacctttgtctatttaggcgtttaattggagtaatgtaattcaaagagtttaacatcaagagcagttacattttaaaataagtaggtaaattatctggaaaattcactcattccagaacactatatctattttaggaaatagtcaattaaacatcgtattcaaccaacaaccagccatatagggctcaataattgctgtgattagggaatatttcttgttgaaatgagcaaaatttggttgaaacataatgattaagaaactaaatgagccacagaaaatccacttgaaagttctattcacttaaggtataaatacaaaaatatataaacttttaattagctatttactttagtatatggttcacttttttgcttatataggctaaaataaagtagccttttacttgaatactggcttttggttgtgataacaattcagtttcaaatgctgaaggcaagtcttagtttaatatcttagagaaagaggagagaggatgagagggacttcctggggatgtttctttgtttctctgctaactaaatttttaagaagatttgacttagaaggagtgggtatgtctgggcacaatggctcccacctgtaatcccagcactttcggaggctgaggcgggaggatcacttgagcccatgagtttgaaaccagcctaggcaacaaagtgagaccctgtctccactatacatatatatatatatatatatatatacacacacacacacatatatatatgtgtacatatatgtgtatatatatgtgtgtgtgtgtgtgtgtgtgtgtgtgtgtgtgtgtgtgtatttatatatatatagcggccatggtggtgcgcactgtggtcccagctacatgggaggctgaggcaggaggattgcctgagcccaggaggtcctggctgcagtaagctatgtttgcaacactgcactccaacctgggtgacagagcgagacctggtctcaaaaaataaaagtaaaaataaaaggaaggcagggttcaataaataatcatttgtaccgaatcagctagggtgatcattcatactaggggaatacttgtataaagagaacagggaggatttattcatagtttgagatactaagttttacctctggtaaaagctgccatcaccctttctgcttgcctgtagatcaagtacatggcagaaatccatgttgttggaagacttgcagctgagatgagaaaccagatgatgctttctattatgagtctattctaagtagtcccatttctatgtatcaaatgaataaattttgttcttgccccccacctctatatgaatattctgtgtgggcagctagctatgctttctattcttaggcagaaatatgtggctctcgggcctaaactattataacatttaaaaaccaaatttgaattcagtacattcaagcctcttagatccatagggactttagagacattaaaccttaaggcctcctgatagagattattttgtaaatttagctcttaattggccatatatattgatggaaagccacaaagcaaaagtgcatgatgatttcatttattctctgtgtcttcctgagagaggattcagtaactcttgcatttgcaaaagataaaatagatagcttttctgatggatggaggtggctgaagactatatttatccttagattttcagatatgaaattcatttgaaatgcagttaagttcatttgtatgaatatttcatttctcttaacaatagtgacattggtgggttctcagtttacttaaatccacatgttttctctcagcccaagtgtggtcatagtggtcgatgatttcaacttgtctctccaaataaataatatcatcctggataacaaagactgttttattctccttctcttttattcccctcacactgatcagagtgctgggtgtgcagtaggattttataagtatttgccagcatcttaggaaagaaaatttttctaaaccaaagagagaaaaaaaattgtaggcataaatgctaaatgatgagttaatgggtgcagcacaccagcatggcacatgtatacatatgtaactaacctgcacattgtgcacatgtaccctaaaacttaaagtacagtaataataaaataaaataaaataaaataaatatattcatactgtggaaaaaaataagcctaaagtcttgtactttaaaaatcaaaactcaaagtaaacttttcatgcaattttcttctttttttttttttttccagacagggttttgttctgtcatccaggctggaatgcagtggtgcaatctcagcttactgcagcctcaacttccctggctcaagcaatcctcacacctcagcctcccccataggtgggactacaggtgtgtgccaccacacctggctaaatttttatatgatttctagagaccaggttttgccatgttgcccaggttggtcttgagctcctgagctcaagcgatccacctgcctcggtctccaaaagtgctgagattacgggtgtgagccaccatgtccagctgcaattttattcttatataatttgtattccagtattagattttaaaaatcaccaaaacattatataatactaagagcaaaatgtgtataatctatacatccacctccaccacccctaccataaacttcacttcttgcctccagttttcttaagattcggctcaagtagcatcgcttccaggaggccttcatagtgcctccgcattggatatcttatgctaaaaatactttcttacccattaccttaagctccctgatggccaagtgaatatcccatttatcattgtttccaaaaacctagcaaaatgcctagcatgtagtaaacattcaatttaaaatgttaaacctaaatgccagtcatttatatatgagttttcattatcctggaattttttttctctttttcatcatctctgtaacatccaagtcccaggatttgagttaccatgggttgctggagaccctcaccataacatcctctatgcctgtggttctcaaacttaacattagagtcacctggagaatttgaaaatagatggatgcttgtaataagacatatcaacatcatgtgccccggatgtgatatacagagaggggccacaacgtggcttctgcagtatccttctcaaaagtgcataacccagtttaatcctgagaaaacatcagacagatgtaattcaaggacacttacaaaatagccagcactcctccaaatggttattgtttttttccgcaagggatttttcaagggtgaaatgattcattttatgttatataaatttcacctccattttcaggatctaatgcaggatcctggattggaccctgaactagaaaatggacattactatgaaaactggtaatattcaaataagaccggtagattagttaaaatattctgtcacatgtcctaatttcgataattgcactatggttaggtaacacaattttagaggaatctgggtgaagtgtatatggtgactcttaatgccattattgcaactttactgtaatctacaattatttttaaatagaaacttaagcatttttacaaagtgacttatgtcacccccagatgtgaaacctgggcattgggacctttaaaaatccccacaaattatatgagaaccagtgctctaagccaatgttagttgaccttggttgtccattagaatcagcagggaagattttttaatatcttaatgctcattcttaaccccagattaaagcagaatgtccaagagtaggaccaaggaattgatatttttatttattttaaactttgtgaaaaaatgttattgtatatatttaaagtatacaacaggatatctatatagtaaaatggttattataataaaacaaattaatgtattaatcatctcacagttaccagttttagtccctgtggcattagcagttgtaatgtactcatttagcaaaaatcctgaatacaatacattaactatagtcctcatgttgtacgttagatccttcgatgtctccattctacatatgctattttgtgttatttgatctacatctccccatttctccctctgcccttacccttggaaaccactgttttatattttttaaaagctcttcaggtaattccatgcaagtcatgggtgagaactgctgctgcaagctaaggttcccaaatgtgcatgataataagtatattgtggaatggtccaggatcatgagcattttaatgtagaggctcccactaaaaatctactgaatcaatattcagggaggatagtattttaacattcactcaagatgagttttattatcagaaaagtttgggaagtattatatgctgtctagaaattctaggtgtggtccagcttctgatagtgaagtttaaggccctactaagagatctttcacacagctggtagtagcaggaaaatgaagagtctatagatgagaaatccccaattccaatggaatataagtaattgtggccattatttattcactaatgattttctaagcgctttctgtgctcattactaaagacagagtagtagacaattaagtccctgacctatagaacttgcattccagtggtagagggatagaatgataaataagtataaatgaatatgataaataatttataaatgaatatgatagtttcagataaattactattaaaaaataattttaaaacggcccaaatatccataaacagatgaacagacaaattatagtgtgtgtgtatatgtatatgtgtatgtgtgtgtgtatatatatatgtgtgtgtctgtgtatatgtgtgtaggcatacgtatatatatgtacatatatatatatatatacacaatggaatattaaactataaaaagaaatgaagtactgatagatgctatgatgtaaataaaacttgaaaaaacttagttaaatgaagtaagacagaaacaggtcacatattgtatgaatcaatttatatgaaatattcagaaaagatcaatctgtggagacagaatgcatattgatggttgccagggcctggggtagccaaaatgaggagcaactgcttaatggatatgatacttcctttttggtgatgaaaatattttggaactggatagaggtggtggttgcacaatgttacaaatgcactaaattccactgaagtgtccactttacaataattttatgttatgcacattttgccttactaataataatttttaaaagttccttatgatgtcatcagagagagatgtgggacagtaagtgggtacttgagattgggccatcaaggaaagcatctccaaggaaattgcttttaatttaagacctaaatgataagaagccagtcatgtaaacatcaagaagtagagaatcccaaatgaatcctgcctctgcctttattgtgtgtgtgtgagctgggtggaatacttaatatctctcagcctcatttgcttcatctgggaaacaggattatagaaagatctaattcacaaattgttctaattaaatgagatcatgcacagaaagatgagcttagtaggaagtcatatgtccttaagaatcaaaaggcaaaaaaggaattgaaaactcactccagcaaaagctgatcagaagccccttgttatgcaagatgaccagctaatgccaagtctgttttacataatctttcctcactgattatgtaatgattctgctggtgttgcttcacagtcacttttctgtgtatatgtttcaccactaaatgttctttctaactcactgtgtttcctaacagctagtctgagctttcctcccatagctttgagccgtggcttcttgctctcatcatccaagactgagcaattcccttccctcattaattttgtaaccttgaagatatttacgcagtttgaacaaatactcacctgcagttttcttttttccccaaactcttatatgaatctaattctttctttttcttctcacacataatatacaaactcaaattcctttctccctttgtgtttgctctaattgtggttaataaaacatttcctacattgagcccttccaattaattaagattattttcctgttctaattgaggaaatatacctgaaaagctgatcaacaggatttaaagacatctttccactttattggtacttaaaaccattttcatttcttgctattctttttaaggtaagctgaagcataggaaataattccatacatagctgtaaggtaatgttcaggttaaaatgaaattttaattatgtaaatcatatagtttggggttatgttattcatagagttctagactaaagtttttcctcaataatgttggtgattgacaggcaactcaggtgagtagcatttcctaagcttgtatatctgagctacaaaattctatacccataaattagcagaaagcatggtaaaactactgttttttagaattctacttttttttttttaaattaggaataactttactgcaaggcaactcaatttttttttcctagattccacatgttgaattcatcacataggatactctggcaacaaaaaggaatattgggacttagcatttattcgctctctctgcaggcacctaatgatgaatttagctaaaatgctgcaagaacaagcccttacagttgtacataaaatctgctgtcctatgcagggttaaaggccacacatgttggtaacagaatttttctctcagaagtgggttctttgttgagacttgccttgttccttttgtttttatttttaagaagagacttccatctcaataaagaaggaaaaatcaataagtgataatttaaacataactcagaaactgaattgaaaactgaagatatatgagcaaagcaaagtatattacattttactgtgattgttaatctctatgatttgaagtcagactggctttgaacttccgctttaccactgagtagatttttttaacttggaagaagtcattttatctctctaaacttccatttcaccatgtacagagtgggcgtaacaatcatggcttcacagagttactgtgagaatcacatgagtaatgaactcctaattctaggacatatgcataggaaaagcttccctcttgaagaggctactctggggagtaaaagcacatagccttttcgtattgctatgtaccaaagcagcccaaaagccagcagcttaaaacaacaaccatttatcaaactcagaattctatgagctggcaattccaaagccactgccctggtacagaatcaccaccctggattccccctgccaggtgattgacagtcctctagttcctagataatcaggtggcctggtaggccaaatggaggatccgggacagcaagggagagggccattggaaggctaaggcagcagctatatattagccagtacaaagtattctgatacacaatggttaaatgttggctatgttagccctgtcccattcatattacaatccttttcctgtccaggttgccccaagcatcttgatatcttattaatatacccataaaatagcagaaatcacagtaaaactactgttttgtggaattctactttttttattaggaacaaccttattgcaagacaaccgaaaatcttttccaaaatcataagatgatgaattcaacaagtgagatgaatcacataggatgtgagggcccaattagcattggtattccctatatcttcacaacaagtatactgcttatatccatgtgtctgtccatccctcctaccctaaatgccaataaacccacatcaagaacaagcacacattatatacatacttcttggaaatagggcaacaattcttaggagaaaaggtggtagtgatggtgtcttttcctgagaattttccaaatctttaagttggcttcccttttgattataaatttcacctttaattcatttttattttcttgcatttttctataatcagtgaagagaaaccatgccacgctctcaacactttacttagatatttattctctgaaataccccatttaatcactcagaagttctatcctccacaaaacactgggacacgaacacaattcagccaggttctttgtcactttataacaaggatggactttcctccagcttccagtagcatgttcctcatttccatctgagatttcatcagaatggcatgtactgtccatatttctaacaacattctgatcacagtcacacaggtaatctctaagaagattgaggctttctctacagctctcctcttcttctaagccctcaacaaaatcatccttacaactattttcctggtaatgtacataaaaatctcttccagcctttatccattagtcagttccaaagttgcttccatatttttaggtatttgttacagtatctccccacttcttggtaccaatttctgtcttaatccacttggactgctacaacataatatcatagaaaataaaaaacaatactgtaaaaccatagactataagacaaatttatttcttacagtactagaggctgagaagtccaagatcatagcaccagcagacttgatatctggtgagggttttgacccatagatggtgtgggtcctttttgctgtatcctcacatggcaaaaaggctagctggctccctcacctcttttatgagggtcttaatcccatttatggggcggaacctcatgacctagtcaactcccaaatgttctacctcttagcaccaacacactgcagattcgatttcaacataggaattttgatggggcacagagagatgggtagcttgaaaaaacatattcagcatttcaatgatatagcaattatatttgtcaagtgggacaaaaacctccattttttcagataacagaaaataagctagtggagatttgcacagacatgcagttcttgaagtagcaaaagagacacaccccatttcaaaagacatcatgggttaaaaccgagaaacatgaaactagagataatatggagaaagctagaggaaatatagtaatatgaagaaatctctggggtacagcccaggagcctatattttaaataaatgattcctagtggtactaaagttggaaaaccattggctacaaactattcactgtactgaggaaatgcagttgtaaaagggcactaacctggataataaagagaggtactgcagcttgctaaggcaagttcaagatatccactggttacagatttctgccctgtaagctgggtagggtttttcttctgtgctttttttgcataaatccacccttaagcccatcttgatagcaccaacactccctacttactcattttacttctatgggagttgtgtaaaactggctaggattgctcgaagcagacatccagatgtagttcccatcctgaaccttgacagataactggttcagattcttctgaagcatctgtaagacctggaagtcccatctgctgagcaggggtgctgacctgagtgactttggctccaaatagcactgaagtcacagaacactctccaggggccacaacaagtagatcccactctctgatgaaaccactctacttcagccatctcatttttacacaatatgctacaacaagcttgactttagaatgtgtcgaataggaacacgtctggtctgcagctcccagcaagaccaatgcagaaggtgggtgatttctgcatttccaatggaggtaccgagttcatctcattgagactagttagacaatgggtgcagcccacggaggatgagcaaaagcaggatggggcatcaccttacccgggaagtgcaagtggttggggaactctctcccctagccaagggaagctgtgagggactgtgccgtgaggaacggtgcattccggcccagatactatgcttttcccatggtcttctcaacccacagaccaggagattaccttgggtgtatacaccacaagggccctgggtttcaagcacaaaactgggtggccatttgggcaaacaccaagctagctgcaggagtttttttttcatacctcagaggcgcctagaacacctcaagcaagggagccaagtggtcttgctcagcggatcccacccccgccagagcccagaaagctaagatccactggcttgaaattcttgctgccagcaaaacagtctgaagtcaacctgggatgctggagcttggtggggggaggggcatccaccattactgaagcttgagtaggctgttttcccctcacagtataaacaaagccaccagaaatttcatactgggcagaccccaccacggtgctgcaaaactgctatagccagacttcctctctagattccttctctctgggcaggtcatctctgaaagaaaggcagcagcacagtcaggggcttatagataaaactcccatctccctgggacagagcacctgcaggaaggggcggctgtgggcgcagcttcagctgacttaaacgttcctgtctgctggctctgaagagaacagcagatcccccagcagagcgatcgagctctgctaagggacagactacctcctcaagtaggtccctgacccccgtgcctcctgaatgggagacacctcccagcaatggtcgacagacacctcatccaggagagctctagctggcatttggtgggtgcccctctgggacgaagcttccagaggaaggaacaggcagcaatctttgctgttctgcagcctctgctggtgatacccaggcaaacagggtctggagtggacatccagcaaactccagtagacctgcagcagaggggcctgttagaagggaaactaacaaacaaaaaggaatagcatcaacatcaacaaaaaggacatccacacaaaaacaccatctaaaagttaccaacataaaagaccaaaggtagataaacccacaaagatgaggaaaaaccagtgcaaaaaggctaaaaattccaaatccagaatgcctcttcttctccaaaggatcacaactcctcaccagcaggggaacaaaactggacaagaatgagtttgacaaattgacagaagtaggcttcagaagatgagtaataacaaaaatccaccaggctaaaggagcatgttctaacccatagcaaggaagctaagaaccttgaaaaaaggtgagcggaatggctatctataatacccgtttagagaagaatataaatgacctgatagagctgaaaaacagcacaagaacttcatgaagcatacacagtatcaatagccaaattgatcaagctgaagaaaggatatcagagattgaagatcaacttaatgaaataaagtgtgaagacaagattaaagaaaaaggaatgaaagtgaatgaacaaagcctcctagaaatataggactatgtgaaaagaccaaacctatgttagactgctgtacctgaaagtgacagggagaatggaaccaagttggaaaacagacttcaggatattatccaggagaacttgcccaacctagcaagataggccaatattcaaattcaggaaataaagagaacaccacaaagacactcttcgagacagcaaccccaagacaaataattgtcagattcaccaaggttgaaatgaaggaaaaaatgttaagggcagccagagagaaaggtcgggttacccacaaagagaagcccatcagactaacagcggatctctttgcagaaaccctacaaaccagaagagagtgggggccaatattcaacattcttaaagaaaagaattttcaacccagaatttcatatcccgccaaactaagcttcataagtgaaggagaaataaaatcctttacagacaagcaaatgctgagagattttgccaccaccaggcctgccttacaagagctcctgaaggaagcactaaatatggagaggaaaaaccagttatcagccactgcaaaaagaagccaaaatgtaaagaccattgacacgacaaagaaactgcagcaactaatgggcaaaataaccagctagccacataatgacaggatcaaattctcacataacaatattaaccttaaatgttaacgggccaaatgtctcagttaaaaggcacagactggcaaattggatagaatcaagacccattggtgtgctgtatttaggagacccatctcacgtgcaaaggcacacataggctcaaaataaagggatggaggaagatttaccaagcaaatggaaagcaaaaaaaaaaaaaaaaaagaaaaaaaaagcaggggttgctatcctagtctctggtaaaacagagtttaaaccaacagagatccaagaagacaaagaaggacactacataatgataaaggtatcaatgcaacaagaagtgctaactatcttaaatatatatgcacccaatacaagagcacccagattcataaagcaagttcttagagacgtaaaaagagactaagactcccacacaataatgtgggagactttaacactccactgtcaatattagacagaacaataagacagaaaattagcaaggatgttcaggacttcaactcagctctagaccaagcagacctaataaacatctacagagctctccacttcaaatcaacagaatatacattcttctcagcaccacatagcacttattctaaaattgactacgtaattggaagtgaaacactcctcagcaaatgcaaaagaacagaaatcataacaaacagtctctcagaccacagtgcaatcaaattagaactcagattaggaaactcattcaaaaccacacaactacatggaaactgagcagcctactcctgaatgactactgggtaaataacaaaattaaggaagaaataaataagttctttgaaaccaatgagaacaaagacacaatgtaccagaatctgtgggacacagctaaagcagtgtttagagggaaatttatagtactacatgcccacaggagaaagcaggaaagacattgaatcgacatcctaagatcacaattaaaaaactagagaagcaagagcaaacaaattcaaaagctagcagaaggtaagaaataactaagagcagaactgaaggagataaagacacgaaaagcccttcaaaaaatcaatgaatccaggagccagttttttgaaaagattaacaaaattgatagaccgctagccatactaataaagaagaaaagagagaataatcaaatagacacaataaaaaaatgataaaggggagatcaccactgatcccacagaaatacaaactaccatcagagaatactataaacacctctacgcaaataaactagaaaatctagaagaaattgataaattcctggacacatacacacacacacccccgccccaccacgactaaaatccctgaatagaccaataacaagttctgaaattgaggcagtaattaatagcctaccaaccaaaaaaaacctgggaccagacagattcacaagtgaattctaccagaggtacaaagaggagctggtaccattccttctgaaactattccaaacaatagaaaaagagggactcctccctaactcgttttatgaggtcagcatcattctgataccaaaacctggcagagaaaaaacataaaaagaaaattacaggccaatatccctgatgaacattgatgtgaaaatcctcaataaaatcctggcaaactgaatccagcagccattaaaagtttatccaccacgatcaagttggcttcatccctgggatgcaaggctggttcaacataagcaaatcaataaatgtaatccatcacataaacagaaccaatgacaaaatcacatgatttcctcaatagatgcagaaaaggccttcgataaaattcaacacaccttcatgctaaaaacactcaataaactaggtatcattggaacatatctcaaaataataagagctatttatgacaagcccgcagccaatatcatactgaatgggcagaagctggaagcattccctttgaaaactagcacaagacaagaatgccctccctcaccactcctgtacaacatagtattggaaattctggccagggcaatcaggcaagagaaagaaagggtatacaaataggaacagaggaagtcaaattatctgtgtttgcagatgacatgattgtatatttagaaaaccctattgtctcatccctaaaactccttaagctaataagcaacttcagtgaggtctcgggatataaaatcaaagtgcaaaaatcacaagtgttccaatacaccaataatagacaaacagatggctaaatcatgagcaaactcccattcacaattgctacaaagagaataaaatacctaggaatacaacttaaaagggatgtgaagaacctcttcaaggagaactacaaaccactgctcaaggaaataagagaggacaaaaataaatggaaaaacgttccatgctcatggataggaagaataaatatcatgaaaatggccatactccccaaagtgatttatagattccatgctattcccatcaagctaccattgactttcttcacagaattagaaaaaaactactttaaattctatatggaaccaaaaaagagcctgtatagccaagacaatcctaagcaaaaagaacaaagctgcaggcatcatgctacctgacttaaaactatactacaaggttacagtaaccaaaacagcatggtactgctaccaaaacaggtatgtagaccaatggaacagaacagaggcctcagaaataacacaactacaaccatctgatctttgaaaaacctgacaaaaacaagcaatagggaaaggattccctatgtaataaataatgttgggaaaactgactaaccttatgcagaaaactgaaactggtccccttccttacaccttatacaaaaattaactcaagatggattaaagatttaaatgtcagactcaaaaccataaaaaccctagaagaaatcctaggcaatatcattcaggacataggcatgggcaaagacttcatgactaaaacaccaaaaacaatggcaacaaaagccaaaactgacaaatgggatctaattaaactaaagagcttctgctcagcaaaagaaactatcatcagagtgaacaggcagccttcagaatgggagaaaatttttgccatctatccatctgacaaagggcgaagatccagattctacaaggaacttaaagaaagttacaagaaaaaaacaaccccatcaaaaagtgggtgaaggatatgaacagacacttttcaaaagaaaacatttatgtggccaactaacatgaaaaaaaagctcatcaccactggtcattaaagaaatgcaaatcaaaaccacaatgagataccatctcatgcctgttagaatggtgatcattaaaaagtcaggaaacaagaaatgctggagaaaatgtggagaaataggaatgcttttacactgctcgtgggagtgtaaattagttcgaccattgtggaagacagtgtggtgattcctcaagtatctagaactagaaataccatttgacccagcaatcccattactgggtatatactcaaaggattataaatcattccactataaagacacatgcacacgcatgtttattatagcactattcacaatagcaaacacttggaaccaacccaaatgcccatcaatgttagactggataaagaaaacgtggcacatatacaccataaaatactacgcatccataaaaaacaatgagttcatgtcctttgcagggcttgaaactggaaaccatcattctcagcaaactaacacaggaacagaaaatcaaacagcgcatgttctcactcataagtgtgagttgaacaatgaaaacatatgggcacagggagaggaacattacacattggggcctgtcgggggttggagggcaaggggagggacagcattaggagaagtacctaatgtagatgatggtttaataggtgccgcaaaccaccatgccgcttgtatacctatgtaaaaaacctgcacattctgcacatgtatcccataatttaaagtataataaaaaaagaataataaaagaaagtgttcatgttacctctcatggaattattttgttttcaaacttggtgcatttggtgcagtgaggagagagaagagaagaactttttcttttatacatgcttgctgtgtacatagagatttccaagatattgaatctatttagattcaggaaaggtggaccaaacacttcaggtaaattcctcaggttttaaaatgattactcatcgcttcaccagattctctgaaattttatcagcagtgtgtgctttatacagatgcttcctgaaaagggggagatacttagtttaatgccatggcttttgttttgtgcttacttcagtgaggaatgagttaaaattcattttttagcctcatctgtttacatttttttctatgagcagatggccagataattacctaaataaggagttacttttctggagttggcctgccaagatttactgtaataccaaatacaaatgctattacaatgaggaacatttggaagcttacatttgtgtgtcaaaatagtaaataatttgaaagctgtatcttttatgcatccttttaggacatgaagttttcaggaagagttgataagggtaatgcaaaccaaataaaggtaatgaaaactaaataatttttaaataattttctgcagctctccattccagtttgttaatacagaatatcttcaattaaaatgtaaatggaattcattgcatgaagcgatctatctggatgatatgtcatcattgaataatttactaacagccactgaacaatgtctaaaataaagtagaatcattgcttcatgattcaaattatgacatgttataatcattcctctttagtactagatgaatgtgagcctgaaaaagtttcttagccttccagagtctttgtgttcccatctacaaaatgaggaaatggaaacacatttcctcaggaatacaagattctttcctgatctaaaattctgtgactttgttatatcttgttttcttctgcactactgatcaagtaacagaaggaagactcatttcagactcagatatgaatttaaatcttgctttctcacttcctagctgtatgtacatgaacaagacacctttgcctgagctacttcatttggaaaaaaatggagaacacgtacctcatgggattacgataaataaacaaggaagtatttaaagttccaatactgattcttcacttatcaagtcctcaataagctgtatttcttttcttatattccatcattttagaattctcaaatctgccttttctatgaaaccttccatcctctcctcccaatagaaaagactacaattctggagaatgtactagacggatgataaaatatagatgagaattatagcagataaaacataaaagacaattttcccctcctcctgagttgtcttagtaaaaagaatgatggcagctcttgaagagagttgtccctcctgctgttcccttttccttttgtcactgaggtctcacatccagtttgcttttgtaaatgaaatacatccaaatcacgagaaagtggcatgcttcctgtatgatagaatacctttcctcattgctcctttccaacaatttttaaattatttttgctattgtatatcccaatttttaaaattaataccaacatgattatttgttcattatacaaaatactagaaaataaataaatgtaagacattaagcataaacacaccgtccagggagagctactttatataacttcctatattttctaactacatgtaaacattatgtaaaacgtgtacaaaacaagagttaatactatatatttctaatgtaagcatcagaataagtgttctataaaggctggggtgtgctttgctttgatatctgtttttcagtaacatgctggacacagggtacgtactggatacccttttaaacttagtatattccatatatctttttgtgtcaataaatacaattctgcagcatcacttttaatgatcacatagtattctacaatatagataaaatcaaaacttaatttatttcctactttgacttgtcaggctttctgtgttttgttcccccataacagtgttttaatcaacacccatgcaaacaaacctatgccccccttcttctttcttctcaatgattttgtttggataaattcttaaaaggagagttgccaagttcaagtaatctactcacaatttagggaatcattacatattgccaattgttctctaaaagattatatcaatttacaatccagtcaactgagattgagcatttttctgcaattgcacgtataggtattatgttgaaaaataaaaataaaaaacacatttaaaaagcaaatcatcgcatcctaagtgttgaacggcaagaacatccattcttcatgctatgttaccagcccacgacaactttccaaacccttttccagatatacaagatcctataacccagcgaagatgcagtctcactaaatcggtataaagagagttctgtcttgtcttactaatttgattaatttaggagaaatgacaggaaagttcatataaattgtccattgacattcacatgaattctctcactttgacattttaccattctacgtcagtatcactttcagtaaataatgttttacatgcagatagttttacaatgcccatttaaattaattctaaactgttatgaaatccataaaaacccttgtggaacatttgtagcttgtacagtagtctcccattatggaatcaaatgtgaaatgtctgtgtgggagctgttttcctaaggtaaatagattattatttatatctctaggtgcaaatgcttttaaataaccagaacatacagcatctgaatatgcccttacataattttcacagctgctgcattcttgtcagtgcactgtcatggtgaagctttgatgctttgatctgagtttgacccctggccatgattcttgcttgtgtttttatcatccactcttaatgtgaacaataaatctgataatatccagtagtgcttccttatgttctctgactttgacattcagaaaaatcattaatgctgcttccactgtgtctacatctccatacttgtgattttcttcccctttgaagatattttagaatacatagtcctggaagtccaggaccaatgactttgtattttctgtattgcatagtgctccgctttgtacttgccgtattgcatagagctcaatttgatatgatcaaatgatgattaccaagagctttagatatgatttcactttttatgaagtaaccaacatgaacgattaggaaggagcctgagtgatagggtgaaattggaggggagaaaatggagaatttagaaagattaagtaacagaaactctatctcaaattgatataaataataagagaagttcacaggcacatgtgcctgaagtacagaggtcagctgacttgagactgttctctcttctgaaatggtgcaagaagaacccttttccatcctgtgagaaggaccctttttcatgctgtcttcatttcctgactctgcttccttcatgctgactccattttgtgcaggcttcctacctcattgtccccagatgcctgtcttgttgacattcaggtttcttcctgattaagctgtccaatctaaatagccaacattctactgtgaacagttgggaacttgaatctcatacctgctatcttattcacattcagcaaacaagagcacaggtttttcactctcaaacaaaattactgagttttgacctaaacaaatcaccctagagcacttgcccattctataccagtaatgcagcttggtatggggtcatgccaattagcttagacttgagtcaaagattctaattcagaggtcaagccagctacccttgaagcacacgggacacattgttccaaagagttggaaccagtaaacaaatggaagtgctaccaccaagagcaagaggaatatatgctaggtggccaaaaaggcagatatccaccaaggtagctacaactaaatggaaacattgggttttacattagttagttcgggctgctgtaacaaaatatcatagactggtggtttaaaccagagaaatgtattttctcacaatctgaagtctggaaatcagagatcagggtgccagtgtggttgggttcttgtgaaggctctcttcctggcttgtagacagctgctttttcactgtgttcttacatgagaaagagagacagagagagagaaagctctgtggtacctctctggtgcccatcatgaaggcctgaccctcatgacctcaactaaacctaattatatttcaaagattccttccttaaataccattgccctgggagctagggcttcaacatatgaactgggtggcggccaggggtgtggcataattcactccacagcattcctcccctgaccttccaaaattcatgtccttcttgcatgcaaaatatatttattccatcccaacagcccccaaattattaactcattccaagatcaactctaatgtccaaagtcttatctaactctcatgtaaatcataggggtgagatacgggtgagactagaagtcgaattcatcctgaagcaaaattgctttccagctataaacctgtgacaccagacaagttatgcacttctaaaacacaagagtgggcaggcatagaatagacattcccattccaaaagaggaaaaaaaacaggaaagaaggaaggcatgatgggtcccaagcaagtccaaaatgtagcaaggcaaatatcatcagatcttaaggctcaaaaatagtcctttttggtttgatgctctgccctccaggtagagatggcaatgtcactcccatgacttgatggggtagccctgcccatttggcctgggattgctgcccctgtggctctctgcagggtccccactctttcaaatggaataagaaacaactcttccccctctgcctgtgatgggagtggcagccctggtgatttcggaatcaccttcaatatcatccttctcttttcttgaagaatagtgcattttcacaaccaaataactcaatggttccatcctatagattccaaaaagtctgacagccttccttcattttacctagcttccatcccttcagttcaaactggtaatgacccctatggtataatctgatctatatttctggcttccgctgggatggctgattaaatccattgttttcaccatctctttatcaagttgtttttaggccacatgtttagtgttctcttcagaaaaagctttctcaatttttcacaatataggtagcctgaaaatcttccaaatatccaagctcttgcatctatgcttaaaaattgcttctacaatttatttctctcttcttgcattttactgttagcagtaaggaggacccaagccctacctttgatattttgcttggaaatctcgtctgctgaacactgaatttcatcacatgcaagttctaactttcacaaaaccctagaacaaaattcagccaagattttttttgcttctacatgacaaaaactgctctttctctagtatccaataacgttttcttcatgtctgtctaagacatcactagaatcaccctttacatctacattcctgctatgcatctcaaaattcttccagcctctacccattgctcagttccaaaaccacttccacgtgtttaagtatttgttacagcagccccttcttattagtacagaatctattataaggaattggctaatggaattatgaaggctgagaactcccaagatctgtagtcaagcaagccaatggagacccaggagagctgatgtgtagttccagtctgagatcaaaggcatgggaaccatgatggtgtaagttctagtccacagttattacactggagacttaagaaaactgggtgtttcagtcagagtctgaaagccagaaaagattattatcccagctcaagcagtcaggcaagaggggttcccttttactaaatctttttgttgtattcaagtcctcaaatgataggatgacgtccatccacgttagcaagggcaatatggtttactcagcctatcaatttaaatgtgaaattcatcaagaaccaccccacccctgccccaccacagacatacacagaataatgtttggccaaatgtctgggcaccccatggctcagtcaagttgacacctacaattaaccatcacatacacacacacacacacacacacacacacacacacacggaaagcttgaagtgtgtgttatactttcaggaattaaattcaaggaagagtttattgagtgaaatgccaaaagcagagatgctgtattcagtaatgattctgctaaaaaagctcagaaacactggtcaaatactgactttttgtatacatatttgttttaatttaatgaaagacatgatttgaagaatctagactagattgctaatatatccattagttcttcaaataaagccattgtaaatgcttgagcagtattatattgctgtgacttcatgtttaagttctctaagaagggactgtagtgcagcattttaagataagtaaagcaagatgtctttatgcttaagatgtctgatctgaagtacccagatttctactgtgaagacttgagaatctaatttttatttggacactagaatgggaaaccatgtaacctaaaagtattcacaacattttctcaataaataaattccttgaatgttctccatcagttgattctgggccatgtggcatttaatgggtaatttttaattcaaaaaaaaaaagaaagcattcattcttagaagaaatttagatggcttctgagacatctggtttcaagtagcatggcactctgcactcgcaaactgctatattaattggcctacagaatgggctatttaagattagctatttaaatgttgggaaatggctactaaatatagtgattttagtttgggggtaattaatggtaacttaatattctaagaataataacaaaatccagctgcttctgccagatagaagcagtaacagttaggatactaatttgctcctataaaaaagccccaaaatgtttatttttgtctcacacaacagtctgaagataagtaacctcctgggcagattttttggtatcaagggtagattctcctaattcctctggcttccttaatattcaactcccatctctaggtctaaaaagcctttgctggtaacttctctcccactccaacatctgccagtggaaaaaaaggggggaaatgaaggatggacacagaaccctccttgtagaaacatgacccaaatgttgccacatcacttctgtttatctctcattggccacaaacatggccacacctagcactaagtaagtctaggagataagatcctttactggacagcattgggcacagttaaaccctgtatcttcatagaaaaaggtgagtatagacagtagggagaaagcaagaaggctttggcacagaccctctgaaggacaggggctatgccccatccaccaaagctaagtaaggggcatctgtccagatctcccagtaagtgtgccaggttgtccaaatagaaataaccatggaaagaacataagattcttatacacttatgaaaatagtgcttctaatgcagcttaccatgacttctagattccagcatgtaaaaaattataacatgtactctttacttctgatgtttttgaatgcccatttttaaaaagtttgggaaatactaaaaataaataaagaagatgacaatcaactacaattccgttagccagagataaccattaagttatctttagttggttttttatggcttttctccatgtgacttttcatttacataattggactcagttttgcattatttatcctgatattaataatatacatttttctcacaccattaaaatgtgattctcaatatcattttacatttgcgttaatttaacctgtagaagttccagaattttttcaacatattactgatgttagatgcttagagtttccagtctttattagtattaataatgctactatcatcatctttatgcataaattttatctgattttgtatttattaatatagaatcttaaaggtgaaataagctcaaatggtagggaaattttaaaggctcttaatctatattgctaaatcactttccaaaaagtgttgtgaaaatttcttcttaaactaattctactagtttttttcatatcaccctcactagcattattacaattaaataaatttgactcagttaattaaatgaaaatggacattcacagccccttgatgactgatgagacctcctatggtttcacatgtaccagcaatgttaccatgattaaattctcatattttgatcatgtattcatttcttgttttaatgcaaatatgaacagtcctgcctgtgttaagcatgaaggcaggtacaaagtaaatgaagatatctcatttaatgacccctacatttaatgatatacaattaatttaatgatagcaatcaacttgatccatccaagaaccttgaagaatatattaaaaaaaaaaaaaaagagaaaggggcttgaattactgattactgaaataaatgacacctcacttatgtgccaaagctcatgcagttttctcagaaggaaagactttaaattcttatttcaaagcacattaattcttaacctagataaaatcctaacacatttgattatatgattttcaaatacgtggcagattaaaaacagcaaagtagaaaggagcagcagacacattaacaacaaataatggtcactgagaaaatgacaaagagaagagatagaaatgtttataacacacacacacacacacacacacacacacacacacaaaaccctgaaattatgttttttaaaatggtgatgtttttaataataacagagtttaagtaaattatagctcatctattcaaagattattaagaagtccttatattatttttacaagaacttttaatgtcacagaaaaaaatcacttttatactaagagggaaagctggatataactttgcagatagaatttaattacaaatatggttttaaatagttgaagagatatcctggaagtactgttcttaggaacagtaagattattttctgtatctcgtaaattttctaaaatgtatatgatgtattaccttaataaagaaaattaactttatgttatttttagaataacattctggaaattttaggagtagaaattattcttttgtatattactaacaaatagaattatacagttatttgtgcttataatggtagcacagttattcaaaaaaaaaaaaaaaaaaagaaaacatcaaatagagccacaggctttattgcagaagacctgggaaagttatctgttgttgaagatttttatccaaagtaaaaataaatgtacagtctatgtaacatgtaaaggtaaacaacagaaattcaaaactcatagttaggggtgattttaaaaatcattatttaggcattggtcttttgaggatgtctcttgagtaatatttaaattatttgttttataaaataatgatcatagtgactatgatggcattagaaagaaaattctcaaattcagtaagtcaaacatcatcacatatttagtgtgctcatgctgtgtaaatactgaaaacactatagaaagtaaaattacatttcaagctggtagaatcccaacaattttaatcaaaatatttttaaattttatatacactcatcttgcatatgagagtggcatgtttatgtaaattgtttttgtagtatctcttaattcgaacttttttgtttctattttgtaggagtaactttcaactacctttacttcgaagaatttatagtattttccagaaaattattaaatgtatgagctttaataatagtcatcggcagactttctaaactaacatgaacaattaaactacagtatttgctccatgaaattataaattacaatggatatatatgtcagtttttacattattgtctcacagacccaaagctatccgttttttttgttttgttttgttttttgttttttttttgagatggagtctctgtctgtcgcccagactggaatgcagtggtgcaatcttggttcactgcaacctccacctcccaggttcaagtgattctcctgcctcagcctcccgagtagctgggattacaggcgcccgccactatgcccagctaacttttttttttttttttttttttttttttgagacagagtctctcttctgtcagccaggctggagtgcagtggcatcatctcggctcactgcaaactccgcctcccgggttcacaccattctcctgcctcaacctcccgagtagctgggactacaggtgcccgccaccacgcccggctaattttttgtatttttagtagagacaaggtttaccaggtcggccaggctggtctcgaactcctgacctgaggtgatccaccttcctcggcttcccaaagtgctgggatttcaggcgtgagctactgcgcccggccaaagctacccttttctgttcagcctcaggatgctggggctgagttcctgcaacccaagtttctgctttgccagcagccacctgctaggccctgccagtagggggctccagaaggaagctgcaaggccggaactgggaggaggaattcacttcaggtacgcttgtagttcctgtatctcctctccagctacccttccttgctgtggcaacaagggttcattccagcagcaactactgaattcagtttgcagtttttctaacatttgcagaaccagctccattgtaccctgctcttcagagacgccagcattagttggccggtgcccctttgtagaaatctgggttgtggcttcacagggctaggggtgtcacatttaacataaaattatgggaaacccaatttcaatctcaggtaaacaatgaataaacatttagtataagtatgtttcccgatattgcatatttaactgtgcttactgtattttatcagcagccatgtgcagggttccttctctaagcttctgtattttaataattccaactatttccctttgctgcctagcccctgagtcagtagctgttttctgctattgctttctttgtgataacttagtgtcatcaacttgatacctccattattctttatattctgtcctgtctcctgactacattgattgatacagtagagttttttaaagcagatactgggatttgacaagataattttcctaccagttaatattcctgtgtataagttaacagggatactcatatggtaactccgatagaagctatccaaactttaacttgcgagtaaatgagttcatatacataatatttgtagttctatgtggttcagagacataagtcatagtaaattcttgtgcatagcatatctcctttatcaacattttaaggaattaaggacttactatgtatactgtgtgtgtcattgtaaaattgtgacaggaggacaagaagaaaaacaatttacagatttaatgtggttgtaaaatacaattattaatttgtaaaatagattaatttctagtccacttgcatctgagttctagactctgggcactaaattcattacttggcaaaatagtcagcacacctggttatatattcatcagctcagtggtatttacatggtgtttgcattgctcttatcaagtttatccaggcttcccatttactctttaccctattcccaccctgttcccagcctgttccaaccactgctatagtggcatctttgactttagtgaccacctaggtaacctcactttttctttctttttttttttttttgcctagtatgaaaatatacccaataccaccttctttattgctgactgggaatgtcctctcaaagctcctaaaattcttgactgtctccttttttgcctttctctagctggactattttgattatacccttctgaactgactctgggtttctggcttgccttgggccacatttctggcttacagtttgggtttcattgtaattccctatttatggctgtagttggttgtacagtgttcacttcaaacccgtcacttcctgcctgaaatcctgtaattgctagtgtttgacattcgaaactcctgatccctgatttgcctcaaacttctggctctcctgtgtgtcctttcatcttacctgaggccctggattagctctggccttgctgctttccaggcctgctgaaataaatgagcaagctatttctagctaaataaaatgagctagaaagaataggctgaactgagagaattaggtgactttatgcatgtctgattatctacgagagtgcagggaaggatgttgcaaagccttgggactgagcttgctggctctggagcacttccttgcctcatctcatgcactgctcatgagaaccccatagggtaggcatcaccctttcaccatccagacttaagaaagaaagattaaagcttagaaaggttacataacttgtccaaaagcacatagtagctaaggaggggagccaggaattaaattcaagctgtttctggtcccactttttttttttaatcactatgctatatatgcttgatttcatataattgagccctcacaatctgtctagttcttcaattcagtgagttttggggtagtaatgattggtttcaagtccaaaaagtttcactggtctcatggcagcagagcaaatgcttttatcatcctaggctcacagcagaagcatgtgcattctgattgaccacacacttcccgccagctgcataaaatcactattcatgatttagattggaaagcatactgatggccagcattttcttcctgtgtatgattgactggcagctgtgactctaaatgcacagaactataggcatgagaataatttcaacaagtatcctttaaagcattatgtcttttttaaaccatcttagccatctttaagtgtatggttcagtagtgtgaagaatattcacataatagtaaaagccatctccagaactgttttggttttgtgaatctgaaactctatacccattaaatcacaactctccttttcccctccctcaattcttttgtttctatgaatttgaccactttctatacctaagaaaagtagaatcttacatagttatcttcttgtgactagcttatttcactttgcctaatatcctcaaggttcatccatgttgtagtacatgacagggttttctttctatgactgaataatatttcattgtacatatataccacatttgtatatctattcattcattggtggacaagtagtttgatgccacttcttggcaatagtgaatagtgctgctgtgaacataaatatgcagatatcttatagaaaccttgctttcaattgtttggaattcataccaagaactgagattatcggatcctatggtatttatttatttttttaattttttgaggaaactccatactgtttcctattgtggtagcattattttacatcctaccaatagtacatggcagttccaatttctccacattctcaccaacacttgctattgtctgtaaaacattatatctttttctttttttaatgatgcaatataatttttatttcaagaaatatgtgacttaagctaatattttgtgagcaaaaatgcagggccaatatatttaaatattatccagcctttcaagtgtgttcactttcagaagctaaatattttcctgaacattccttaagtaaatgaatgacttgctcttttgaacctaaaacacatgcttgtttcctcattcttgtggctaccactgtcttacccagcactaaaagcttcttaaaattagtcagaggaagacaagtgggaaggtgtagacttctcacttcaatagtctgctaaagatggaggaaaaatatggtgctattcaaagacagtctagacttaaagatttagaattttggatggaaataatccggtgaaatagcaagaacatttgaaagagaacttgacaaaccactgctgcagaaagctgaattccaaggaaatatgcccaatatccatgaagctgagaagtaagtttctgaaatcatgcctttctatttttttttaatttttcatttgcctaaaaaatgtcaaccacttgttgaggcaagcggagtcttgctactggaatgtataaattaaccaaatagagtattatgcaaataatagtagattcggatatttgtttagtggcccttttatggagtattagaaattgccaacttttgactttgagaaaagaatatgtgtgttgtcagtaatattttgattctgtgttttttttttaaaaaaaaccttttaaacatttgtcttatttctattaatgtcacttgatttttctggtttccaattcctgtttcattcatagaagcttctagaagtaaatgtcttttttcattttaaacatgaacgcagatgaataaaatgaacttctaatacatttaatgtcacacttgagacaaccatattgagattcttaaaaaattgcttgtatggagaaaagaagattatcattttcagggccaggcacaatggctcacacctataatcccaactctttggaaggccaaggcagacagatcatctgaggtcaggagttcaagaccagcctgaccaacatggagaaaccctgtctctattaaaaatacaaaaattagctgagtgtggtggcaggtgcttgtaatcccagctactagggaggctgagacaggagaatcgcttgaacgtgggaggtggaggttgcagtaaactgaggtcgcaccactgcaccacagcctgggcaacagaatgagactctgtctcaaaaaaaaaaaaaaaaaaaaacctaaaaaacaacaacaacaaaaagaaaattatcattttctagccagtgactagtaaattttctaaacctatcagataatttataacaataatggatttaaaaaacaagcaagacagatttttttctattgacatatatatatatatatatatatatatgaaggaacatatatatatatatgaaggtaaatactgatcaaaattcaaaatccagggcagctcacttggagagaaataaaaataacaaagacctattaggtaaaacaagattatttggaactataggagtaagagttaagaataaactaaaaacaaagcacttgttctttgtggcagctgaaaatagcaaacctggggacaacaaggtttttcttcccatattctctatgctggttagctggcatgatgactaaaacagaattgtgcctgccattgtagagcttacaattatttcttcttggtggtagtattccacaatggagagcgttaaataaaagtaggcagtcttttacaacattttaatttagtctttgttaatgttaaagagacaaattccttattgagtttctgagcaaagcttaataataatgaagttagaggaaaaacacccaccacattttataaagtagtgaaaaaagcttattaagccacagaagtgttgtttttcctctttttagaaaataaccactaaagcttatcacttgacaagcaggcttattttacaaagaacttactaatttataaaataataagactttggagaagcatcttccttatcaattgtcttatacgtttcagggacatgatggaccaaaccaatgtcacagtctcttggcaccacttttaggatatgaatatatttggcaccctccccacagtgttcagccttggggttctcagccaaaactaaaacaaagttccatttccattgcttctctacttctatgacataatgtggttatgctattttaaacttattcctattgattaagtttttagttgttaggagggagttttttttgaaaaagactaaaattatttgtgtctaaatatataactttcataaacagagtatgaattagaaagtatagtttttccttaagctttaagggcaattcataaggctaagtatttttcatataaaatatagtcacttgattccactgactcgtgactctaatgggttaagttccccaaaatttactctcatttacaagcctattaaacttctttaaatacttcaagctaaattacaaatttatatgatttttaacaaacactttaaatgcctgataggacaaacttaaagtgtaataagccaatgcttgctaaacacttaacctctgtaaaactaataaatcaaacctataaatgtagtaaattagattctcctaagcatttcaaacatcttaaaatcaggactggaagcaagagttccagtaaaagatggcggattaaatgcaaccattaaggtctgttccatttttatcctcaactaaaatgacagtaaaaggattttctaagaagacatatgccaaaaggaccaaaaccagaagaggaggtaacagtgataaaatttcgtagtttgaaggcaatttagcagacccaagaaagctaatgctaacagtgggaataactgagaagcacccaatttacagtgtggaactcctgaaagtagttggtgatgttgagtattttaaaaagtaggagtaaagataaagctaaagtatcttttcgaaaagcagattgacctaggagagaagacttaacgttactgacattaagaattctcttaggaccagctcaatcagagcatgctacagtcaagaccacagttactgcctcacttccaatctgcttttttagtgtcttgttcttaaatgggaaatttattgaggttcaactcctaatatgagaacactgactaaaccaaggacacagaaaagaaaaattggaaggaaaagaaaatacttgggaagaaagaaaaccatctaaagagattcttagcattctcaaaaggataaaatagattgtatccaggaaaccaaaatagggtgatacaaaaagggatattcaggaaacaaatttctaggaagttaaaggtataattgcataaatgaaaaacccagtaaaagctttgaaggaaatgtttctgaaagtagaaaagagatgaaaataatagagaaaaagtagagaaacctgagggccagtcatggaactccatcatccaaacaggatctccagaaagagataccagacttaaaaaaagagaggggtgttcgggggaggggggagaaaagtcaaagaaataatgtgagaaaatttcccagaactgaaggacatgagtttccaaattgaaagggcccagtagcaagaacaatgaaaaaaaggctcacactcaggcatattatcatgaaacttcagaaaacttgtttcaaagaaaagattcttaaatcatgagggagacatattcattcaatggatcaagaatcagaatgacataggacttctctatagcaatactagaagctacgaagtaagagtatgcctttaaaatttgaatggtaaatggtaaattatttcctatcaatagttttactatcattataaatcaactatgagtagaataaagccattttcatatatgcacattttaaaaatttccctcccattacagtttctcaagtgctccagcaatatgagaaagaaaaaaaatggaatccaagaaataggagatatccataaggaagaagtgaagggaatcctgcacagggtgattctaagacagctataccacataaaaacagtctaggctggtgcaggtctgagaaaataattcagagtggttggttctggagagtaggaaaaagggtgggattggggggattgctttattttacaagtcaattagaactagctatttgcttctttagtttatgtggaactttgataaaaatttaaacttataaagagacaaaacataatttaaatgccatgtcaattagaaaatccactgttcctctataaactcaacttgaataatggttattccttcatcatctctgcacttttatggtatactttcctggggtgaaaagttgcttatttgactaaggagaattttatcatcatctccagtctacaacagcaactatgaccataggtttgtgttgtggatggcaattctagaatagggcttctcagagatatttctaggaaaattctatctaaaaacaagatagcaatccaagtcccttctttcagtgggacttctaaagcccactccttttcttacaccctagtgcatcccaggttattttattcactattttcctgttatctcaggcaactttagtctaaaccaacttgctaggttgtatatccattacccagattagaatttctcttttctacctgattgaattcagtactcttttaaaattttacattatttcattatccaccattctacatgctatagtaatttaattcagttcctcatggaacttatgttacatatcagcagaaggcaaaaactatataaatgaacatgaatgtagggcatgagtaaattgtagagtaagttaggtaacagatgctatggagtaaagaaaatgccaagccaggtaaaggaagtcagaagtgccaaagaggggatgtgtcacaatctttaatggtagtaagagtaagcctcattgagaagatgacttaagtaagtaaaaaattgaaggaggtaagggagttagtaatgtagatacattgggaaatggcattccaagaagcaggaaagtaaggccttgagatgggagcttgctttgcatatttcagaaatatccaggtacatgttactagagtgaacaacaggagaatatatgggagatgcctttggagagataatgggggctaaattatatgacatcttagaagcttttactcccaattagactttttactctaattctgggctagagtttttactcccagtgaaatgataagtgattagtgattttgagcaatgatttggcaaatctgacttacattttgagagacttgttctaactagaacgtggaaaacaaattgttggaacatcaagattggaagcagaccagttaggaagttatagccatgattcaggtgagaaacatggtagttgagaccaagatggtagtgctagaggtggtgagaagtggtcacattctgtatatactttaaagatagagcggacacattttcctggtgaatacgatggggtgagtgtgaaggagtagaaagaaagaaaaaaaaagagagaagaaaaacaaacaaagcagtcatgtattcctcccccaagttttgacctgagaatataatggatttgacctcacatacagtgggaacagtgaaggtggcacaggtttgcagagaattcaggagtttacttctgagcatagtcaagtttcaggtgttagctaaatctctaaattgagaaatggaataaactagctggctatttgaatgtggagtttgggggagaaactgtactagaaatattgatttaggagtcttcaatacatgggtgatagcaaaaaccatggaagagctcagcaaaggagaaagcatagatagatgatctgtgctaaggcctagtatttccagtgttgggtaggaagaagtagacctggaaaagagactgagaaggagcagcagtggaggaggaaaatcaggagattgtgatgtcctgggggcgagtgaggaaagcaggtgggaagaagatagagataaatgtgttgaatgagaactgagatgactgtttatcaaggaggaggtcattggtgacttcagcaagagcagttcagtgcagtggtgggtctctaggcccacttagaatggattttaaaaagagcatggaaagagacgatttagaaatggtaattagggaaaatttctaggatttttgctgtaaagagaagcagtagaaaggagtgttcatccatagtgtaaattgggtcaggagagggttttattaagatgagaaagtaacagagtatttttatgtggattaatccagtagaggtggaaaatttgatgatatagaggagagtaaagagtttcaagattgtctctgaataggtgagagaggatggggatacattagcttaaagtagaagcatctgagaaggttgagtcggtgggcacagatactggtaggtgggtcgatgtggtattgagtctgtggaagttctctaatttttttttttcagtaaagtagggaccaagattatcagtggagattaaggatgttggaagagtttcttgggtttgcagggaaagaacaaatggcgtgaaattatcctctaggagagtaggagagtgaatgaactatgaaaatatactacaaagatcaggcagcactaaagtttcacttgaagctcacactcataaatatcttagcaaagcttgcttatcattatgacagagttatatttgaaaatacaaagacatcttagttatggttgttattttaaggtggactttaaataaagaatgttctcaaatgatgggctgcagcacttctcagagaagtcccagtagataggtttgtaatcatcattggggttctggttgaggcgtgctcacacctgtggccattgctgtgcctgaataaactatgtagcatggtttttccttccctcctcttcatgaaacctccctctcttcttgcatgttttctttttcttaagggtatagactggaacattaatatttgaatcactgagtataatcattatttgagctgtggaagaggaaaagaaaatggtactaggatgcctagtacagagaaggaaaagatagatatttaggtaaagaattacttagaataatagatccgtgaaggtaagaccagttgaaccatcttctaaatataaacaattttttttttttttgagacagagtctcgctctgtcacccaggctggagtgcagtggcacaatctcggctcactgcaagctccgcctgtggggttcacgccattctcctgcctcagcctcccaagtagctgggactacaggcacccgccaccacgcccggctaattatttttgtttttgtatttttaatagagatggggtttcaccatgttagccaggatggtctcgatctcctgacctcgtgatccgcccacctcggcctcccaaagtgctggaattacaggcatgagccaccgcatccggccaacaatttttttttttttaaatagaagaagaaactgcagtgatgggttggaaattcaatatatctcaaaggactcctaacctattttgagttatctttgataggactgccagatattgggttaactgagcactgaagctcttctttaatgatctaatgtgccaagcaaggaggaaaatgttcattggttcttggtcttcatttatgtgcaagaaattcatataatttctcatttactttttttttttttgagacagtcttgctctgtcacccaggctagagtgcagtggcgcgatcttggctcactgcaacctctgcctcccgggttcaagcaattctcctgcctcagcctcccgagtagctgggaacaggcatccactgtgcctggctaatttttgtatttgtagtagacagggtttcaccatcttggccaggctggtctcaaactcctgacttcatgatccgccctcctcggcctcccaaagtgctgggattacaggtatgagccaccgcgcccagcctctcatttaattttaaaccaagcaatttcttttaatatggtataatagttaaaagcttcctatcagggcttgtatatctcagctgcacaatactaggcagattacttaatctttcactgtctgatgttttaatatctaactcataactttgtaaccaaaatgcagattccatcacacactgtgtgcaaagtccaactaacaagagcgatgtctggtataaagaaagtggctttattccaaagcttagcttagggaaagaggtgcaggctccttcctgcctttagtggactgcttcacttttggggcagaaagccgaagctttaaagggggacttggtgtgaacagcatgcaggggagagagcgagcaggtgctgatcattttggtgccttatctactgggtggtgagctggcaccatcacaggcagatgtgggttgtaaaatggccattgtctcaagacaccctccaggtgggagagagttccatcgcagggcacaccttaggttgtaaattggctgttgtctctaggcagcttggtgagacagagttctggccctggagccttttttttttttttttccacagcagagacaagtgaacatttatttttatgcctttcttcctatgtgtatttcaagtctttttcaaaacaaggccccaggactctccagattcaattatgtccttgggcttggttgactgctgcaggagtcttagggagccttgtacaaatgctagagtgactcatttaccaacagtaaaccctaggatagatccaacaaagcaggaatgtgccgatttcagacgacgcagcacccaatgtagaaaacgctggaatttttccttggaactagactgtgatgagaggtgcttgacatgaacataagctactgtcttttctgctttttgagatggagtttcgcttgttgcccaggctggagtgcaatggcatgaactcggctcactgcaactcccgcctcccaggttcaaacgattctcctgcctcagcctcctgagtagctgggattacagacatatgccaccatgcccgactaatttttctatttttagtagagtcggcatttctccatgttggtcaggctggtcttaaactcccaacctcaggtgacccgcccacctcagcctcccaaagtgttgggattacaggtatgaaccaccatgcccggccagctactgtcttttctttgacccttcctttccagtttttgaagataaagcaggaaataatcttctctgaagatacttgataaaaattcccaaaacgacaaaacacatgcttccacttcattgataaaaaatttaatgcagtttggcacctaagagtatgacaacagcaatagaaagtaatttcaaagagttacgatttcttcagcaaaatagatgattcatatcttcaagtcctttttgaaatcagttattaatattattctttccccatttccatctaaatgactgcggcaatacaggtttttggtttttgttgttgttgttgttgttgttgttgtttgagacggagtctcgctctgtcgcccaggctggaatgcactggcacgatcttggctcactgcaatctctgcctcctgggttcaagcgattttcctgccttagcctctcaagtacctgggactacaggcatgcgccaccacacccagctcatttttgtatttttagtagagacagggtttcaccatgttggccaggatggtctcaatctcctgacctcatggtctgcccgccttggcttcccaaagtgctgggattacaggcatgagccaccgtgcccggccagcaatacggtttttagttactcgacatctttaagcctataactcttaggctatgcatagccccatgtcctaatcaggcattcactgatcccagcaggtctccatctatttgtaccagcctcttctttcctcccaatctcaaggttactcttaaatactagtaaatgcaaaaagaacttgtaaagtggcaaggcatggcctatcaaaagtcagcccaagggcagttttcagccctgcctcacctgggtctagctcagctggcgggtgagctgattgatgtgttcaccccgatagccaggtgtgcccatctccttgaggaagcccactctatttttggtagcatgagtggacctggagcttttgagataagtacacattttgagataagtacatagttagataagcttgccctgtggggagcatctggtgaagggaaggtaaagggtatcattgcgtttctaaagaactaagtctggattaagaaaatgtggcacatttacaccacggaatactatgcagccataaaaaaggatgagttcttgtcctttgtagggacatggataaaactggaaaccatcattctcagcaaactatcgcaaggacaaaaaaccaaacaccacatgttctcactcataggtgggaattgaacaatgagaacacatggacacaggaaggggaacatcacacactggggactgttgtggggtggggggaggggggaggggggagggatagcattaggaggtatacctaatgctaaatgacgagttaatgggtgcagcacaccaacatggcacatgtatacatatgtaacaaacgtgcacgttgtgcacatgtaccctaaaacttaaagtataattaaaaaaaaaaagaactaagtaggaggtaggaaacaaggggaaaggaggaaagaaaaattattaaaaaataactcttactcttagaaaaatgggagtacttggttacaagtctagtccataaattaaatgtataattatagataagttaccttttaccacttatttccaacattccaaaggtcacacagctggtaaacataacacagctgggaatcataaatattgctaccaccaccactacccacccaattattgggggagtggggagggtcccatgactgtttcccagttggatgaaataagaaaccaaaaatgagtttttcttgatccttgaattgaaaactccatttttacagaaagaaaagacattttacaatccatttctctgaaaacatccgttctttatctcacaggatgtaataacttgatgggaaatttaaacgcaaggttattcataaaatggtaaatgaggggacacctggcgtgagagctgcagcggcatttccgacacactgctgccccctgctgcctgatacatcgttttccttcttcacgtgtactcaaaattaacactgtctgtcacccagattataaaatcatactgaggagaaaactgaggccctgaaagtgatctggatgacatggatagtagaagatttagattatggaaaagtcacttcttcctgctttaccatattgccttttccctattaaattaaaagtcaacaaactactgtgtgcctacgtagaagtactcaaaatggagaagtgaaaatcaagatctttgcacttacataactcatattcttgtgtgagtaaacagccaataaataagaaaaaatcaataaataatttaagagaataatagatgtattaaatagtaacaatgataaagatttctggagtactaggagaacatggaattcaaggcactgttcccagtgctttccatgatttctttcatttgattctcactgcaacctgcaaatagctacttcactttacagatgaagatattgaggcagggctagaatgatcctaagtgatggaaccaagattcgaaaccaagccacttctgactccagaagtgtctagggtagtctgctctgagaaggcaacagtgaaatgaagagaagaagccaggcttttgaagatctaagggaagagcaagcacaaaggcctggaagtggaagtgagtttggtatagcaaggtatagggaaaaacaaacaagcaaacaaaaaccatcccatatgattgtactaaaggagcatgcagaagactagcagaggccaggtcatggtagggagcttggattttattctaaattgcaagaggaagccattgaaggatttcaatcagagcaccaacctgatttatggtataaggagctcactctggatgttgaaaggaaaacagatggtaggataagagtttcctgtttctaccatttatatagacattgcataaacgctagcaatactgaactccatgttttctaaatgtgacccctacagtctcctgttcctttttcaggtgttttcctctgtttagaatcccttccttgagtcctctcctttccattgcagcctgccttttaagatttcttttgtgaagctttcccggattcttcaattatataatttccatcctttgaactctgtatatttcaagtatagcttttctgtgttaacctctgtcctaggatatctgttatttgactgcctacctcacggactgttagatcccaatcttgagatcaagggctaggactttcaggccatcctgtataagtatgcacgttgactccttcacaagggcacccgacccgccggaactctgctaaccaaactgagctccctgacacaggctgcacccatgaaggggagagtccttttttgtctaatttgtatagagatatcatataaaatagtggatccagaattgatttctttcatctttgcatccgaaacagcacatcacatctagcaatagaagtatacacatagtagatattttatcaaacctttttattaataattgattctgatttggccaggcacgatggctcatgcctgtaatcccagcactttgggaggccaaggcgggcggatcatgaggtcaggagatcgagaccatcctggctaacacggtgaaaccccgtctctgctaaaatacaaaaaattagccgggtgtggtggcaggcgcctgtggtcccagctactcgggaggctgaggcaggagaatggcgtgaaccaggaggcagatcttgcagtgtgcagaaatcgcgccacggcactccagcctgggcgacagagcgagactccatctctaataataataataatagattctgatttaactaagtccagttgtggaaagtaagatgaaaaactcaaggtttatggtatgctttactcatttaccaaggctatatgcagaaaggaatgggattggacatcctgccaagcccccctgcacagccaccatatctcaattgcttgataggctgtggtttgtgtaaaaagagggaaacaaagcgtagatgacagatttaaggtacgtcaaactggaacaggccgttatgttgaagtgttaggacactgcagtgcaccacagtctatgataccatggtttagaaaccttgaggacttttgttaagattgctgatgacatattttcagcaaaggtcacaatatccaggggaagtaaaatataagggtgtattcaattgctgaggctttattttttttttctccagctagcagtgtaaaggacatgtgtctctattttgggagctgatttcttcttagtccccattaaagtgaaactctaataagggtatgtcagcaccaatgtttctatgtaagaggacctccttgtcatctttgaaattaatttgaaattaaatgattaattcatcgtctgtttccactggaagtttgtataagtggtcctaaaaccagcaaagctggggatagtcctctttgttacatgcaagactggaagaatcatgtcagacccccacggaagccttgggaacccacccttaactgctgcttttgttttcagaaccttattagttgagagttgtacctcctgttttcagacctcctagtgttctcatctgcctttctgccttcagtgtgagtacataatctcttctcagagcaagtttagttgaaaataaagttttggcacctaaaaaaataagaggaggcgaccagcaagactgtgaggcatggaatctggagcacagggatactgataagaatgaactgattcatattgctgctaagactcagaactgacctatgaaacatagcagagtgggcacaaatgaaccagagccgggctctcctcccttggaaggtgctcagtatttacacaatgccccttgtctgtaagggcaagtactacatcagagggaaattggcaggggaattgttggaactggaaagtatcagagtgatgaaagaggcagctcttgtttagctctgttaagctgttgctctgcagatgcctgcccattgctgctagatttttcagtggaagttgatgttctgcatttttatgaaacactttctattctttaaatgttgtcaatcaattcaaaaaagcttttgaaacatataggcaaaaccacagtcttctttgtgtggacgaccagtttgcaacccttgccttaaaattataaccaacttctgttctctagactctgagaaagaagcatgcacagaactatcattttgctttgttaaaaagcagtctgatcattaccttctctgtttaaagaagtatcatttctccttaagagtgtagaactggccgggtgcgctggctcacgcctgtaatcccagcattttgggaggccaaggagggaggatcacgaggtcaggagttcgagacaagcctggccaacatagcgaaaccccgtctctactaaaaatacaaaaattagccaggcatggtcgtgggcgcttgtaatcccagctacccatgaggctgaggcaggagaatcactcgaacccgagaggcagaggttgcagtgagctgagactgcaccactgcactccagcctgggcgacaagagtgaaactccgtctcaaaaaaaaaaaaaaaaaaaagaaaagaaaaagaaaacgaaagagtgctagaactgtaactcatggggggaaaataggaagaaaggcagcatttatcttgtttgtttgttttctggtcacttttaccagcatggaataatgctggaaatagcctttcttccttgcttgtaaataatcccacatgcctcatagagatgcagcatatcccataaacatttgtgccaggtaaaactcctagagcagtattcaaattctcaaaacttgctgaaattagaattcagtacacatttgagtatttttggaaatggaatctgtagcatgtctagctacaggtgcaggtcaggggagactggtgaatatgaacccttgaaaaagaaagtgttgaataaggatttagatttttgaaaaatgaattctaaatatttcttccttctcctaattttgtaatttcaagttatcatttatttttaaatataaattttagcaaaactttctactgacgcttcttttcttttattcattccgtttgttcaataaatatttattgagcacctactaataccaaagatcagtctaggcacacaagatcaacaggttatcaaaacagatgaaagggctggatgcagtggctcacatctacaatccccacactttgggaggccaaggtgggcagatcacttgagatcaggagtttgggaccagcctggccaacatggggaaactctgtctctactaaaaaatacaaaattaactgggcatggtggtgtgtgtctgtaatccctgctacttgggaggctgaggcatgagaatcacttgaacccaggaggcatagtttgcagtgagttgagatcacaccactgcactccagcctggggacacagagtctcactctgtctcaaaaaaacaaacaaacttatgaagagccctgccatcaaggagcttacaatccagtactaataaataataaatttatcagcaaattagaagcaaatgagtgcaatggaagaagtaaaattgaagcaggttaagagggatcaaaaatagagggtgtacacattgtatttttagagaggtcagagtgggccttggtgacttttcagcaatgactcatagagaggaggttggtgtttttttaattgactttcccactccatagagtcaatggttctctccatttatccaagtagtatacgttaaatggtaaagaactagtacgtggatggggccgggtgcggtggctcacgcctgtaatcccagcactttgggaggctgagacgggtggatcatgaggtcaggaaatcaagaccattgtggccagcatggtgaaaccccgtctctactaacaatacaaaaattatctgggcatggtggtgtgcacctgtagtcctagatactcaggaggctgaggcaggagtatggcttgaacctgggaggcggaggctgcagtgagctgagatcgcaccactgcactccagcctggggacagagcgagactgcacctcaaaaacaaacaaacaaaaaaaagaactagtacgtggtatgtacacctcatagaacacatctttaaaacaaagagggaaagtgctatggtctgaatgtttatgtctccccaaaattcatatgctgaaaccctaaaccccaagacgatgctgttcaaaggtgagcctttgggggggtgattaagtcatgggggcagaggcctcataaatgggattagtgtctttacaaaataggctcaggagagaccccgtcactcctgtgaagttagagtgagatgatgtctgcctgtgagaaagcaggctccttccagaacctgcaggcaccttgatcttggaattctcagcctccagaatcatgagaaatagatttctgttctttgtaagccacaatcattttatgatatttttgttatagcaggctgaatggactaagaaaggaagacaaatttaacacaaacagttctacaaaataaactgcttaaagaatatctgttttgggtattttatatttgtacaataagggaaaggactatttaaaaaatagttttctctcaagcttttagcttgcaaagttcttctcacacatttttatttgatgttcgttataactcattgagacaggtggaattatttccatattctaggtgaaaagatgaagcttacaggtttgcttaagtcactcccccttaagcgatcccacattgcccctcggattccccattccccagatctctgatcactattcacaaggcccttcacgatctggcttctgcttcatttccacagcatctcttgctaatttcctctttactgcccacactgccccaatatctagctacttcctttcactatttgctaagctctccctttcttgcctttggacttttgcacatactattttttgtcacctcctctggccaccctctaaagattatcccagtctccacttgggcatcatttatttcccagtgctagaacctctcatacaaaatcatctgagtccagggccttccccctgttccacaggcacctcctggccactatagtttctcttaatatttctcctttagagtcctacatgatggtccccacccctcatccaaaccttttaaacttgtggaggagcttgaagcttagatagggtgaaatccgtaatctaggtcagccttttctcccctttttgaatttttttcttgacctttcaagatgagagattagtggcttaacacatggcttctctgaaagtttaatgtcttataaggtatctccttcagactcacttctgctaacttcagtttttcctgccaggtgcttcctgtccttatcacagctctatcactacaggaggaaaggtaactcctgcctctctttctgtgggcctctctaaaactcctccagttttgataataacttaccaatcaatgtctggcaatttcacagttctgcgattgtcctccctgcttcctctgtggaagcaagcccagtgtgctcactgtggtttgattcctgctttcaggaaccgacatgtccaaaattcaaaagacaactgtttttaagctacatattatataagctgtatagtaattctaactaatgccttttaatatttttggaaagtttacaaatatccatagaaaacagaagtcatgagctgaacaattgctaattttgaagtgattaatattcatatttacatagtccagttggaatacattcaggatgaaattttagtgtaaacttcaccattgaacaatatcttcaaaaacttaatctcacaagtgagggatattttgcctcagaaaaaaaataaaataaaacaagaggaggcccctgatattttaagcaaatataattacctgaaatagaagctgaatttgtaaagaattatttctcgtgtccttaattttaaaaagtattaccttcaggtttcatttgataaaacttgggaaattattttaaaaattagcttttattttggagaaaattataaacacatgagaaagaggggacattgtagacaagttcagtggcttcatttagtaggcctcatttcatttaaggagcctagctgaaaggcaaatgtgaggatgacattgcctccttctcatgcacaatgagtagttttctttctccccagttgctatttattactgaaagatgaaaatgtcagtatttcttttaacagaagctaatgcagcacctcagatggtgaaaactggtggcaggacacaaagttactcaaccagagtagtttaaaagtgtgcacttttaaaatcaaatgtaattgtaactcagtggtcaaaaatgaaaaaggatgctgagcctgaattcaatatttcatgattagagagacttcttactatatatattttttccttctaatgtctgacctggatcatatttattcctcaaccaggaacaaaaggagattctttaattttcttttgatccacatgtgtattggattgttgtcaaatttcttactggaaaaggttaggttaatattttgataacagataaaatcttcaaagtaagccagaagcttaagtaatgcaagttagatttcatgtgctagaatgtcaaggataaagcgtagaggaaggatttgcaagtcatccataaaatgattatccttagtgtaaagtttatattcctccatgccaacaactcttttaacgtattaccttgtcctttatattcaggtgccagaagaaaccttagagcagcagtccccaaccttttcggtatcagggaccagagagacaatttttccagggacctggggtaggggtgttgggggttggggagatggtttctggatgaaactgttccaccacagatgatcaggcattagattcttataagaagtgtgcaacctggatccctcacatgtgcagtttatatagggttgatgcttctatgaagatctaatgctgccggtgatctgacaggaggcagagatcaggcagtaatgctcacttgcccactgctcatcttctgctttgcagactggttcctaacaggccaagggccagtaccagtctgtggccctagggttgaggactcctgccttagagagtccaagagtagcaaacccatatacttatttggggccaagcagttacaatggatgagcatatctgtcacttgtaagtaataggagtaatggaaaccatgggaatttgagagcatatgtcctatttaaagatattcaaatcaacttaaaaataaatgttgtgccttccatacaaagtccatccacaaacccaatgtggcctgtggctctccagttttctccccttacagtttagcccggcctagactacagtttcttccaacctctcatccaaggcctaggttctttcttgagcactcctaccagtggccattcagcttctgtttgagcaattccagttgcaagaattttgggggactgtcaagtcctttgccaatcatattagtggtggtagtgatggtagtatcttttgtgctttaggataaaatcagaacagattagtgagttttaacagtagattgctctgaccaacaaggatccaatggacctctttttgttttgtgattgttccttgagactctgtccctgttgaggattataatgctttgtttcatggaagatatagtcagtttcagaactgtacaatgtgatcttactttttcttatattattccaggtttacttctatggctcatgtcatataggctgatctcagaagggcctgcttgccattagcattggttcaccccatcacatgcttactgactgatttcttcatgctaggcactgtctaattactgggatacaggagacaaaaggtcataaagagctatcctttcctggggcttacattttagttagggaaataaatacaatcaagaaaacaaaaacatggtaattaaatgttctaataaattctctgaaggaaatagaggctggaggagggaggcaggaggtagccagatcatgcagcctagtagacttccaggctattaggagtttggagtattgtaagaaaatagtgagaagccactgaaggattttaagcagaataactgatcttagggcactgtttgcaaagtgagaacactaacatatattcagtgtagaaatttgagaaaatacccaaaaaagttaaaaagaatatccattatgcaagagaccattacccagagacaagtctggtgtaggatgggaggtatggtagccagaattctaaaatggctcctgtctttatctgttccggctgctaaaacagaataccacagactgagtagcttaaacaacaaacatttatttctcacagtttggaagctggaaagcccaagactgaggcgcaagcagatctgggtctggtgaagcactccagctggcttgtagaagccatcttttccttgtatcctcacatggagagagcccgggcccttccatctaatatactagaaggacactaattccctcatgggttccacccccatttcctaatataaccatgattttaccttctaaaggctccgtctcctaatattatcctattggatttgggtttgggtttccatatatgaattctggggagtcacaaacaggcagttcatcacagttcccaagattcccatcctctggtgtgcattccctgggtactcttttcctcctgcctatgggaatgtgaacatgaataagatttatcattattttgattaggttacattatgtagcaaaggtgaaaggattttttagaaatgtaattaaagtgtttgatcagttatattaagttttttaaggagattatcctgtgtgggcctgacctagtcaagggagccctttaaaagaggctctagaggtcagagacagaagtcagagagattcagagcagtagatgcgctttactgttggcttaaagaaaattgctgtgtagagaaacccaagtggcaagaagtgatgggtgacccttcattgctgagggcctcactcctacaaccgaaaggaaatgtgttatgacgcccagtgatcttgaagaggctcagatctgagattgcaacccaagccaacacctggatttcagcctagagagaacccaggaaagccatgccaggattcctagcccacaaaaccgtgggtagtaaattgtgagagaataaataattgttttttctaagccactagatttatagtaattgttgcacagcaatagcaaactcatacaaagggaatgacatgattttctctgtaaccaaactgactggagagggacaagagtagaggccattgagaaagtcaccgtcgtggtctaggcaaaagataagcatggcctggagtggcttggaaagaagtagacagactttgaattatgttttggaagtgaaacagggctagctagctgataaatacagtttggagggtgaaagaaatgaaatcgtcaagaatgattcttacaactttggtataagcaaatgagtggatggtggtgctgtctagtaaatattgaaagaatagggaaggaatattttgttctgtggagttaacaagagtggtggaagatggtgttcagttttattaatattctattttaccaaattagaagttaggtgaacttcatatacatatgtatgtgtatatatacatgtatatatgtatgcatgttgtattacatatgattatgtgtttattttataaaaattatgatagtacatttcttcatgttactttttctccacttaacagtaaaaacataaatattaataattataaaatattctaccctgtgcagtcccttattcctctattgtttgttttttgttttattttgttttgtttgttttttgcttttatgttgtcctagtgaatattcttatcctttcaggtttattcaaatgtattagattacccttcagaaagatgatttatatttacattcctcataatggtatataagaaagctagttgaccccattttcaccactgggtattattattttaaaagcatctttgccattttaaaggtaaaaaaactcacttctctattaatgtttcatagcctgtatatcttgaaggtatgcttcagtgttttgtactatttcttcttgcctggcctaacatctctcactgtatttgacatgcgtatgactggagtcaggtcctgttgttagtaagaatgatgccattaagtcacacatcctctgtgataacatgggtattacctctgacatttcttgagattgtatctagaatcagaaagccttgatgctgtccttatatacaaatcagcttttttctaaaaacatacagtgtatagttatttttacaccttgcctatataaaataaaaagcaaaaaaaaagtcagtaacatttttcatctggcttttctgtattttttaaatggtatatggtagataatactaccatctttttcagctaaaactgtcaagtaaaacctccacaacgtatttcaagaatcagttatgagaggtgtattaagtgaatgagagtgtgtattatttaataatagctccctttgggtgatgggtttatgatgggtgattgttattttgtttttgttgcttttctatattgccaaaacttttaatatggaacgtgtaattctcccttaaaaagaaaggtttgaatagagctttaaattttaataaagagtactttaagatgtcttagaaagcaagtctgtaaaattgctttaaaaatcaagaacagggccgggcacagtggctcacacctataatcccagtaatttgggaggctgaggcgggtggatcacttgaggtcagcagttcaagaccagcctagccaacatggtgaaaccccctctctactaaaaatataaaaattagctgggcgtggtggtgcatgcctgtagtcccagctactcgggaggctgaggcaggagactcgcttaaacccaggaggcggttgttgcagtgagccgagatagtgccactgcactccagcctgggcaacagagtgagactccatctcaaaaaacaaacaaacaaacaaacaaaaaacagaagaaacctgaacacttgcagggattaaatgggaaaactttttaaaaagcaggtgtataccgtctattaactgtgtgccatagcacttggccacaaaccaagtatacttttgaaacccctaactaatctttaaatatattttcaaacaccttttaaaaatgtgtcaggggcaaaaatgtcaaaagcattatgactcctatgggtgaagggataagccacgatgcttgaagtcaggggtcttggctttcacagggaaagacaggatttcaccatgttgtccaagctggtctcaaactcctgacctcaagtaatccacccgcctcggcctcccaaagtgctgggattacaagtgtgagccacccgtatacagtattattgatatcctccaaaccagataggatatttagctttttgtaaaattctataggtattaaagcttgcagcattaaaaagcactgcttttgaactctgacagatgcagacaatatatccagtaacaaaactgagtttctttactaacatattttgatagcgtgaccttaaacttgagacaaaaaggagagaggaagagttttattgaataaacgtttctaggaaacagatgcttaacaaatggttgtacagctgtttgcaataacatggaagaagcctatctttcgataattgtgacataagtttttcttgtttgttctcctagagttgtctgcaaaaagtttatgtaatatgcctgaaggttatactaagaaggaagcatttcagaaatgattgaagctgtttatctgtgtgcaaaagcctgtaagtgtgtttgtgtgggcctgggcacgtgtatatgcctgtgattcacacatttcttttcacaaaagatttgaggtcactcaggatgtcattcatcctgggtaaaagccacctcagattacaagcagttaataggtcagatgctacataatgctctcttcaacttagatttcttaaaatcttacaagttgaaggaggtgagagcctgggacttttaatttgcactggggcaaaatcgttcctttgtgctgaaaacatgtggctgacaagatgccactgggaaagccaagcttttttagaagagtttgctgtataattcataaagataaaatctgtaatattttatacttgaaagctaaaattttttaaaaagacattatccaaatcaaaactctagcaattaaaacacacagatagggtatggttgactttctgcaatgctaatctggtttctgtcttaggtctatttgtacaggacagatattctactttattctccaacaagactcagcctggagttgcctggtgacctgctttaattgagccaaccacattctgtaggggaaaagccagaccagaaatagctaggatttaatggtgagaacaaaggcattcctaaaatcctcaaatctgggcctagcatggtggctcacacctgtaattccagcacttttggaggctgaggcaggtggatcacctgaggtcgggagttccagactagcttgaccaatatggtgaaaccccgtctctactaaaaaaaaaaaaaaaaaaaattaggcgggcatggtgggcgcctgtaatcccagctactcaggaggctgaggtgggagaatcacatgaacccgggaggtggaggttgcagtgagccgagatggtgccactgcacttcagcctgggtgacagagggagaccctgtctccaaaaaaagaaaaagaaaaaataaaataaaggaaacacaaaaaacacctcaaatctgatatctcccacttcctacttaggttgaaacaacatatgacttctctaagtctctatttttattttcaataaaatgtggatgataataataaaatgtggatgataatcccacctcactatgggatgcaaagtgtttaccagatgtattatgtttcctattgcagttgtgacaagtcatgcaaaagttagtggcttaaaacaaatttattatattaagtcccagcattctgaagtccaaaatgcatctcactggggctaaagtcgaggtgtcagtaggtctgtgctcctttctagaggccctgtgggagaatccattttcttgccttttctagcttctagaggccccctactttccctggctcttggccacctaccatcgtcaaagccagcaatgtcccagcaagtcttccttagagcatatcactatgatactctttatttatttatttatttatttatttattgagacagagtcccactctgttgcccaggctggagtgcagtggtgtaatctcggatcactgcaaccaccacctcccaagtccaagtgattttccttcctcagcctcattagtagctgagattacaggcatgtgccatcatgcctggctaattttttttttttttttgtatttttactagaaacagggtttcaccattttggtcaggctggtaccaaactcctgatctcaaatgatccgcccgcttcagcctctcaaagtgctaggattataggcatgagccactgcacctggccactatgatactcttgatatcatatgatagctcttgcttccctcttccacttggacctttttgattacaatgggcccacctggataattcagtataatttcccatctcacagtcagctgcaaccttaattccatctgcgtccttaatttctctttgccaagtaaggtagcattcacagattccagggatcaatataagaatattttttagggggtcatcattctgcctaccttgttggagtacctgctactaaataaaaacaccaggaatggtagtttttgctgttcttaacccaaaggaagaaagagcccttctctgaatggtttttgttgtttagttaagaaaatgccaactgaccaatgtcccagaaaccaaatgggtgtagagccctagcatgcttcatttcaacacctttcacaaacagtagttttggcactttgcctaccaagctgaaaaacaaagagcagggttgttatgtctgacctaaatacacatggtctgtaactttcctcttctctctccatacctcttcccttcttgaagatattttactgctggggtatcaacttatttacatgtagctgactcctcagaagcggaacttgaatgccagccattctgtcgagcttaaagcaccacaatccagctgtgagctaggcaactttccccttatattttgtgtgcctctgaaaacatctccagaattcaaatgaccatttttgacataagttatcccttcctcccctctgattgcaagggcagcatcactctttctgccatgcataagtcaacatttggagtcaatagccctcttgtactaacactttcacagtcctctcaagtagccttcctcactgtattatccaagttcaaggattgcttacacttacctggactacaggcaaagcctcagaaccatctcctgccttccttcactgatttgtgtcatcactccctggaggtctcaggtccctccttctcatctcttcttccttaaatcgatccttctgccttaaatcagcccttctgcttagcattaaataagtctttgtcagcatgccaaagggtgcagggaactatttttaagcagccaccatatgccagacattgtgcttagacattttgcatacattatctcatttaatcccaacttaatgacctagcaggtcgatgttatttcctctttctttttctttttctttttcttttttttttttactagtgaggtaactgggacatagagaactttatgtaattcagccaaacctacacagtatgtagcaaagagttcagactcggctgtgtctttctttaaagcctctagttttaccactacattagacccgtcatttgactttattttgaaggtatctattttattagggtgggcactgggcactgtggctcattgctgtaatctcagcactttgggaggccaaggcaggagtatagcttgaggctaggaatttgaggccaacctgaccaatgcagtgagaccctcatctctaaaaaaacattattttttttaaactggtcaggcacggtggtatgtgcctgtaatcccagctattcaggaggctgatgcagaaggatcatttgagcccaggaggtcaaggctgcagtgagctatgattgcatcactagactccagcctgggttacagagcgagaccctgtcctctgtctctaaaaaagcaaaaaacaaacaaacaaaaacgatgaaaaaaaaatccattttatcaaggcttacctgtgctcatgtactttatgggcaaatctttcaatggcctaatgacaaacatattatggttgggtcatcttggtggtggtttctgtgggaggctaaagactgctatgtgtactattttttatcagagatctagtactgtcagacatctgcctttgaagtggcttgtggattaatccaggtacatttctcatattttttgaaaaggatgggttctgagggaaggaaataatttttctatatgcgagaggctttgagtcacagtaagttagagctcttgtggaggtaaataatcttgataaatctgttctttgtcattagagatcaactctcagtacccagtgacaggcccaaacatgcttttattctttgaccaaaacacccacaaaggaaacagaaaccagtttagcaactttgcaagtgggtgcagaagtattcctataaataaagctgctcattgtgcttctctggtcatgttaggtttggaatgctgatgggtttatatcgtcctactctgaattcttagtgacaacattgtgaatttagttctagctgatgcttgctacattgcattttttagtatttgaattctgctactccttaaaggtgactgaaatcataaagcccattttgtagaatgaactttgttccccacttatcactccaccatatgctttcctgattgctttctgtttttactttcttgaagagagaaaaacataacataactcaatcttagttgatcttagtaaaaggaagaatgtgtgggcagtgggacgtggtgggtcatgcctgtaatcccagcactttgagaggctgaggggagaggatcgcttgagcccaggagtttaagaccagcttggacaaaaaagagcccatctcaaaaaagtaataataataataacaacaacaataataataaaaggaagagcacttcctgggccttgagaagtcttcttgctcacaaagaagcatcaaagcaagtgctatatacacaggaggtcagtttgggcaactcttttttaatcacatagtagctttgccctcatggattctaagtagatagataatagaaaagttgtaagaaatggtcttcagtaatataaggaaatactctttcaaacctattacttttttatcggaaggaaaatttaaacagaatcaactattctacataggtcttaggtttttgtgtaattgtgaaaacaacatagcagaagaattaagactttaacctgaaaattaaaagtgctctctggagtcattattgggttaattgtcaaagttagaatgcagatgacagattacagaaaagtattccattcatgtgaaattttccaaagttgaaagttacactatggttatataaaagactacccatatttataggaaatatacatttcctatttagaggtaaagggctatgatgcatgtaatttacactcaaatggttcaataagtatatatgtgtgtgtggtatgtatataacacacacacacacacatttatgagagaaagagaacacaaacagaaagcaaatgggataaagtatgaacaatagttgaatataggtaaagagtatatgtttttcctaaacgatatcagttcacatctgtgggaagatgatgctcaaatttaaatttctagcccagaagattatcataaactctagacccataaatccaattgttcactagtaatatacagtaaaatatttcacaggtgttttaaaatcaaccttttgattttttttttttttttataatttacccctttaagccagttgccttcagtgttctttggcaccaaactagattctttcctctccctcccaagtccccaccaacactgctacaatccaaaaattctgtctattcaaccctgcaaattctcatcagttgatccacttctgtcaatcactgctgctattattcagcttcatatatcacacagtttataatcatcatcttctaagtagtcccctgcattcaggatgtgcctcctccaatccatcttctcatttgcagctaatttcagatgttcaaatctgatcttgttcatgctctgcttaaaagctgaagtatctctctgttaccctcagatcaaaatccaaatcctcaatacaattacaatgcatgtgaagacactggttcttgcttatttttctaacctcatctctctcctctcatcctaccatcgtttatcctatcctgtctcgtaccatgccacagtctcattcgactcctttcagtggaagttcctctggctgccaggcctctgcccatgctagtctctctgacttgagcactttccttttcccctgctcccaactacctgttcaatacataatcctacttgcctgacttactctttcctcctttaaatcccaacttagatgacattattcgaagaaacaatcatgacatcccaagtctgatccaaccaataattagatgcaaatttaaaataaagtaataagattctgcctgtttttaaactagcataaagcatgtacacagtccttccgtcaataaggttttccttaaacatttattaaatatctgttctatgcccagcaacttctgattgggtcattgaacagatatttatttattgatctcctacagtgttccagacactattttgggtgcagtgaacattcttagaacttagattctaatagaggtgactaatcacaaacaatgagatgggtagtatcagttagtgataagtggtacgaagaagaaacttgtacagggtgctgacctagatacagtagtcagagaacacccctctaaagaggaggtatgtaagttgggacctaaatagaatggcagagcaagggctggccaatgtctggggaagagcattctaagaaaagagaaactgcaagtgcaaaggctttaagataggagcatgcttggtgcattcaaggaccagaaaagaggcctgtctgtgttcaactcagtgagcaagatgtgttggtggaaaggagtcctgaaggccagaacctggagtgttgagcagtgaatgtgctttgtcaggttcagtttaactctgtacgcatttcatttgtccaaataactttgtgagtgaatggagaacacaaactgggctgcattttgtatggaggtcaagggtgatcgaaagagagcatccctagtaaaaagttatttccctaagggttaaagattgagaattggatagaccctggagaaccagaagggtgatgtcagaaaggtagaagtaagtagatcaaagtgtttgtcccacgcaaattggcagcgcttgtcagagtgtcttggcatctaatctctcccctctgccctttcccacccccattcattcctaactgttccaaaattaacttagaacatctttattctttgccagcattaggtggggatggagagtcctgttgcctgtaaacagcagtgacttttgtaaggaagtataacatattgtttaaaaaaataaaataatgaattcagtttttacatcagttttcggcacagtggcctaaatagaccaaatgtagcatacttttaatttctatacctttgtatggtaaaaacacataaaaacaaaaaaaaaataggtcattctgtttttcgtgagaactgccttatttccaggattaattctgtatgactgagagagcttgaattatttccaaaaggatagctttgcattttcttttcttgttaatcagtctctactcatttcataattttctccttcagtttttttttgtatttgagctttgctttttcccttttctcatgttcataccttaaagattgtctaccttttgtagaaaaaaatattattctgataggaatactttttaaaatttgtgtgaaagaaatgtaaatacatatataagatagaaaggaaactggagaagaaaataatatggaaatgaaatagtatatataaggcatataggttaagtccagtgaaactgtataaggtaaacatatacactgttaagcagtctccaaagcatgattgatgtaagtacctaaacaataactttatataattttgggggggtataataaccttcatatataacttgttacatatgtatcattcattttcttcagatgactttttatagaagcttgaaattcaagctcaaaactcatttcttattatgatctgagaattttttctttaattcatttcctttctgcatctcttatgacaattttgtattttctaagtcagatagttaagaaaatctttgttttcaggagttcatcataatgcatttctatatgtttaggactgtattaacattgtttattttgacagagcaggcaaaatgtgaagtacctacatacacttttatggctctcacttcttgaaaattttaaagcatttattgagtatttattacattccaagtactattctaagtatcttacatgtattaaatactttaattctcacacagccctacgaatactaagattctagttttacaggtgatgaaactgagaggcaggtgggttaagtaattggccctacacctcaaggctagaaagtgaaggaactgagatttgaaccctggtcaactatcttcagaatcataactgctcatcactctgcaacacgtgctttcaggcaagcgttagtcagtgcagctcagggaaaacaggaggcaagttgactacttatgcagattgctgagaaatataacaggagggaagaacagaatggaaaacatgcttcttacctaatatgagacatttttccctagggaaaacagaactttggctatttcccttcaagcagaagaaaatatgttcacacagagggaaagaggaggaaatgaaaagggctgtttggatcagatggctgaatcgccagtaacccgagtgcttagcgtaggctgctctcaaacgtatagttgctcattaaactttaattttcattgcatgctacctgatctggtttagtgaaggctcttttatgcaacctaaacttatgggaattttgtgatgtatttaatttccacaaaacctaacatacttgatatgtccttctttttgagtcagagtttcgctcttgttgcccagcctggagtgcaatggcacgatctcggctcactggaacctctgcctcccaggctcaagcaagtctcctacctcattctcccaagtagctggaaatacaggcatgtgccacaatacccagctaatttttgtatttttagtagagacagagtttcaccatgttggacaggctggtctcgaactcctgacctcaggtgatctgcccaccttggcctcccaaagttctgggattacaggcgtgagccactgagcccagcctgttatgtcctatacatatcagccaaccataactgtcagtgtaagtagttcaaaatttctcctaagaattactcttaaacacctactctcttcccctgaaaatgagttaactacttagtaagtaacctttctcacagaaaaactagatgttttctctggaattctttcccttgcagccatcccctggaaagccttgttttagaactgacaccatttatatggcttggcatctcgactgcatttgtttccccatctggcacttctcggggtgaaagtgttcattttggtgttctgcagagtgcattttgagaaatgtgtacacactacaagtgaaattcacatctcaggctaagactataccctcagcattgcaatgtgatattagcaaaagtgcttttataatcctacctgccaacaattcacatctataattaggaaaactacatgatttcaaaattacccaagtcttggaaaggcttgtttttaccatatgtttttcttttgtaaaaggtctattattttcaccgtcttaaaaaaggttcagtttgatcaagttctaattatattctcaagcacatttttcaatcccataaaaataaatcaataaacctagacatttaagtcactttatcacaacttggtcaatctacatggtgtgacaacagatataaggaaagtagataagtccgctaggatataaagaaccaacttacagtaaaataaataactaaactagaaaaagaatctagaataaaaactagagatgtagaagcaagagcatttttgactgccgtaaatcagagcttcttagcagcccacatcccaaaagtggtagatagccaatatttgtcagaaatgatgattgtatacctagtggacagctctaagcacaattataagattgatttcgttttacaaaaccttgaaagaagtaaacttaactgaccagtgacttgagtctagctcctatcagattcccaatgagagcaaagaataaagaacaaatggccaaatattgggaaataggtatcttatagatatgacatatagataaatagatatatttacttatatacatactgtcatatgaccaattcataggtgtgtttgatatggcagtgtgtgtgtgtatggttttataactctctcattcatattcagacacaatgcaaatgtagatagtattactataccatctatttgagatgtaaatattgtaaaagccctcctttgcatattccgcagatgctaaaaaccacatgtatttatgttttgtttggggtgctgcttctgtgtgtatgagttttattgttacatgaagtcttgctttaaaaatttggctgggcatgatggcttatgcctgtcatcctagcactttgggaggccaaggctggtggatcacttgagctcaagagtttgagactagcctgggcaacatggagaaaaataggccaggcgcggtggctcgtgcctgtaatcccaacactttgggaggccgaggcaggtagatcacttgaggtcaggactttgaaaccagcctgaccgacatggtgaaaccctgtctctactaaaaatacaaaaaattcagccaggcctggtggcacatgcctgtagtcccagctactcaggaggctgaggcaggagaatcacatgaactcaggaggtagatgttgcagtgagccaagattgcgccactgcactccagcctgggcaacagagtaagactccgtctcaaaaaaaaaaagaaaaaaagatggccgggatggtggcaagcacttaaagccccacagctccagtaagtccggaggctgaggtgggaggatggcttgagcccaggaggcagaagttgcagtaagccgagatcagactgctgcactccactcttggcaacagagacagaatctgtctcaaaaaaaaaaaaaaaaaggaaaaaaatgccaattcattcttgctttctacctgctgctgttgttttccagaagtctgcagctatgctgaatgatttgaacaggaacatcaaggcatcttcaaaacatttctgttctctccttatgctcaccttataaagctgcaaggaaacattgtgtcattaattttctatacatagcgtgcttggcaaatcttggagaataagcaacatctcccagggtggttgtgtgcataacatgagaatattcgttgaagcactttgtaaacgataaaacattacacatagtaagtcattgttatcattggcattactttaatgtagtagaatggaatccaggactggaataagccattcatgtcactaaggaagagaatggaaattaatatccaatgaaacaccttctttttttttttttttttttttttgagacggagtcttgctctgtctcccaggctggagggcagtggcaatggtgcgatctcagctcactgcaagctccgcctcccaggttcacgccattctcctgactcagcctcctgagtagctgggactacaggtgcccgccaccatgcctggctaattttttggaatttttttttttttttttttttttttgtagagacagggtttcatcatcttagccaggatggtctcgatctcctgacctcatgatccgcccacctcagcctcccaaagtgctgggattacaggtgtgagccaccgcgcccagccaaacaccttcttatagcagagtaccaggagcttaactagaagttttacataagttacctcatgtattgaacagcattcataggaaatactggaactcttaaaggaaccaaatagagtttgtattgaatacaaatgtagctccatagagaagattagacatcatgaattttcatttgagaatgaatcatcttgccaatttatatcattttcctgcaaaagcttattggcttggtcatgtactttactagtcaatgaccagttattatggagttgtcagaacttggccaagaccataagctctatattacatgcaaaatcttagtattattactatttatacaacttcagcgttgtgaactggtggcaccatgaactccattttcttcgtgatcattgtcacttcatcaccttgtactaactctgcacgtggtttttgacaatttgtttatcttttaaatttacccctgaagcccacctgtttgggcatccattagttcttagactcatgaagatcttcacccactgacttgacattgtctgttctcaatggttgtgatctctgccctcaaataaaatatgatgttacagtatgtatatatctcagtgagttgctgttgaagggtctcataaaaatgtgatgacagggaagaaggaaaggcagttttccaccacaatcctctccaggattctaaagtttaaggacataaacagtaagtcagaagcagccgggctataggtgctgccctttacttctaccgggataacagggaatgtggattaaaagggggctaagggctcatgcctgtaattccagcattttgggaggccaaggcgagtggaccacctgaggtcgggagttcaagaccagcactgacaacataatgaaaccccatctctactaaaaatacaaaaattagccgggcatgatggcgtgtgcctgtagacccagctcctcaggaggctgaggcaggagaatggcttcaacctgggaggcagaggttgcagtgagctgagatgaagatggcgccactgtactccagcctgggtgacagagcaaggctccatctcaaaaaaaaaggggggtgggtgctaagtacaaagaaggaagttattactacttttatccattcttttaattactaagcagttagtgctgttgtgtggactttcttctttccctcctagggaaaaaagactaaaataaataactataatgcaaagcagtgtgaactatatccattatgatgcaattggaagttctggatgcaaaacatcaaaattatgttctgacaatggctagcagtatttacatatctataaaggtacagaacaccagcctggttcatactcagcttatcaaatctgctacctgttgttgctattaggactataaaatagagatttgttaaaggtggccatgccatttatttactttatgataagaaattgtacagaggctagatattgagtcttgtgatctcactccatgatagactttacagtatcaacttagtaacgtatcatacagagcatgtcgtcgtcaccgtttctaaaatgttcagtgagccaagagcaagtccacagtcacagggcaggtacagtgagtttcctgtgtgcagaaacagaaacctctgaatcttgcacactgccaccaggggtcagggaccgggcgggaggagaaggcactctggcagaaaggaaatgttatattaccctgagaagcacaggaatcaaaattcctgtctcctcttcttgaaagcagctcactgctagctgagcaaggttcgaaggaaggacctcagaaatgttctgccagcgcaaaggtatgtgtaagtgctctcttagtggctttaaataagttattttggaaagtcagatacagcggacattaaagggcacactttatgttgcattttcaaagtccagatgagctgtatggatctgtgacgatgcagttggaggttctatagctactgcctccaaaatgcaaatgtttggctggggaggttaggagggattaaactgtgtcagaacactgaatctaaatagaatatctttctaaaaagactttacatgtgtgtaaattatttctctatgatttgctgtagatactgctgctaattatgattccataagtactcccagaaatagattcagacataatgattttgagtctcttcatgtccagtggccatttgtaacaagtccttagcgatttattttttattcattcataggacaacatttgtcagtaagatttccatgttgccttaccttattcttcactcaaaaattgtccctaactcgggtaatggcagtgatcaagtcacatgctctcacttttgtcaccactgtattctgggtttcaaagacttgtaattcatttcattaagactctccaaaccatccccttaaacatttgtttaaatgtctctgttcttcattagcgttttattacgttacattctctaggctccagaaaaacgaggcaagaaataggaggatttttttttttgccttttttcttttttttggttgaagttttggtcaaacaagccaaaataacattatcattaaacagatcgacctgtacttttaaatggaaggaataaagatataaaaagaactgaggcgtgtaagtaacctctttgatttttaatggcatgcagcagatggaattcattattgactttaaaaaatgaaattgctctgcattattatttatttatagttttgcctttcaaaagaagtaattaccattactaggttagtttttcctcaatcacaagcaactgtgtgacagtatcagaatgtataatatactttaccacttatttagacatgaggcttaatgatgttgcaggacattatccctttttaagttagtaataaatttatgagcataatgcacagctaagaggttgactatcttttctttttatctgggtaatttcaaaagcaattatttcatatcataagacaatttatttatgaaattctcattgctgaaacaaaagtgtttttaattagaaataatctaatttcatttttccagttcagcacacagatactgtgatgataatcataatttatacaaaattatcaagtgaaatgtttaggtgattggttttgagcccaaacaattttttaattttaatcacaaattctaaaacttttaagtcattggggaggttgataaccagtcataacaaaatttaatttttaagcaatgccaaatatttaatcaattatatctagttcaaatttgagaggtactaaaattgcctttgtaataaaaaaatacacaagaaaggataaaaatttttagtattaaacatggagctgtcaacgctataaaaatgtatgaaccccttttcaaagctgatgttttaaggtatcatttcatatacaggacagcatttatatttaataagatcaggagatttggcgtgagcaggattcagaccacttttgaatttcaatgaaactcctggttcaattagatccctcttcccatccttcttacccctccccagcccattctcctttccccttgctgcttctgcctctgtattcctctctctcctcctccctcctatgccttatatcctcttggcacttttacactgagacatctacaagtggatctgctgtcttcagcagtggtcattgttgtgaaactgaaggatagcaatgaatatttcatatatagcacttaaacctcttcatctagattatgcattttgcttcattgtacccatccataggcacttaataagtgcttatcgattgtctagtgagattgtattataactgattttgagacttttcataccctctgcagttactagtactatatttctttgattctaagatgtacatttttttcaaattttaactttttaaaatctaaaatcaccttgtgatcaagctgtattgtgatttaattgacagtttttttttcaatctttctttcttggtcatgcgtctcacaatcagtggtatcttagattgatgaaatgcagcagtgaaaatatatacctaagtttgtgacttgtataatatgttaaaggccatatatttggaacttcataaagtcttcttttttccttacgtggcttatctgtggccaatttttgtctctcctcactacattcttccactctggcttcctggcactgtggttctaactgttcttaggccactgtcttgactgaactccctggaaaatactcagagaattttattagtaattaccaatattcaactgtaatgaaatggacagggaacaagtttttaaaactgaagacccacattcaagttatgtttctgctcattaaaagctatgtgtatttagcaatctgataattattcccagagcttcaaattacacatctaaagaaggaaataatacaaataatttctttatctataaattaagacaattagtaaaaaatattgtaccagtaaaaatagtgaaaatgaaatgtgtatgacagtactttttaagccatgaagtactgttaaattataaaccataaggatcaacattaaatgaaacattattagaaatgtgtgagtagaaagttagggaaaggaaagaaggaaaaattaaataattcattccaaattagaaagttttaaattatcattggaaatgatgatacgacccattaactagctttctgaatttagaggagaaccgtgaaatctatcttcagattatttcttgcatatcagagtcctgtctgttctgaactccagtgctgaatgcatgccaatctctgagagcttgtatcctttattgaattagcaagccacaacccacagtatctctgtggtattaaaaataaaagagattacttagattccccacttcctttcctgccttgattctttccatttaaaagtgagacccctgtctctacaaaaaattcaaaactaactgggcgtggttgtgcatgcctgtagtcctagctacttagaagactgaggtgagaggattgcttgagtccgggagttccaggctgcaatgagctatgacggcaccaattcactccagcctgggcaacagagtgagatgctgtctctaaaaaaaacaaaaacaaaaatgaattgtattggttttcacagtttcaaaaacattcaataagagtaaaaaaaaaaaaaacttgttatttttgcatctttaaaagacaggatacttcaatggcacttgaaatagtactgttgaatagaaattccattgcaatagtaactataaaacacaagattatccattaaaagttaatatatttagtatatgtgttacttttgaggatagggatactttgaaaaggcaagaataaagaaaagaaggaagtgccatattaaaggcatgtgcaggttaaaaggggaattgaaggagagggaattcttagtcattacttgaaaattatatttttctactatactacatctgtcagtggaaagtctaaatcactttatttccaaagaccacaagttgtgactctgacatgaacatttagtcatatactggggtttaaaaaatgttcccatttcaatgtattattaataacaacaaacacatcagacccacttgatgttaactgctatacttagtgcttttaattcaccaattcattaacatgttaacacattttggcatgataatatattattcatatattaaactatattcttatttccattaatggaagcatcatttctctagctattcaggccagaaacattggtgtaattctaggccttctctttcttactgaccctgcatctaatcagcccagagatcctgttggctctcttctcagaataaacccagaatctgtccagtccttaccacttgcactgcttcctcctcggtccaaacaccatcatcttttgactgcactgtgcaagagactcccaaccggcctcctgtctctgcttttgctccccaatccccaccccagtcagttttcagtgaggcaactgggaggaatgtggttcaaacatgaatctcattgtatcgctcctttgtccaaacccaaagtcctaatcatggcccacagggccctaactgatcacccccagcacacacacacacacacacacacacacacacaccccttacttcatataattcccccgccattactccactccgacttcactagtctctttgctattccttgaacacaccatgcctgcttctttctcaaggcctttgcaatttgtgtgccctctaccttgaaggctctcctcctagagatccacatagccaacttcctcactttcttcgggttcttataaaattgtcttttcagtgagaccttccctggccactgtacctaaaatttcaaatcccctgcccatcaacagttcacatacactcttctctgctttttttctttttctccttacactaacacatatttatctaccttattggaatacaaacattataaaaaatgaatttttgtctttttccctccatattctagcccttgtaccaagagcagggcctaatacgtagaatgtcttcaaacattatttgttgaatatatcctcagttaaccctgtaccctcaataggtacaattattacccccattttacagatgaggaagttaaggacagaaaaattaagaaacttattcaaagtcaaacaagctaagcaagcgtcagagctaagattcaaacccaagaccctggctccaaaatatatgttcagatcactgactgagtagattaattagaagaagagagctacctatagattcctctattccctgagattttcttcaatatgggttccatccagttaaatggaaaaattgtgtcatctgctactgacaacatagtcagatatagtaaagctcctttttctcattcctctttaatttctttttgtaaaaaaaagtatgagaccttttaaaaatagaaaatatatgtatattttttaaaagcaaccctaatcccacccctgtggacattaaaatagtaataataatgttaacttacacaatagtaaaaaaaaaacactagggaaaagtatgaaatgaaaacatgcattgaatgcctattatattctgtaataagtcggcactctgaggacatatttgttacatggagtctaatgagagagacagacacatactcagacaaactctaaattggaattcagaagaaaaaacatcaaacagaagtcttgtgacagctgaaagtggggcctggtagagtaagttgtggggcaggtgaatagtagtggtggaaagggattgaagaactggagactgaagaaacagtttctgaaagaggaggtgggagagtaccaaagagaaatgtgacttacctcactattttgctatagaggatgggacttagtatgagagaaggtttttaaataacattttatatgccgtagaatagaaattacaggaaaatcagttattgaaaggctgtgttgaatttaacttgtaaaagggtatcattacttatccaaatgcatcatgtgagaaaattgtccagttcatttccccagactacctcaatctattccttctgacaaaccagaacaagaaattctgttttccaaattgttatttttgctaacacattaagccagcttcagcttcctacagcacacatacacacacactatcctgtgttatcctgtgtctgtttagtgttttcattcacatgtgtgttttctttcctctccacccttgtttctctggaaagtcaggttttcgaccaattatttccctgatttgacaaggtcactctgaacttactttcattgaaaccattggcagtatggtctagcttagtgacagactgctgggtcactcaggtcctttgataaaagggcatagtgcccttgtatggtggccattccaaataaggaagtaaagaaggagtaagatatttagataacaaatgttaagaagaaaataatagagtaatgagactggagtagggtagggcagtggtgcaattagcctggctaacgatgggggcatctctgagaaggtgtcattagaattgaaacccaaattgtgagaagaaagcagaaaaacaaggatcgggaagaatagctaaccaggtagagagaaaagccaggtggtagaaattaatttgctttgttcaaggaacagaacaaataccagtaagatgggacagagtggtaggggtacaaaaatgaggtctcagagatagctgagggctgggtatacactcaaactgaccttcgtttacatctacaagcactggaattgctgtttttcaggtgtgtcccaattgtaaatctaccattatttattgtagaaaataacttcacattgctctgcactgtaaaaaacctttgacatacattcgcattttatttaacatttcataacatcactttgaagtttgcagacctgatgtttgtttttggttttgtttctgagacaggatctcactctgttgccgggctggagtacagtgatgcaatcatggctcactgcagccttgacctccctgagctcaagtgatcctcccacctcaacacactaaggagctgggacttcaggcatgtgccactatgcccggctaatttttctattttttgtagagatggggtttcatcacattgcccaagatggtatcgaattcctgggctcaagcaatcctcccacgttggcctcccaaagcgctagaattacaggcatgagccactgcacctggccaagcctaatgttatttctgttttgtggataaggaaattatgataccaaaaggttacatgaattccataaaaaggtcaactccccttccctccccataccccacatgttttgacatgctatgcttgacacccattttgacttgctaggctaaatcaaaattttcaagctgggagcagtcgtgtgtacctgtaatcccagcttgctgaggcaagagaattacttgagaccagcctggacaacaaagtgagaccaccccctttcagaaagtcaaaactgccttttagcttggatagaaaatggatttgtgactttggtataactaagggctcattattgctcaaaacaggaaaacaaaaagaattgctgcaatgaatgaaaaacaggcaaccttggtttgttctaatagcacatgtgtgtagagcaagaatctacattctctgtttagccacattttttattctgctgggtggctagtttataaatcatgtgttggtcactgtcagatttaagttttaagtaattctctctgaaacatgtatttgaggagagcaggacagcttaggcctggtgagatatgttgacaatctgaactagggtaatgatagtttaggtctcctcgcttagccatcttagtcactaaggtgtgtctgcattgtataatcaataatgtttcccaatcttgttgaaatgacctcacatgtgatagcacttaaaaattcaaagaagtgagctatagttacttttcttctatttttcatatatttactttattgtaaacgtatattagattatatatgtctttttaggaatttcagttatatttaatacatatttttttctctatatgcttaaaattgcttttaattttatatcttttcaaatactaatgtataatttttagaattaaaaaatattttctatcaagaagtactattgtgctctgttctgcgttttgtgtgtgtgtgtgtgtgtgtgtgtcttatagcataagttcttacaagaaaaaagacaattttcttaagttgaaaaaacaatctagatacattaaaaatattccagtgttgaagctatcaagcctactttttagaggcaaaagatagctaatcctgtttttccttgtaaaaaaaatttttaaaaagatattatatagaagtatattatttactgactcaactattaactaaaaagccgtttcaccctatgcagatgataagatgaaggttatctttaaaattcattttctaaaaaaaaaaagtctttcctgtttcttgcttattgtttttataattttagttgtatttctacacatgtcattctctgtatggcatggccttgattgaagtttggtgtcttttcccttttcattcagtccttttcatatttttacattaatgtaattatttttgctttggttttctggtttattaacaccttctctgtctgaattattaaatccatgttgtaaatttttttttaccttaaaagtagctcattttcttaggttttttttttttttaacacttacacatttattaagcttgaggtatgtgtttaataatatctttaaaaaaattatttcacttttctgccaagtctcaaagctgctttcctgatttaacattgtagatccctgtaataattttttacaaatcactattaccagatcttaaacttgaggaaaaaattttgtggttattattcactagcgttgtgataaatatttcaaattaatttttaaatatatattataattatcatattttaaatgcatcatgattttaatgtgctcaataacttttgtaaagcactaggatatattttttcttatattatttaaaatattcgagtcctgaaaaatatgaaatgcttggatacatttcctctattatgtttcgatgcttttctccgtagttaacctctcgtgtctacaacaacctgtatctcaaagtacatgcacatgttatgcaaacaactaaaaccaaggcaaaaaaaagtacattctattaagcaaaattggattggaagcacatccgtaaagggaagaattcaggatagaatagtgatatttcaaaagaaaacttggtttctcacagattcctcatggtatatattcagatgttgttacataagagaacattccttccaaattatttagtttctggtgttttgagagaagagtagccttcgacatgtcttaaacttcccttgcattcattactttttaaatgtatgcattttaatatggagactctcccacaaaaatagtggaaaaggactggtgttttacagtggaaatactaaatgctgttgagataaggaaaatcaactttttgaaagaaaaaaagatgaaatgatagccatctgatggttaaaaagtggtaacgtgagatattctatatttgtgttttacatcaattctattatgtctgatttacccttgaatcaatgtagtggcttaatgatgatgacatcatcaacatatgaagatgacaaaaaaaattaagctaccgaactacccaaatgtttttagggaatctttctacttcttccccgcagccaagaagcaattatactgacatttagttctttcatttccagcaggaagcttacctactcttttttcggagatgattaaaacctcatgccacttagcaataaagagaccaccattactggtgggattcatagtggaaagcattaagcattttggcagtgagtcctaaagcctttaccatagcaggattgatataggaataagtggagattgagggcacaggggatccaccagctatcccttctgcaggtctgtatgattgcacttagcagatttcccatgcttactattacacagagagatttactacatagaattcctaactggactcctacctttcaggtttctccctgcctttccaatccattatccacactgccatcttaacagtatttctaaaacgtaaaattcattggttctctcctttaaaaatctttggagatttcctattgccttcttcatgtggtccaaactccttattatggcacatgtgggtctttcagggtttctaacctatattcctagaacctcctgttttctgtgtccttttcccaaagagctgacattaggaatgcctgtccattggattgttgcaagggttcgatgataaaatatatagaaatatttcataatagctagcatttattgaccctttatcatcttaccaggtgccaaagactgggcagggaatttatacatattctctcatttaatcttcatacaaccccaagagatgtaaatgcttttataaactccattttataaatgaagaaacagattttgagaggtcaggcaactttcccaaggtcacacctatagatagaaatggagttgaattttatctctccaactccaaaattgatgcttttatagattttactgttgcttggcacatttcctagtgtacaattccatttgattaaatattcattttttaaaaaccattactataaaacttacagtatctaaaaaatattttggtttgctttccttgccctccaaggttagctgatacctcacttcttggactctttctagatgtcccatcccctctctgctatcctcttccatcttcacacgcatcatacttcaagtgtaatggttgacctgtatatctaatgcctctgatctgttggcacttcacgtatgcagcactgtgtctccattgtcttcgtaccctcagggattagcatcttgatgttcagcattcaatatctgttgaacaactgaaggaataaaacagactccaaggataattttaaagtatgtgggctctctcttttctcacaactgctgcatttctgcttccatttaatgtttaactgcactaacacttcaactaacactcagctagattatgaaagagcaaagacagacttcagagcgtaacagagtaagagagaatgaagaaaagacaaaatcaccctcttttacttcattcctctcccccaccctccaaacttgagagattgtcttgccagatgaggaagagacaaagttgaaggagagaaaaggtgtgcttagatagtaaaataacatttaaatttttttaaagattagttataccttgtgttaagtctgctattcaagtctgtttttttttttcctcatggtcctttttaacaatattttgcaaacacaggaaaacctacattcatggcatttctgagaggttggcaaatgaggaaacactcccaaattctctcctgagaacttacaggagatcaactgatgagcacatggtcaccaagtgagtcagtgtaagttctatgaatagggcttggatcttctgactactcgtctagggtcctagtcatctagctactgccatgttccctgaagaatttggtaaaaatagcagatggcataactgacaaagtaaatcattgtcattgccactgtccatgttctatttttccatgttcagtagcataatttaaaaactcattaatgcatgtatgctattggttattatgtaataatatgtaaaaaacaccagtacagaaatacttctataatttacattatacctttaaatacagagaacccacataatatcaccacaaaggcatttcataaattatagaataaaacacataaatattcattctgcattattattctgctaaggaagagcgcaaacattatttttaacaaactgctctttaaaaaaacttgtgtggtaggattctccatctgtgagtgagattcaacaactataaggtccaaagcagatttggtactctgggagaaaatagtaataatgtaaaacaaaataatagtcaatgtgatctaaatacagtatatctataaagtacaatctctttcttaagagagagaaactcctgcctctgcctttacatttattagacaaacattaaaatctcaccaatttaccccctttgtctcttctttatatagggagattgtggcttagctttctctgggagattgtggcttagctttctctgtagatataaaaggcaaataaagcctgggtttgggtcctagcgctgctaccagacaaatgtggaacagtagaaaagtcctacaatctcctttagcttccgtttctttatctgcaatgtggggataatgttacttactgtccttcccctcaaggttgttgcagagatgaatgacataggtgtaaatagggctgaactcattcaatctctgaacagagaaggattcttacaacatggactctaacttcgccatttttcagctaagaaaactggggcacaggaatggtaaaggtcatgcgtgtctaagacacttggccagtgagttatacatctattataagactagaaactaagtattttgattccgtactatgttgttgtgttttatttttgtgttttattattgtgtcgctgtaaggtttctttgtcttttcacttactaggcacaacagaactcatatgcacgtgcaagaagtaaaagctatgataaaattatctggaaggggaagcgggttgtttacacaaagtaacatgatagcagatgagcaaagaggaaggtacaaggaagaatatttactagagagtttacagcatgccaaacatagagtaaaaagtgaaaaccttttagccagatttgtatacctgattaaatatctactaagggtattatttttaatgtatagagttatcaaaaacacattccttgctttctgtttctaacacttctagttctagggctcagtggctcttaacaatgagcaccaaaaccctgcttcatgctgtgttgctgcctgtgctagctgagggcagaaggtgcagtgagaaaatgtaagggacttttgggggttggtcggaaagagatgaggaatagttactgggcatgaagataattggaaaagaagaaaatattgactaaacatgtcaaatactcattcaataatgaaaagtaagaaagaccaacaatatgtgagtggttgagagaggagaggcagaaaagggaaccaggagagtggaagtgcttgaagctttttagatgagagtaagagctgacttaaccctgtgtatgtttgatcattactaatcctccttataccctagttccttcctttatttccttaatttccacatctatataaatagaatataaatacaaatgtaaatgtattatctataaatagagataaacgtaagtattacattatcacctgtggttttctcaaagctcacaactattctatggcagttcttgatggcattaagtgaggatgttaacctgttgttttacatgcatatggatggaacacaaaattaaggtggcaatgtaaagcctttagaaatattcacccttcaactgtttaagcaacccactttgcatttatctattagtcttttgtttagctgccataaaagccctattaaaatgtttttgtggtcttaatttttaagttgttgcaaattgaattgttaaaggtaaaatattttatggtgtaagcctatagtgagagcaataagtgaacatgtaatatgttttaattgcattctgttaccgtatttatttcacttcacagatatttattaaatggttactatatgccaataatgagctagatcatgttgtaaaggatcataatcagcctactaagaaagatttgattctaataaggtcatacagatgttcagtgaatttacttggagaacatattgctgagatagggatttaattgccaactgaaaaaatcccttcagtaaagttctgagaaaattgctatgtctgctatttattacagcaccttatatactactatatccctcatcaagatatagtacaaaaaatatactaaatacttagtttggaaactgaaatatgatcagaggccctgggaatattttagttcttatcctagacaaggagaccaaaaagtgtatactcattgagaaaatgtcaatatgctcgctaaacctaaatatagattaggaagacagaaagttttctagatatgaaatgaagaaagatacaacatgatccaaatagagctacccttcagattttaatgaaaggtttagagagaaaaaaatagtgttcttcaagcttaatgtgaaaacaaatattaccttcaagtggtgtcttcaagtacatacctagttttgcagtagcatccattattgaagtgattacataaaacatgttctgtgtcttttatctttatatggacagtttttggaaaactgttatggcctaaaatctgaacatgttttaaaaatgttattgtgtttgtttctggataatcttatttcatctaattcatttttatgttcagcttttaatcaataatttcaggttaaatgcaattaaatgtctgaaaatcaaacaagctgtcaaattaaatgctctactatctaataattgatgggtttttcttgttggctaatgcttcttctgtattgatcttaattttggtccaggcactcaaaagaggggaacactttatatacctctttttttttatttcaattgtttctgccttttgtcaagttagacataattttgtagcctgtcatacaatttttacttatgctttacttgcatcacaatgtaaatagtatgattcaaaatattgcatattccagcatgggcaactggcaaaaccctgtctctaccaaaaatacaacaaaaaattagctggacatagtggtgcatggctgtggtcccagctattcaggaggctgaggtgggaggctcacttgagcccaggaggcagaggttgcagtgaaccaagatcacaccactgcactccagcctgggtgacagagtgagaccctgtttcaaaaaacagccaaccggccgggtgcggtggctcacacctgtaatcccagcactttgggaggctgaggcgggtgtatcacaagctcaggagttcaagacaagcctggccaagatggtgaaaccctgtctctactaaaaatacaaaaattgccaggcatggtggcaggtgcctgtaatcccagctactcgggaggctgaggcagagaattgcttgaacccgggaggcagaggttgcagtgagccgagattgcgccactgcactccagcctgggcgacacagtgagattccatcaaaaaaacaaaacaaaacaaaacaaacaacaacaaaaaaaaagccaaccaaagaaaatattgcataataaaaaacactacaaaattatgttaatagcactactctactctgctgttattatatggccgtcttacaaataactcttcaaaagttattgattttcaaaatattcccttcaattattttactttggtcttagtgctctttgtcaattttaccatcgtatcttactctttgtatcattaaagtaagataatacatctctgaaagccatagtcttctagaaaagacatctgaaaaactcaagcccaaaaggaaaaagaaaagaccaaagtgtagaacaatgttgggcttattatctaatttatttttggccctgatcatctgagccagcagttgcttcttttgaaaggtggctcaaagttactctgtgctgatagaatttattacaaggaaaggaataatttcctcgtcatggtgtcaacttataattgcagacttcaagttcatataagtcatctgctatgttcctaaagtcataagacaattcagaatgtacattgctgttttgggtcatcctaggcttccttctctagcttcttagatttcccaaagtgtcaagtttaatttgaggatttgctccaaactgcaggagcttattaaacaaaagtaaggaaatatcagaggtcccatatgcttaacttcagcaatttccttattaataatgacatacaaaaaggctacataattcatattggatttacctgaatcgacaataatctcccttggttttctaatatccaccttaggatgattttgaaccattttacatagtaccattttgttacaaaatttccatgataaactatcagaactactactctttgaaagacttacttgaatgcgttaacataagattttttgaaagtcttatttgtaggctttatgagccagtataacgtgaaaggcaagttaaaacatgaaaaggaaatcctccaaaaactaacaatatgctccctctgagggtcctgcctagttctgtggcatgcaaagctatagctgatttataggagagcctcaaatgaacaaagggctgaaaagctaattttagaagaaaggtcccagcaactaaaatattttagctcagagtaaaaaggttacaaaatcaagttatagtagcatatatttattgaccacttgtcacatgccctataatgtaggtactattatacccattttacagatgagaaaactgaggtttagggaaattaagtaacttgcacatacaagtagtaagtgatggaggtggaagtggactaatagaaatatgactgtagagccctctttttaatgctacagttattacaaagtataaggatgatattcctacagatcaagtagttaactgaatcacatatctccttaataaattattcccaaaaaagatgagcttgaatctattcaagttttttagacttaacatcatttacttaattagaaattaagggtaataaaggaggaatatgttaaataataccacatggaagcaaacatgcaaatctagaccaggataactgacctatttctgtaacaagctcttggcatgcaaaaaaaaaaaaaaggcctttgctaggatcttgctagtgtggtccactttgagtccagcaacattggcactacctgggagatgttaaaatgcagtagctctagccctccccagaccctactgaatcttaagatccataagtgattcatttgcatattaaagtttgagaggcactggtcttaatgacaaagacttaatcagttataatatgtagaccttgtttaaatgatttaaagaaccagctgcaaaaagatatttttgccaagagaggagatttggtcattgacttgttcatcgattctaccaaagaatgactgttaatttcacgaggtgtgataatggtgcctcctggatatgaatgaatgtccaaatcttttaaaatttaggcatgcatagtgaagtgtatatgtctagaattttctttacagtgttttatcaaagaaaatagcaataagtgatgcaaatatgagaaaatcttgaaaattgttgcatatgtgtgattggccattctactcctctatttttgagtatattatagagcttttcataaatttgtttttattttaaagattaaaagaaatgggtttatgccttaggagaggtgcatttgtttttgtttttgtttttttgacatagtcttgttctgtggtccaggctggagtgcagtggcacaatcttggctcattgcaacctccgcctcctgggttcaaacgattcttgtgcctcagactcccaagtagctgggattacaggcatgcaccaccacacccagctaatttttgtatttttagtagagacagggttttgccatgttcccaaggctggtctcgaactcctgagctcaagcaatctgctgcctgcctcagcctccaaaagtattgggattacaggtgtgagccattgcacccggcctcgaattttagaaataactataagaaagaagtttcttatagtaagagtgattaatcacttaaagggatgccagaaaatctttctccaaaggattttttacaataggacaaattcattggtctggggcagttttagatatagtcttggtaaaagccagaagacttaaaaaactttcaagttctctttcacaagaaatgattccatggtagatgttatacttgtgaatactttgggccatttgcgtcagatttaatgccttagttatgattttcttaaaaagcagttgatgatggctctgttctagccctgtacttactctcatggcattcttcactggcagttcactttaatggttgaccaatggaatgctgagctacctacttgtccacatcaagcatttaatagagtcctgtactaatctcattcttataagtgcgaactaaggccttttgatgttatgtgatcaataggaaacactttaagctggtatgtgtttgtcatatagaaaagcattccttttaacatcatataaaccctttaatgtacttactcactgtaaagcacatcatttttttttttttatttctggacaaggagggcaaacaggaattccacaagctattaccagccaaacccttttgcaacttattaagtggcagtatttgtgctagtatgtcttatattttgtggctccttcctatagaaacccgagaatagttttcaaaaactaaaataaactcagccatcatccccagagatagacactatgctgtatgcagatgaaccactaatgcctgactggtttagtagatgccatgtatttatagagtgagtcagtgggacagcaaaaatttgcttccagaaaccttcctatttaaaatacaaatagtttctcctatatggttctatgttttggtctatttgtttgggcttcatgggataatacaaaggatctaagtttttctttaaacgaatacctattaggaggaataaatgagtagaataggatagtgaagggaattttggtttcaactgtgaagcagagtcactgacactcagacagtgctacttacattcctgtcatttaggtatgcccatggtgacaggctccctatttataggaagccgcattcttagatgtgtatgattttcaattttgtagatatttgtttgcttttcctcttctttattcttctagtcacctagtctctctctgttccatccacaagagcagctcctgcataaaattttctccattgctcattagccctcagtgagtacaaacaaaatctggtagtcaaatcgtaatcattcctttggcatactgcaaacatgccccacacacccctctactcctcagcttgtttgttttgctatggtacaatattatcatccttggctagagaattgtaattaaaataatttgttgtttctcctaaccttgttgctactgttaaagattgttcatgattataaaatataataacatttcaagatacctaaaattcttctactactgtaggagcatgatgctattttaaaattatgttatgtcaaaagaaagaactttaatgtgtgtgtgtatatatatatatccaaaatggattctacagtgaaataaaacaatgagtaccatttaaggatcattttccccagaaaacataagattaagacaaaaagatgaacacgtgttaaatattttatttcattctgtaatgaaggaaccagtaagatgttacagatagttcaaaggggaactcaaaaaccagacatatttataaatcaagacgactgaaatgaaagtatagacggtacattcttccaaccttggggaggaaagtcaattcaaagtctattgggttgaatttgcatagacaagaatgtcattgtttatagacaaaaaccgttttgtcttgctaccagcttttacaatttatagagttgtaaattagctcctatcaaatcagaatcagatagccctaagagtatactctagacactacatagtttcgactttttttttttttttttttagacggagtcttgctgtgtcacccaggctggagtgctgtggcgcgatctcggctcactgcaagctctgcctcccgggttcacgccattctcctgcctcagcctcctgagtagctgggactacaggcacccaccaccatgcccggctacttttttgtatttttttttagtagagacggggtttcaccgagttagccaggatggtcttgatctcctgacctcgtgatccacccgcctcggcctcccaaagtgctgggattacaggcgtgagccaccgtgcctggcccgatttttattttaaccagcagttttgtattcctaagggcaggatatccatagttagtccctcctgccaagaaaaagaagtccagcctccttaggctgacgttcacaatttagcttcagcttctttctaacattttcttttatgaatcccaccatccctatatcctattttattcagtcaaagttaactacatattcccaaattctaattaatctttcaagtcattgataaatcgtcaccttcaccaagaagccatgtcgtattttatctattctaaccgggaattactaccctccttttgatacttacgcattttttagtacttttcttctatattgactatctgctgttctcaaacttgaaggcatcagaatcacctagagtacttgttaaaacacagattgctgagcctcatctatcctctgtatcactggatttgaggtggggcctgtgaatttgcatttcttacaagttctaagataacattgatcctgcttctctgaggacaacactttaagaaccacccacccagggatgtcaaaaagcaaatacccggctgggcgcgatgactcacacctgtaattccagcactttgataggccgaggtgggcagatcacctgagttcaggactagcctggccaacatggtgaaatcccatctctactaaaactacaaaaattagctgggcgtggtggcacgtgtctgtagtcccagctactcaggaggctgaggcaggagaaatgcttgaacctgggaggttgaggttgcaagtgagcagatatcgtgccactgcactccaacctgggcgcaagagtgagactccatttcaaaaaaaaaaaaaaaacctataaaacaacacaacaaaaatcaaaaaaaaattcagtttaaaaatctaattggcttttttctttcagcagctcatgaatgggacagcatcccatctatgaaatagaaaggtgcttgaatgagttggctttataggaagaaaagggctaaagaagtggaaacaaaaagtagagtggtcattttgaagttactttccttatagagttaaaccagaggggactttcctatcataccacttcaggttgactggaccccttctgactggttgctatgaatcttccttttttttgtttttgcttttaaactggttcattttaaatttcagtctgattgtgcggcacctagcacatgtcactctattctgatttgttctggtcttatggggcctactgcaggtgcttccataaatggccttaaacaattgccattaaacaatggccaaccttccataaaacaatggccttctgtaaattttattttatacagagaaaccatgtaaaaaactgcagacaagaagatgaatgagacatatacccagctcttcatgagttcacaatctaacgggagtgttgaaagctggctccccaaaatatcactgatattacctttttggtaagacaaaacaagttcattgaggtatggagaataccacttcaacagagcctttgtagtgcctaaaaagaaggaaaagggtgggacatagttggaatatttgagattttcaagtctaatttaaggcagatctctcaatagggcaacttggctaagattgggtaaggatcatgatatgatagtttaggattgataaaataagatgtggcaagggattcaaagagtcctagtgtataaactattgattaatgctttctattgaagaattgatgtatcattccagatgctcctagaataaactaggagacagtagagtgagtgtaaggtcatgttaatgtagacaagtatattaatggtttccattctcagagacagacacataaacaaaaaattagtatggtaaggtaagtataatcaaggtagtcacagtgccctttgtgagcaagtatatcaaatcttgtaacctccctgccatctgccactgccaggaattccaagatggtgaatgtcttactttggtttatctctggtatatcaaggaaaaggcactgatttttagcaaggcaaagtttgtccttgtttctttctctttctttgtttatactgttaacagcctcagaactgatgtgtatactttcacatattttatcttacaaacaatatcaaatttgtggggaatgaaaatagttcatatttattaaagacctactatatcatacaaccaatgcaaatatatatatatgtttgcatatatacaaatatatacatttgtatatacgtatttgtgtatatatactaatacatatatttgcatatttgtatatagatgtatatatacacaaatatatgcatatgtatatatacatatatattaatgaactatattttatattttcatgttaattatgattttccccttataatgcagataatcatcattgagaccttaaggataagcaggcatctgtatggcgctctttttattttatctaagacatatggtctcttcttttgaggagaaagtagtgagaatggcagaggaatcctctctttaataataatagaataagtacatgtatatttaaagtgtgaataacatgtaatctttactttgggaagtaacttcgatagcataaaaataacatttatttctttgcaaatcaatttttagaaataccctaaactgattatatttaaattacatctgagaaagacaaatttaaaattttgaaattcaaattttgccagtgattcaatgttcaaattcttgcaataatagttacaactttgtttttaacaaatacaccctatgtttgttcacaatacttgaaagaatacatagcatgctttttactagttccaaaatcaaactagaacatatgcatactataaagtaaatttacttcatttatttatgacaagcttatatgcatgttgcagaaattcactgaggtaaaactcacttctatactttttaactaaaattttaagaaagcatctacatagacagtagtataactctacaagttatcaaatacatccaatcatgctaatgacatttacaacatataaatttgctagctaaagaaacatcattctgttagccataaacttttttgcacacagctgtcttcttctttttgccatatgagcttacaatcacatctttcattcccagatttttctgtgccaattgaagctaagtcaaactggtataaagaaggctttagagagtaggatgtcttgaatgggacctcatagcttttgaagctagtgagtgaaaacgtggggctgaaagagcaagcccagaaagatatgtcaggaagtggcaacagcctgccctgcatcttctctgtaaatgagatggagaagcatcaggatcaatagaagcatgttatctccacgcacagcatactaaagtacgagtgttaaagaatattgaatattgtgtctagatacaggatgaaataaggctttttacaaacagactataaaagttgccagaggtgtaaggtggttatgggagcgctgaatctttctcaacatccagtagaatagggtttcttaattgagtattagtagcatacccaaaaaatcaaactctggcaaacaaagtcatgagtaatcttaataagaaagcaaaatggggcgataccagtgtgatttggcaagctgttttctgagcttagttcttagaagaaacaaaagaggaacatattaccagggacaaaaaacaaacaaaaaagactggcataaaactgtgaaagagtatcaggccaaaacatagagtgaggttatataagcaccaaaaaaactagtgaaaaggaaagtcctacaataaaggagaacaagatggatgggtgaggcttgtgttgtttaacaatttattaaaagaaagagtaagtttaatgcctatttaattttttttttaagagatggggtcttgccatattgccctggctaggcttgaactcctgggctcaagagatcctcccagctcagtgtcccaagttgctgtgactacaggtgtgcacaaccacacttggccacagttttgctttatttttctcaattaagaagaatgagctacaaggaagtacaaaacaaatactgtaaaattgaaatttttaggctaaggcacacagggatacagtgaaagaacacctacatctactttacatgaattgaaacctcttggtccagaaaaccagaatattttcctatgtggtcacaaaacctttggtagtaaccttacaggaatcatagtgtatttttgacagttatactccctcctgtaacaaacttcaaaatatataaaatggcttaaatacaagagaagtttattcttgtttgagtctacatttggagttcctgggtggtggtggctctccactaagggtgggttcaaggacctaggtaccttctatctcaaggctctgtcatatttaataaatggcttctcaagtcaccatgttcatctgctacaagtatgtgaaaagaaaagagcatggagatcaccaatagggactctctggccaggcctggaagtagcacacaccatttttgcagtccttccattggctaaaaaataatcacttgagcactgctgcccaaaaaggaatctgggaaatgtaggctcactatgtgcccagaaaaaagaagaatcaggtttggttacagctagccattctgtagctggataatgagacatctgccagaaaactgtagttaggcgaatagcccgaatttttaaaatgctattgaaatggagttgaagggtatagaaacatcatagacttgaaaccatttcagaggggaaagcagtgatcacttggagtctgtaccttatcttctgcgtattagaaagatgtttaactaatatgtggcattgttgataaatgagttctgggtgatggtagcatttagtggattcatacttctttagattaatgtgttcaatgagtggtagtcattgtcatccttgaaggtgtcagttgacctgtgtcttgtgactttcctttctcatgtctcattaaatatttttatgaacaaccttaacagaggcaaatttatggttgactcagtaattagggataccgaatgtcactgtgggtgaaagaatcaaaatgatcccaacagtttagaatacagtccaacagaatttttctgaaaagggccagggagcaaatattttaggctttttgggccataaagtctctgtcacactagtcagctctgctgatatagtcccaaagcagccgcagacaatacataaatgaatgggcatggctgtgttcaaaggaaaccaaatttataaaaacagatggccggccagatttggttcatgggccatagtttgctgttccctggtctagaagaataggctgaaattctgaagggaatcaatagaattttttttttttttaatttacagccaaagaacaatgggcctaatacatacatcatgtcctttctaataatagaagagctccaagttaggcactatttgctcttattttacagatcagaaagctacatctcaatacataaataagtcaatagtttgacctagctttcacagccagaaaacccgctgtgggacatcatgccactttaaccaaatgtttgggtgaactgagagagtaacagttaattgcttgagtaaaagatggagggaaatgtcatgtggcagcatttcccatgggcaaaccctgcgttctggctctgttcttttccaagtgtgtgaccttgagaggtacacttgacctctctcggccttgatgacccaatccataaaaatgaaaggcttgactagataaacaccaaggccccgctcatgtcttatggttaaggttgcgattagtatgttaagggcattgtgtgaaagacaattgagatgtattctttgtagctcttaaagtaattattttcaaccattttctagtgtacttttatgggagaacagtatgtaaaacataaaaatggcattttatgagcctacatgtgttttacaagttcaaatttacattttgattataaagatatttattgagagaataaggctgataggaaaccaaatttttaaactgggaggataaatgatcgacagattctttttagcttcagcaactccgcattctccccattttgcttttgttgtttgttggttttcctctggttgtattaagaaaatacttattcacatacacaaaaggtaaatgaatagtttcgcaatctcagaatacttttcagaatatagacatggcaagagacaattgaaaagcaaaatcattaacaaatcaggtgatctttagcatattaatatatcattaaaaatgtaacttaatcatttgcaaaatctatcagtcaaaataagctaagcttattctgtgatgccaaatgaacccctaaacctaagtgacttgctgaaataggtgtatatttcttgatgtatttcttgttcctcttacatatccaattttgggttgtattgggagcaggggctctgatccatatagttacatagggatccagactgatggaggctccaccatcttgtagctgtaccgtcctgtgcacatcatatccttagctgctgaggcaggggctgaggcacctggagcgtaaaacactggcagttttaaacagcgcctgttctttgcacacgtatgtgaaacacatacatcactgctcggtggttgccagatctagtctcatggacctttttcggaagtcattgtgtgactcatatgaactaaatatgcaaaaaccatttggaagaactaaagtagcaggccgcaaacgtggcttataatttaaaaattgaggttcctgagttccccaccctacagccatggaaccagaatctctgcgtatagttggagaattttaattttttaaaaagttccacagctgattctcattatcaacaggcagctgctgctgtgaacaaggagtgtttttaaagcggagaaaaggcaatacttagattggcggatttaagattaccctggctgcagtgttggagatcgattaaagagggggtaaagtagaagctgggagatttcattttactacataatgtataggctctaatgagcaaacacaaatgcatgtgcttacatatcatgcagtgtgttagcagaactagctcaatctgagggcctaacaatgttgttgatgtctctgtatatttaagaatcttatccccaacccttccttccggactcctagaaaaccagtagggtaggtacaaattggctgccaaccagtccttgttcaatgcatttgataaattctactggtggtggtggctgtatagccagcttggcacccatatgagtctgtggatagtaggtggggctgaggtgcctaggcatgccctgcttctctcttgagaggcaattagaaatgatccaactttccttcaagcctgttagggcagcatagatttgagttttgaatctggttatattgctgtgtctactgttctctaggaagacttgagaatttagagtagatctgcaacagaagaaaatgaccagtgcatgattctgcttgaaaactaaacctgtctagtcagtgctggatcatttaaagattgaccatctaggtttgaatttctcttcctatatgctgactgcctttgggctgattcacctggggatattagcatctttcccagattgtgtttggtatggggaggtggggagttagggaactcccatctactttgggaagaggaataagttctattcctttcaaacattatgtacagcacttaggagtttgctgttcatgcatcatggctgaaacatttggacaattgataaaaatttgtcattgctgcccagcactttctctgagatggatgaacttataggtaggctctctttttattgtacttcatttcatcttgtattgacacagccccagttatagactttcccccaacagaaggaacaacaacaacaaaaaactacctaactactggttacaggttaaagctggaaatgtgctggcaacagatttaggtttttccaatattattttgcctgttcatcttcttttttctctattatcttttttttttctttttttgagacagagtctcactctgttgcccaggctagagtgcagtggcgtgatctcggctcactgcaacctccgccccccaagttcaaacgattctcctgcctcagtttcccaagtagctgggattacaggtgcacaccaccaagcctgactaatttttgtaatttttagtagagattggttttcgctatgttggccaggctggtctcaaactcctgacctcagggtgatctgctcacctcagattcccaaagtgctggaattacaggcatgagccaccgcgcttggccctattatctttaataaaaacaaagatagggaaattatccaaaaaattagctaaaagctatataactttaaaatatgtgaaattaataatttcaataaagtacttaatataccacaaaacaaatgttttcacttatcagcttttcagattaagtatcaaaattctattcaagtaacatgagaaggtacagcaatatgtgaagacccattatagaattaagagaggagaagaggaagaacaagggtaaagaagggcccagaaagataaaaagacagagggtaagacctccttatagctatgcatacagtaccttctgtagacacacactctctactgcaacctcaaagaaagtgcaggcaggaaaagaaatctgcagaagaaagaaaatgagaatgtttgtcttcatgatgtaacattattctttgggtgtcctgatgagctattgttcctcaaggtttttaaagctttattgagttttcagaactttaagcaccattggtaataccaattggcacttgtccaatgagctgagtgaaactgatccaaaagctccagaagctgccacattccaggtatggagtatttgggggctgtaattataccattgtaattactgtctttaataggattaaaaatagaactggaataattctatggtaagttgatgtcacttattgtgacccaagtttcaattataattgttaacgatgctattgctgagtccttgtttggcttgactgccatgcagtgtttttctgatgagtgaaggagttaacaccttttggacaattttcagaattgaaagaaaattacttggtttttagtagggtttgtaattattatatccaaggttggtatcttctagaggggaactttttagaaaattaatattagactctctcccagtctattgaaaggccgtattaaatctctatcatatactcttcaatgctgtgatcatgattatattcaaacgataacccacattcttcctctttgtggtcatttgggacacaggtggcagtctcacatatgataaggaatttgaatgttagcataaaccattttagtggcaaaaaacacacaaatgctttatataaaaaaagagtcaattttaagggtatcaaatttgtctatgaagttaagctttaggtttactggcagatgcagatgtagtgactgtataatagattcatgccttagtttctaaacttacaaaatctgtttgcttagtttagtgtcagattgtcagtctgctttattgattccatcagtggtttggcttatcatatcagaaatttgagtgctgacttctggcctcaagcgatcctctggcctcagcctcccaacgtgcttagattacgggtgtgggctatgatgcccaaccctaacatttctatcttatgaaatagttgacaggtagatataatttgttactggagaagattattttttcattttgttcttttaagatccaattgttattttctgagtttattaacatagctagccttataatgagaacacagctctcacttttaccattttgcttaaagatttgcagatgtgtcgtgctcatatacttcaatgtctctgtgttttctcaggatgttacagttctgcttcttttatttcctaaaattcaataattttatctgtgttaaaaagtattttaaaatgtaatgaacacaatgttgtggctactcataatagttttagtgaatcaggaagtatgccaggggatggttgttagtagaaaaaccatttcatgtcatcttcagtaaaagataaagaagtgagcttgaattcagagagcttggtatataggatgactgacagagataggagctggggcaggaataaaaagattgagaagattgaacattaaacagaacttcagtcattagccaatgtaaacaagcaatcaaagaatagtccccttaaaataggaatcatttaattcatctaacaattaagaaaatataaacattacaaaccaatgtttttgttaatctggttctaattatttttaggttactgatgatattcttttagtataaaaatataaaatcagagccatttgcctagttttcatgtcatttttcttcatattttcagaaatcattgtcttacttgaaagttttctacttaagattccacaattaaaagaacaatgtttcctttaaggaatagtgctgcgggggcaggggcagaatttcttaaagcattttggggagtggtttaactaaataacctacatatagtagtgcacaagtttccaacttattaatagttgctttccagtgagtttttagctcctacattttttttggaagtaaatgtgatgtaattaaattaaatattctagcaactaacaacaaaaggctttttcaacagataataataaattgaactcggaaactgtaaaaagaatgaaggagaactaatagaaattgatatggaaaggtgtctaagacaaagtgaagtaaaaatatttgtataaaactatggacattggccaggcatcttggctcatgcctgtaatcacagcattttgggaagcagaggcatgcagatcgtttgagcccaggagttgaagaacaggctgggcaacatggcaaaaccctgtctctacaaaaactacaataattagttgggtgtgatagcatgtgcctatggtcccagctacttaggaggctgaggcaggaggatggattgatcccaggaggtcgaggatgcagtgagccctgatcacaccactgcatgccagcctggacaacagagtaagaccctatctcaaacaagaaaacaacaacaacaacaacaaaattgtggacacaatatgttcccatttgtgtgggttttttttttaaagaaacacacatgcatatatacacatactaatccctatgtaaatatatgcatacaaaatttacagaaggatatacacaaagctgtggaggttgattcaggaaggatgtaacaaatttactattatatagccttctgtactatagttttgttttcccatatgcatgtacccagttatatattgtccttttaatttaaacatctagtaaaaaataataatttcaatgagaccagaaattactaagcaaaggaaatggcaaggtagttctacttttttggaaaaaaaaaaaaaagaaaagatggtcattgtatttgaaacttaagacaagataataacacgtattatctggttaatgaatgcctgtcctgtcttcacaaggatttttcctgacataaaattctaaatatctgtcaaaaatatatatatatatatacttgagatggagtctcgctctgtcgcccaggctggagtgcagtggcgcggtctcggctcactgcaacctctgcctcccaggttcacgccattctcctgcctcagcctcccaaatagctgggactacaggcacccaccgccacgcccagctaattttttgtatttttagtagagacagggtttcactgtgttagccagaatggtctcgacctcctgacttcatgatccgcccaccttggcctcccaaagtgctgggattacaggtgtgagtcaccgcacctggccaaaaatattttttaattatatacactaaataacaacataatgaataatgtcttcaatatcagttcctcacacaattatttcttgcgttgaacttcaataaaattcagaatataacactaatggtataacttgataaggtattttataggaagcattatagctcacatttaccaaggcttaatgttttacaggcactcttgtaggcatattgcttgcatgatgttattaaatcttcccgacatctctatatgatctctattttacaggtaaggaacctgagggagagagaggctaagtcagttactttcccattacgctgctagtaagtggcaaagccaggatctgaagttagactaagggcccatgttctcaatgatgagacatgccttaggtatactgactgcagatgacctaacttgatatgcctgtaactcttagacaacttaagaaagatcacatttttcttactgatgattgagaaatgcagtctatctcaaatgcctttcataggagctgaatgacagtcagattggcagtggacagtctagcaagctcctacaagatagaatgggcttatgggaaacaggtcctttttaacttaaaaaatcattttcgaataggtgatacatgcatattatacacacagtgaaaattaaggctctctctcatcacaccctaagccacccacttcttttctcagaaagcaaccaccattactaggttcttatatatactaacagaaatgttttatttgtatgtggataactacacatacttcacattgttttcaaaaattgaagcatacgacatgtggtgttctatatcttcctttcccccttaaaaatacttttctcaagattctttcataatcagttataccaggaactgtgtagttatttttaatggctgaataatattccattatatagacatgtcatattgtatttaatcatttccttattagtcaccacttaggttattttcaacattttgctattgcaaatagaaaattgcatcatttcatacatcagtaggataaatatcaagaagtgaggacactgagtcaaaaggagtgtgctttaaaaatgttgatagatcctgcaaaatgaccctctttgatgatcctgcaaaacggtagtaccattattcgctcccctactagtaatatatgaaagtggtagtttccacccactgttagcaaaatggcttgaaactttttgatcttcaccatcctgatagaagaaaatggtatttattggcagatatttgcattcctcttattagtaatgaagcaaatttgttgtttatgcctttggtgtaatctctgagtccactgccaattccaagatcatgaagattcaccttatgttttcttctaggaatttaatagttttaagtcatacacttatgtctttaatctattctgagttcatttctgtccacggtgtgaggtaagggtttaatctcattcttttgtatgtgaatatggagttgttactgcaccatttattgaagccactatttttccccattaaatggcctgggcatcattgttgaaaatcagtctgttttccctaaatgtatgtgtttacttctgaaccctgaattatatttcatcaatctgtacatctattcttacgccagtactacggtttttgattactgtagctttgaagaaagttttgaaattgggaagtatgagtcccccaactctgtttttctttttaaatattgtgttggttctttggggttccttgcaattctatatgaatttgaggatgggattttccatatctgtaaataaaacaggggaattttgatagggagtgtattgcatctgtatattgatttctgaattgccattttaacaatattaagttttctagtccatgtatatgggatgtctttccatttatttagattttctttaacttctttcaattatgttttgtatttttcagtaaatgtcttgctcctccttggatagatttatttctaagtatttttgtctttttgatgctactataaatggaattattttcttaatttcatttttggattagagatgcctttttgtaatgtgtctatttgcaggggtatctctttctaatcgcacaaaaacatcttgtgctggcactggtgatctttgggagtgtaacatcagcttgaaagtgccatagaaatagggactctctatcttagtgctgagtaggcatttactaaagctgaatgaatggatgacaatttgctgagagtgagcttgggtaggagcttaagagaggcagcaaatatggattttcaagaaattcagtgatgaatggaaggccttaaaaatgaaggaaatggaatattatccaggatagactataaactaggccataaaaaaactcaatgattttgaaaggatgggggaattgtaccaagtatgttctctaactacagtaaaattaagttagaagtcaaaaacacaaagaaatttgggaaattcacaaacatgtggaaattaaacaacatactcctaaatagccaatgagtcaaataataagtcataaggaaaattactttgagataaataaaaactaaagtacaatataccaaaatttgtgggacagaactaatgaggtatgtagctgtaaaaacctatattattaaaaaaaaagaagatttcaaatcaatagcctaaccttctgccttatgaaactagggaggttggggggcggcggggggaaatagaagatactaaacacaaaacaaatagaaggaaattataaagattagcatggatattaatggaataggaaatagaaaaacattagagaaacctcattaatgaaacctcaagttggctctctgcaaggagcaacaaaattgacaaagatttagatcgagcaagaaaaaaacagagatgactcaaattactaaaattaggagtaaaagagctgatattaatataaatcagagaaatgaacaggattataaaggaatactatgaacaacaaattagatgacttacattaaatgaacaaattcctagaaagacaaaactaccaaaactgactgacacaaggagaaatagaaaaaaaaaaaaatatatatatatatatggtaaatgattatagtaatttaaaatattaccagaaagaaaagcctagagccagatggcttcaatggtgaattctaccaaacatttaaagaatgattagtaacaatccttcagaaactcttccaaaaaagtgaaaaggatggcatacttctcaattcattgtcaaaggccagtattacccaaataccaaagccagacgaggatatcacaagggaagaaaagtataaaccaatgtaatatctattatgaatatagacaaaaaataatcaacagaataccaacaaaccaaatcaagcatcatattatacattctgaaggttatctaaggaaggcaaggttcatttaatatacaaatattaattaatgcaaacactatattaacaggataaaggacaaaaagcacaatattatatcaacagaagcagaaaaagcatttgacaaaatctaacgtcatttatgacaaaaaaattagaaattaggaatagaatggtgcttcctaaactagagtaagggcatctacaaaaaaacgatgtataatatcatatttaattgtgaaagactcaatgcattttctccaaattcaggaataaaacgatatctgctctcacaacttctatttaatattgtactgaaagttctaaccagggcaattaggcaagaaaaaaaggcacctgaattggaagggaaaaaacaaaaccacctttatttacagaaaacatgtacttatatagagaaaatgttaagaaatccatttaacaatgaatagaatttattaatgagtccagcaaggttgtaagatacaagaacagtattcaaaaatcaattttatttctgtatactagcaatggcaatctaaaaaaaatctattcacaatatcaacaaaaaataaaacacttattaatgtatgtcacaaaaaagtacaagatttatacaatgaaaagcacaaaacattgctgaaagcaactgaagatctacctaaatggaaagacatccttttgtttatagaagatatagcaatacttcccatattgatctactgatttaatgcaatccctatcaaaattacaactgacttttttctttgaagaaattgacaaggtaatcctaaaattcatatggaatgaaaaggattcaaaatagccaaaacaatcttcaaaatgaagaacaaaatgggaagactcacactttccaatttcaaaacttactacaaagctacagtaatcgagatagcatggtattggcatgggtttaggaatagaattgagagtccagaaataaaaccttgtatttaaggtcaattaatttttgataaagatgcaaagacaatgggggaaaaatcatcttttcaataaatggtgctggaacaactggatagccacacataaaagaatgaatttggaccacttcctcacatcaaacctgaaaattaacccaacatagatcaaagacctatataagatcaaagatctatattagacctatattagatcaaagtcctatgttagatcaaagacctaatataagagctaaataaaataaaactcatagaaaaaacataatagttaatcttcgaactttggattagtcagtgatttcttagatacaatgcaaagcacggatgtgataaaaatattgataaatttggacttcatcaaaattaaacctttttgtacattgaaagccaccattttgacccagcagtttcacttctatgtatatatgtgaaatgaaaacaggtcaacaaaaaaacttaattacctagatgttcctacattattcacaatagctgcaaggtatgaacaatccaaatatccatcaatggatgaacggatcaataaaatgtggtatatcttatacaaagtaatgttatttggtggtaagaaggaatgaagtaccaatacatgttacaacatgaagaagcctcagaaacattaagtgaaagaagccagaccccaaagaccaagcattatatgaaatgtctataaaaggcaaatccaccgaggcagaaatagactagtggttgcctagggctgcaagtgtgactggggagtgactacagatggtaaaaagtttctttttgtggtgatggaaatgctcaggttcaaagattacattttgatgatggctttataaccctgaattgttatcaggtgaactatataattttaacacgtgaattttacagtacttaaattacatatgaataaagttttttttttttaatgaggcaaaaggtagcgtgaaaaagcaggcatggcatataagcaagctttttttaaggctgagtgacttatgtggctgatagaggaaggataagaggaaaggaaatatagtgaaaaggaacagagaggaataataaagctggcaagtcacagacaacataattagactatcaaaagaaaatctggaagaaaggcatggacaggaataaagacctccttctaaagcaaggtagggagagcaacttgatgtagattgaagagaaaaaggaaagaaaaatgaatgttcatatttgatggcctatgattttctgggtcatgtagaaggcaaagtaacatgttcaagtgatgaatttggtaactttaggataatgatgacagttcagacaacaaatacagagaataaaagagaacactgactatatgaatagaaggattttagagacattacgactcagccgagtttaaatcaaagattgtaaggcattcagtcatcaaggttatacatttttctccagcagctctagccttctatgaaatagaagcagaaaaaaaacccaaaacagatgggttaactacctgtaaatctggatttgaactggtagaatgaagcttcctgcaaatgttggatgtaaaagtgcagatctaatcaggtaaaatctcaagcattaattggatatgcttataacaaaccggtaaatttttagaagatgtaaaacatatcttagaaaaataatttaaattattaatgagaattagactaagtcattgaaatttgatttttaaaacttaccgagcctctctttcattgaactcagaagtagtgtgaatggtaagtcttccttgtcaaatggaatgctacttagcagctgtcttagctcgttccagatgctataataaagcaccatagactgactgactggtttataaacacacatttatttctcacagttctggaggctagaagtccaagatcagggtgccagcatagttggtttctggtgaggaccttcttctggtttgcaaactgatgtatttttgtatcctcctgtggcagaaagatggagacagctctctgggtcccttttttataagggcactaatcgcattcatgcggcctctatgctatgaattacctcccaaaggccccatctcctaataccatcacattggggttaggattttaacaaatgaatttaagggaaagcacaaacattccgtccactgcaacatctacaaaataggtccttaggaagtgcagaagtctggaacagttctttcccaagccacaaccctgaaaacatggattgctgggtatgcagattctcctgggtccctttcccataaacaccgaattagacactctgaggatgcagcccagacattctgtatttttcaccaggcataatggtgatggctgatattagaatggtgaaatttatcccacctagtaagaatctaaactgaaaatggtgatgatgcaaaaaagatctgtcaaccagttaaaaaaaaaaaaaaaaaaagagggtgtgtgtttgtcaggagggatagtctttagtagtatggccaaaagcttaagcctgattttcagggctctattgttggagtgggtagttcatcaacttcctaagtaattcaaatctttttccccccaatatattaatatattggtgattccaagaaagagggtttaatttatttaatgcctgggaaaactaaaagaactacaaacagatgtgaaaggaagagaataaccacatctcacaggaagcaaaatttctgtcaaaagttactgttctttccctgtctaggttctttgtccctgaaaggtagatccgcaaactaaatccctcaataacgttgcctaaacaggactgggatcatagaatgtccaacactaacatgagttcataatggcacaacgaacttaaaatgttactattcatgttttaattatgattgcagtcttacgttgaaggtatctccgccgtccttaaacataaaaaaaaaaaaaggaaatacaagctgcaaaagttttatgtaatgcactccaccctcttttttccccaagccaacacacacccttcaaactttttgacagttattttcagacccctcctaggctcccgaactccatgcaactccagcagtctcccctgggccatttttagcctctgctctgacctggcgggaggctgggtgtccaccctttcccctgcagtcctgaaagtccggtccgagcgcggacggggcggggaggggctgggcgggccaggccagctccattggcgccaggcgggtgggggaatgcgctgagaggacccgtccagcttgcttaaaagccatcagttttctgaccccgcatcggttccaggaagaatacacctatgtgacaagctaagttctgcctcattttgcatttagaagccacaagaaaaacttttcgaaaacttttgtccgtcttttgctcccccgacgcgtggtttcctgatggtccgtccccgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcaggtgcgcttcgaagattacctgagggagccagcccagggggacctcgggtgcgggtccccgccccaccggcccccggcgccgtccagcccggagggacctggtgagcccacctttctttcgcctcccgcgcggccgacctgggctgagggctgtggggaggcggcggtcgtggcgccgggcgggggtcgctgcccggctctggcaggtgtgcctgggccggggcgggcaacgtggccggggtggcggccgccgggggcgaggaaggaaggactcgttcggctctggggagggaagactttcagctgcgtgccagctcttcctgctctgctcttcctgctttcctcacctagacttgattttctttccccgccaagtatttcaaggggacgatccattctctctttccctcccactgggaggtgaagactgaaccagttatgacgtccgtgttttcagtcttggattcttgaagagcgctgtgcctgctttggttttggtttgggtcagtctttccttaatatttctcagttgttaggattcacttcctaaccgaaaaataaaaagccagatacttctttgtaaaataaaacacttcattaacattggaagctagttgacattttgcgtcgtgtactttttgaacggctgcacgttgtcttgtggtggcagaacctagaaactttctcagttcctgtttattttgtgttgtgttggccgatttttttcaccacagtggctttgtaccattctttaaaacagtcatttgtagcgacatgatattgataacttaaagaatttttgaaagtgctgctgaacagttttagcataatgcatagggtaacttccagtgtccttggcttcgtttaacaggtagcagacatcctagccatgtctgatttttatttttgttaattgctttaatatttgagggttatgaaaataaatgagcattagagagtttagaaaatagagataggcacaaagtgtgtaaaatctgtttataactccacatcgtgccagtcattttattttaaattttatcttactttatttttgtagagatggagtctcgctgtgttgcccaggctggtcttaactcttggcctcaagtgatcctcctgcctaggccttcccaagtgctgggattacaggcctgaaccaccatgctgggccctgccagttgttttaaagcagtaaaacagtgaggacatttttgatctatgtgtgtaggtatgtaatttaagctttgaagaaatattaaagtctcattttagcatagccctttaaaataaattttccttactttacataaaatattttttatctttagaaatgctgtttatggaattaggaaatgaaaaggggaggggaatacttttgtttctgctctgaaggacgttaaccaaatgcagaatcctcttaaaggtgggaccaggcataggaaagggactttaaagtgttcaaatcaaggactttttaaaatgagttttcagtagcctaattgaaaacagttgatgtgtgaccagccttgaaatgggtggagaattcagaaatatgtggggtaacttaactaaaaaggaatatggttagtattttaataaatatggccaaacacgtgtatctgattcattcggtggcccgtgtctgtagttccagctactctgctcaggaggctggggcgggaagatcctttgagcccaggaggagaatccagactgggcagcagagagacacttatgtgtttatatatgtggagcacacagctatatctgacaccctccttcaaagtggcgcttctgaagtgatatgtattcctcttctgttgaagctgccttatgtattcattgcatattctttaatagtcatggtgcccccaaatctctgacacattagagaggcgttgtgaggtcaaagtatgaccacagtcatgtgggcaggtacgtcctagcattaacttcctgaaagaatttggacaagttacttagtgtctttgggcctatattttcttctttgtaaatgaggttggatttggtgatttcaaaattctctattctagagcattttcatttggagcagaattagtgaaaactagctgacttttgagaggcaacgtgtatatacacaagtgaaaaataaatgattcttcatatgtttccagctagcctttgtttaaaatgagaattctgtgctttgcagctgcttctcagatggattttggctctagggttgttctttgtgtttgtgtcctttagaatgagtgtctgtcagtctgtttgaaggatttcttctgctctttctactcttatttcagtttcttaatagctgcttaagtttcctgctatcattctttcttcagttctttaagaagccctgtgtattataggagtatttcttgttacagatactttcacacatgtaaattgactgcattccaggaaaccctttgttgttagtgatcttattcctcctttcatccactaagatgaaaaagtagaaccttgtttctgttccttctcacaacccaacatcggaggagttacgcatcaagaaggggtggagggagtcatgttcagcaatgatgttgataagatagtttcaccattgacagattaaggatagaccagataaaattttggtcaaatgtcagccagttgcggtggctcacgtcggtaatcccagcactttgggaggccgagacgggcggatcacctgaggtcaggagttcgagaccagcctagccaacacggtgaaaccctgtctctactaaaaatacaaaaattagctgggcgtggtggtgcgtgcctgtaatcccagctacccgggaggctgaggcaggagaatcgcttaaacccaggaggcaaggttgcagtgagatcgccctactgcactccagcctgggccacagaacgagactccatctcaaaaataaaacaaaaacaaaaattagccaggcatggtggcacactcctggaatcccagctactcaggagactgaggcaggagaattgcttgaacctgggaggtggaagttgccatgagccaagatcacaccactgcactccagcctgggtgacagagtaagattccatctcaaacaaacaaaccaaaaccaaaaaaaactttggtcaatgtttctgagtttaccctttctataaagaaaccacttactgaactgttaatgtctctccttcctttactcctctccaaggtggctgcttttgctcttaccagcttttagtgcttgctggctccatcattatagccctctcaggaaaaccataattgagacttagacatattaaggacattatcacaccattgatctagttaataacaattacaaaggaaacatcttaaaatacaatgcttgttcctgattaacgggtacattatgctttgattttaaaaaattgttttgaactttaaatatagctcttgtttgggggcataactataactcataatgtataatctttaaaagtactcacttcactagattatattgtaataaatatagataaattttactagtgtagactctcaacttactgtcgtataaacatgaaatcgtttttatcataagcgtcctattatatcaacctcattttcccacttggtgacaggattctttgagcacaactcagcccttttacattttcttttcatttatttttagcaattaaaactatctttcagttatttaagacttggtccatttatttaaaaatttcagtctcatattcaatttatatctccatttacctttctacctcagttcccattccaagttaggttggtagcggagaagaggtgtggtctagctctcacaaactcccctccaccccttcttgatgcattaactcctctgatgttgggatgtgggaaggaatagaagcaggggtccactttttcattttagtcctttttggccccttagtgggaggatgacaatggtggatagcagtagtagcagcagtgatggaacagttctgctaaaatggctactcctatgcagaagtgctgacttcagtagccaacagttctttcaactttgaatctgggacattaacatctggtaataccaaccatagaccttagttgcaaattgttgtactaggcacctaaaactgctctgcctcatagcatatatgttactggtatgtgtgtgtatatcaatagagttgatgaaaaatgaagttaagtgggaatgtattacatttttatgacttgaattatttgacatgtcaaggaaaaactatttaataataatatttttttaaatgattatccctgttgctgaagtttcattttaggtttacattaagcaaatcctatgtactgaatgtatgtaactgaaggagaagcgtttagaagcctgagattgatattcttgttactggttcacttttgataatcatggaaaatgtaaaccaagacatggaataataattataatagacaaaacatatagtgcttgctgtgtcttacgcacaagttaaccctcagcaacaaccctatgaggtaattaatagtagcattttcattttactggtgagggtactgaggttcattaatgatcctgtctagttgggaaaatagacattggacaaagaatttataactgtgttggttattgggcatggaatgtaaaatatattatgggagtatataagaagggtttctaacctaatattggggggtgtaaaatatcatgttttgcttggattgggggtaatgtctatttcagtaaatgggatgatgatgatgatgatgatgatgatgatgatgatgatacttgtagtaataacagaagtagtaatacaggttgagcatcccaaatcagaaagtccaaaatctgaaactttttgagggcctacatgatgctcaaaggaaatgctctttggagcattttggatgtttggatttgggatgctcaatcagtaatgcacatattccaaatccatcctatcctttaggaagattcaaaaaaatccaaaacactcctgttcccaagcatttcagataagtggtactcagcctatagcaagaatgatagctgtaatggggcaggctctgagcaaaagttttttatttaatcctaataaaaacctgatgacatagtactattattatcctattttccttttgaaaaatctgagccaaagaaagaagtgagaaattcagaatttatttgggtgttttcttagtatttgcaagagttacagtccttgagataggggaaaaatgtgagaagaattaaaattctatcatgtaaggtattaaagttaaattagttaagattgtaaaggatagaatggattgtcattgaaggttctttagagttagaaagatagtaaaatgacagagctggaaatgcaaaatccaatgagggtgtgagaaaaattaggtatatattaggttggaaattgccacctcagatgatgtgttaagagttagatgatggtttatcttgaacccaggaggaccaagtgcctctaaggcaggggtccccagccctggtccatggcctgttaggaaccaggatgcacagcgggaggtaagcagcaagcgagccagcattactgcctgagctctgcctcctgttagatcagtggggacattagattctcataggagtgtgaactttattgtgaactgcacatgcaaggtctaatccctgatgatctgaggtggaacagtttcattgagaagccatctctctccccatcccccaccccttgcccacatgtccataatccatagtcttccatgaagcctgtctctggtgccgtaaaggttggggaccactgctttaagagacctggagtgtaccagttgttacagtaactttttaaaacaaccaccaccaccacaaaacaaaaaactcacagtgttggtagaagataaccctagctggccccagttttagtctcttttcctaaagccggatgggaggaagagaatactctctacttgatcggcaacctcagtgggctctagtggtaactcccaactagttagcctttcttaatagtgtatcatttagttcagtggttctcaggcatgaggttgatttgcctgttttagaattgctgcttgtctcacaggatagctgataggaagttctgtattatctatgttgtagaacaaaactgcctctaaaataagctgatgattctcaaacttcagcatgcaacagaatcatctcctgaagggcttgttagaaaaatattgttgaatacctctcctagaatttgtgattctgtgtggctgagaatttgcatttctaacaagttcttaagtaatgctgatgctgctggtctggcaaccacacttttcttagtgggtaagtcttttatccatgggaaggttagaagtaaatatagaaatgatgaaatttattaaatgcttatattaatagttttgttttaagtctaggaataatcagtgtatttggtctttaaggtatttgttctgtttcatagaattaggcctataaaagtggccaacaaattagtcttaagagtataatttaaaatgcatacttgcgtaattgttttttgacttgggattttaagttgaaaggtgcaacaatttggctaaacttagaaaccactggaatgtttaagaacttaacatttattatatttaaaacttagtatagggtttttaatatttttctcaggaggtttacttgttagaagcaatgtgtttaaaatagaatatagtaaatttataaatgcagtttagtatagtaagtcctcctttgacatcatcaataggtttgtggaagttgcaccttttaagcaaaatgatgtgtaaagaaaccaattttaccataagctaattgatgtaaacaagagttaggttcctaccatatatttctggtcacaaaaacattagcaaacttgtaagtaaagacctaaaatacttccattattaaacattgaaataaatgtgaactatgcaaacattaaagaaagattaataaagacaagagaattatttactcagttattccagtcagagtcactgttggctggatcctgtcctgctcatggcacaaggtgggaaccagccctagacgggacaccattccacctcagggcacagtcacacacacacacacgcacacaaacacacacattcatactaggacagtttaaacacactaattaagctaatgtgcacatctttggatgtgggagggaactggagtacctggagaaaacctatacagatgtgggtagaatgtgtaaactccacacagacagtggccttgtctgggaattgattttttgttcttatcaaagttataacaaaacaatgataacaaaacgatgttattcaaggacctgtaatatatgtaagagaacttagttacccatgtttataacaggattatttagggatatttaattttccagtttgagttggtcagctatttaaagcaccttagaaagtgttaaaatttgctagattataaatagaatgcactttttatggtagaagacaagggaaagtaggtttttatatttttaacttcaagaaatctaacattaaaagtaaagtgactgcagatagtgtttttctgtgtgtgaaggcttatttcatggccactaggaaacttacattaggagactctttataaatgttgttcaataggtgatactagtacaaaaaggaatgtgttttagggtcaaatacatacattagagaaaggacaaaaattggcttttattttctagcagtaaatggaaagaaggaaatgtaatcagccataaatcacagtgtccctaggataaagataaacctgttgcttaggcagccaggagaaacacagttattccttatagtgagaatataacaaaaaaaaaactcatggaactctgtaataaagcaaaacaaaccaaaaagcttatttttatggtaagtacagacttcagtttcaaaaatctatttttaatttttttaaacccattaaatctttaatgtagttcaatggtgtagctctaaactgcaagttagtaaaagcacttctgtacaaggggaaaacaattaatccaaatatgcagttatctaacagtccatcttaactgagaggtaggttttacattttaaactatagattttagatagttacgactctctgttttggatttttttgagagtactactcaatagaattttttgaggtgatgaaaatggtctgtatctgtgatggccagtatggtagccactaggcaaatatggctattgagtatctgaattgcagctaatgcaaatgaggaactggattgagaaaattggattcaggattctgtatttgctctatctaatatggtagcaactagtgttaaaggaaaaattatttgataatacttcctaaagcacaataagacagactttattcaggaccattgcaatagggatagggactgtggcaatgagattttgtagttgaggagagagattgggctcaactccaaatacaaaatgggcaagtgggaatttctagccaaggagtagagtaaggatagatggatggacaattgctaagaggtaacgtcaggaataaggggtattatggtgaaactgacctaccaggattcttgctgaaggcaggccagagtaatcagacttcacctggacagtggaggatgagaaaactgatcagatacggaaggtaatcagatatccaggatcggggtgggggttcctgctacactgaccttaacatgattcttgctgaaactcggttttataaggaagtgaacagattggcataggagaaggttcagcagcctgactaaaatttggctatgcaaataatctttgtgactaggcacatgtagctattttaatgtaaattaatttaattaagtaaaactttaaattcagttttcagtctcactagagacatttcaagtactcacaagacagatggctagtggctaccatattatacaaggcagatataaaacatttttaccattgcagaaagttttattgggcagcattgatagcaatgagtcccaatgcagggtacacattagaattccctgggtagccatgaaaaaattttgatgccaagatctgattataatcaaagatttgatcttgaaatctctgtttaagatctccacttacagtttcttacggaattctaatatgtaactagggttaaaaaccactgacttaggatgtgaaggactctacatcattctgttttccttaatgatatttctctcaatcaaactcttgctgaatttagcaggttattatttatttatttttctttacaagtacttggggcatgcacctattttatgatgcaagttaataaaagaaatgcatgtttaagttttctgccaacctctggatagtattgagaccttaggaaagttgaggtgacttacaatgaaaagttcctaaaaggaagacatgtttgtatgctgagagaaagatgctgaagataaaatgactgtgtggcaaggtccttgtggaataaataaactactggaattatgatcattcttttttcacatgccacaattaagagccattaatattgtggaatatttgcttccagtcttttatacgaaattaatttttaaaataaacctgatatatactatatataaataagtcatatgttgcaaatactgaactttaaaaatcacctctaatccagtcacccagagatactgttaatatttgggtaggcattactgccaagtaatgtacatcacttctatgtgtatgtacatatagaaggatggatgggtggttagaaggagggagtgacagaatgaaagataatacttattcaccacaagaggttaattcctaaggggtgtgtctaaatttaagcaaattctaaaaaaaaaaaaaagaaaaaaaattacagatactgttattacaatcttgtttcagttttaggtgggatatatttaaccatgctttggtatgacattagcagtttcatttctcatttttctcctcctcacatcctaatatttactcattttactatttttacattgtccatgtttgtaacattcatacttagtttttcaaccacttttttataacttattattgttctatattctctagtaaccttttagaatgtcctccttgattctggagtttttgatacaattggcataatttcagtcttatagcactgagtaatgtttcagtagagaagtctcatgcaagccagccagattcttttccatttcccctagtagatgatttgctttttatgcatgaattgttgaataattttttaagctcccaagcataataatttaactaagagtagaaatgggaatagcctgactcatgtgcccacatgtgtctatgtggaataatcttttaggaattacacctttcttctggaatacatgttgatggagcagccactatatggaagatctctggttttgagatagaaaagagagctaagaagtacaattttggctccaaacacttccacctggaagacatatatggttcattgggcaaagcaagttggccatgtctgacatcaataggatggtgaggtatattttatattcctcaacaggaaggaatacaggcttagtaacaataatatagtctatcaccatgactaatttagaaaccattatattagtttgacagatttgaaaactgctggtgttaactgtcacaaatatgaagttatgtagggaagcccatttcttctgtcacttacgcagtctgcaggtctttgatctcttcagaagctctatttgtatgtctctcaaatgtgttgtgcgtgcaaatcaatagtaaatctgtaggtccggactgagcctcagatcttacattcacagtaagcttctgggtgatgtcaatgcagctggtccctggaacacacttttaaatagcaaggctctatagctctttaatatcatggatcttttcacttagaagagagccaactttaaggtctagatggaggaaaaggggcagtaaaaaggaacattaatgggtatgagaccaagaggagtgtgaaatactttcaaataaagggaaagaggaacatgcagaagaagtctcttggatgtttcacagagatcagataaaaaaaaagtggaaaagcccatcaaatttgccatttaatttattcattttagggtggggattgtgaactggggaagagaagatattacaatacattgtggattctgtaggagataatggagtaaagacagtaaaagtagatttctactttcaaaaattcaactgaaaagaagcagaaagatggagtagtatctagaaaaagatagatactagatttgagggaaaattgaggggttttgttttgtttttgttttgatcgtggataaggagtcaatagtgaaatgttgaaaatacaggtttttttccctagtatctcattattgagagaattattagaaaagctacaatcagcaatctgttttttttttagtttagaagatacttttaaagtgtttgaagttttagtatctatattactgtttttgaaaatactgacttgcagctcaatgttttaaatagtcaaactttttatacatagctattatcaatattgtaatattcagttattataggagtcttttattacattaaacctgatctcatagtacgttcattgatgatttccagactttctacagcatacctttccatttctttaccaaaatgatttttttaaaggttttatactgctctgttaattctctgcttgaaagtccttcaggagttctgagtctagtaatagcaagctaggtaattcagactatcctgctgagaacaatttaaaaagctggacacaaagcaaacattttattaagggtatcagaaagctaagtggtatgggtaggataggatctgaatgaggacaaaggtctaaggagggagaactccaatttgattgctttttaccccaggggtagtgttgattcctgaaacaggaactgagagaccaaaaggtgcatttgacaggctgtgggtataatggaaccgggccagagtgcaaggcctgtcacaggggatgggtggccctagtgatctcttctcactttggaccccaaaatgttgtacattagggagaaagataaactgaagtagctaggcctccctaggaagatacttcaacttcaaattatcaaaatttctgtaacttaattaataagatctggtattactagtgtcctcaggcacttgacagaagcaaacattaattctttctggagaattaccagtttctacatgtaaaaatgttttgtcagacgattttgcaaattttatgttctgcacacaaaataggcacatgacaagatatgtgacacaatagagaatagaaacaggcccacggtaactctagatattctagttatcagatttaaaatagctatgttgagaattttgacctgattaagaattttgtagaaagttacaaactatgagaaagaaaaatggatattctagaagtgaaaaatacaacccctctaattaggacctttgtagatggatttagcagcaaattagacaccgcagaggaaagaattccctaactgaaaggtaagtcaaaagggaatgttcagagtaaacaggaaagaggaaaatataggagaaggtaagttcaatacaagatacagtgagaagttctaatatgtatgtacatatacatatgaatcctgaaagtagatgagagatagaatgggcaaaagcattatttaaagagagaatggctggccaacatggggaaaccctgtctctactaaaaatataaaaatcaggcgtggtggtgcgtgcctgtagtcccagctatttgggaggctgaggcacaagaattgcttgaacctggcaggcagaggttatagtgagccaaaattgcacctctgcactccagcctgggtgacagagtgagactctgtctcaaaaaaaaaaaaaaaaaaagaatggctgaaaacgtccaaactaaagaaaaactttaattcagattcaagcatccctatcaacctctagtggaaaccacaccaaaggcaaaaaaaaaaaaaaggaaaaaatagtgtttctaccttcaatcatacagcattaagatggacattgatttctcaacagacacagtaaaaactaaaaaactgggaacctatagatttaaaatgttaaaagaaagtacctgccacctagaattctgtgacctgtgaaatttcccagagatacaataataatcataaatatgagagcaaaactaaatcaaccttgactatcttaaaaataatgttttttaaatacgcatgtattcagcgtgtaaaactgtttcatatatcttggcagtggcagacagtttttaacatccttgcattgtctgggaagaggataaaagtaccagttaatattaggctgtgagcatatgtttattgcagcactattcacaatagcaaagacttggaaccaacccgaatgtccatcagtgatagactggattaagaaaatgtggcacatatacaccgtggaatattatgcagccataaaaaatgatgagttcatgtcctttgcagggacatggatgaagctggaaaccatcattctcagcaaactatcacaaggacagaaaaccaaacactgcatgttctcactcataggtgggaattgaagaacgagaacacttggacacaggaaggggaacatcacacaccagggcctgtcgtggggtggggggaggggggagggatagcattaggagatatacctaattgtaaatgacgagttaatgagtgcagcacaccaacatggcacatggatacatatgtaacaaacctgcatgttgtgcacatgtaccctagaacttaaagtataataataataataataataataataataataataataataaaaggctgtgaggagtcagtaattcagactttttatctctgggatgaccactaaaagaattgtttaaaaaaatgtgtaactttcagatatgtggggaaaaaccggagttaataaatactgaatccaaggaaggcaacaaaggagagaagtctaaaagaacaggtagacagatagaaaatagaacaaatagtgctgggcacagtggctcatgcctgtaattccaacactttgggaggccaaagtgagtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagagagaaaagaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccctcctgccaccttgtaaagaaggtgccttgcttccccctttgctttctgctatgattgtaaatttcctgaggcctctccacccatgcagaactgtgagttagttaaacctctttcctttctaaattacccagtcttgggcaattctttatagcagtgtgagaacagactaatacagtaaattggaactacaaagtggggtactgctataaagatacccaaaaatgtggaagcgactttggaactgggtaacaggcagaggttggaacagtttggagggctcagaagaagacaggaagatgtgggaaagtttggaacttcctagaaacttgtcgaatggctttgaccaaaatgctgatagtgataatggtaaatgaagtccaggctgaggtggtctcagatggagatgaggaatttgttgggaactggaataaagttggctcttgctatgctttacaaagagactggtagcattttgcccctgccctagagatatatagaacgtgagagagatgaaatagggtatctagcagaagaaatttctaagcagcaaagtgttcaagaggtgacctgggtgaccgtaaaatcagtcagttttatggattcacaaagagatggtttggatttgaagcttatgtttaaatgggaagcagagctaaaaagtttggacaacttgcagcctgacaatgcaatagaaaagaaaaacctgtttctgaggagaaattcaagccagctgcagatacttacttaagtaacgaggagacaaatgttaatcaccaagacaatgggtaaaatgtttccagggcatgtcagagaccttcgtggttgcccttcccatcacaggcctggagacttaggaagaaaaaaatggtttcatgggccagacccagggccttgctgttctgtgcagtttcaggacacagtgccctgaatcccagctgtggctaaaaagggccaacatacagcccaggccatttatttagaggatacaagtcctaagccttggcggtttacgtgcggtggtgtgcctgtgggtgcccagaactcatgaattgaggtttgggaacctctgtctagatttcagaggatgtatgcaaacacctggatgtccagacagaagtttgctgtaggggtggagccctcttggagaacctttgctagggcagtgcagaagtgaaatgtggggtcagagcccccacctagagtctctactggggccctgcccagtggagctgtgagaagaggcctaccttcctccagacctcagaatggtaaatccactgacagcttgcactgtgcacctggaaaagttgtaggcactcaatgccagctagcgaaagcagctgggagaggggctgtaccctgccaagccacaggggtggaactgctcaaggccatgggagctcacctcttgcatcagtgtgacctggatgtgagacatggagtcaaaggagattattttgaaactttaagatttaatgactgccctgccagattttggacttgcgtgggacctgtagtccctttggtttgcctaatttctaccatttggaacagagacatttacccaatgtctgtacccacattgtgtcttggaagtaactaacttgcttttgattttacaggcttataggcagaaggaacttgccttgtctcgggtaagactttggacttggattttagggttaatgctggagtgaattaagactttgggagactgttgggaaggcatgattggctttgaaatgtgaaagggacatgaaatttgggaggggccaggggcagaatgatatggtttggctttgtgtccccacccaaatctcatcttgaaatattatccccatactctccctgagttaagggagaaaccaggtggaggtaattggatcatgggggtggtttccctaatgctgttcttgtgatagtgagttctcatgagatgtgatggttttataagtgtttggtagttcctcctgagttcattcttcctcatgctgccttgtgaaaaaggtgcctggttcccctttgccttccgctatgacttaagctgaggcctccccagccatgtggaactgtcagtcaattaaacctctttcctttctaaattatccagtcttgagcagttctttatagcagtgtgagaacagactaatacataaggatacagaaatgttgagagtagaaagaaaaagcagaaactaatgaaaagagaattggtacattaatattagacaaagaatactttatggaaacagtattctgagaaaaagtttaattttccaggaagatataattttcgatttgtatgagcctaataacatggtcccaatgtataaaaagcaaagtagggagacctactgggaaccaaataacccataatttagagtgagagatattaacaacctccattggtaacagaataatcagacaaaaacaaatcaatacaaatatacagaatttgactaacacagtccacaaacttgacctcatggatatgtaaatacatgtgtgtgcatgtatgcatacacatatataaaacactaaaccctgcagtgcagagtatacattattttcaagcatatatggggcatttacaaaatttatacatcttataagtttccctcttaacactatcttagctgtgtcccagagattctggtatgttatatctttgttcttattagttgcaaagaacttcttgatttctgccttaatttcattatttacccaaaagtcattcaggagcagattattcagtttccatgtaattgtatagttttgagtgaatttcttagtctaatttttctaatttgattttgctgtggtccaagagactgtttgctatgattttagtccttttgcatttgttgaggagtgttttacttctgaatacgtgatcagttttagagtatgtgccatgtgacaatgtatattctgttgtttttgggtggagagttctgtagagattaggtccatttgctccagtgctgagttctggtcttaaatatctttgttaattttctgtctcagtgatctgtctaatattgtcagtggggtgttaaagtctctgagtattatcgtttgggagtataagtctctttgtaggtctctaagaacttgctttatgaatctgagtgctcctgtgttgtgtgcatatatatatctaggatagttagatcttacgaattgaaccctttagcattatgtaatgcccttctttgtcttttttgatctttgttggtttaaagtcttagtttaaaactagatttaaatcctagttttgtcagaaactagaattgcaacctctgcttttttctgttttccatttgattggcggatttttctgcgtacctttattttgagcctatgtctgtcattgcatgtgagatggatctcttgaaggcagcatatcaatgttcttggtgtcttatccagcttgccactccgtcttttcattgggacatttagcccacttacatttaaggttagtattgttatgtgtggattttatcctgtcatgatgttagctggttattttgcaggcttgtgtatgtgatggttttataatgtccctggtctgtgtacttcattgtgtttttgtagtgtctggtaatggtctttcctttccatattttagggttcttttaaggcagttctgatgctaaccagtactcttggcatttgctcttatggaaaggatcttatttctccttcccttatatagcttagtttggccagatgtgaaattctgggttggaattttttttaagaatgatgaatattggccctcaatctcttctggcttgtagggtttcagctgagaggtctgctgttagtctgatggacttccctttgtaggtgacctggcctttttctctagctgctctcaaatgttgtgattatttgattgtactttcatattgatggaagaaaacaaatagtttattttatgtgctttggtatttagatctgtgaataaacattttaatattaattattaaaatttagaactgtttttataatatgtaattattgcataatattttataatttttaattagtaaagagaatattttccatttgtttttcaaactttaaagtgtagaaagttagtacattagttttcttgccctgaactgcattctgtggtgagcttttgaaaattacagagcaattgcaaacttgcaaacatgtttaatgaattattgggatattatgaaacacagatcgaaaagctattaggcaaagtaaatacaaactaacggttactcctaaaatcaattaaggaagggtatattattagttaaaggtaatctgtaattgtatattgcattgcttgagaagtttaaattgcaagtttaatttgctattcaaagaaatcatttaaaaattatttaaaacataaattattcaaaaataaatcgaattttattttaatacattttcagttgtttaaaataaaaataaattctttaaaacttattttatcttaaaatagttttaatgtttgcattttctcattagagaagcaaatttaaatataaactattcagtgtagaagaattagaatactttgataagcaaaaataatattctttataaaaattctaccatattgcattgccaccaggaatgcagaagaatatctcatttcctactgtcaaacagtatgtgaccaaacttcttttgagtttttaccaacccgataggtgtgaaatgatatttcagtatagtttaaatttgcatttatctaattatgagtgagattgaacaacattattacatgtttaaggacatttttacatcctcttgtgaattgtctgattatatcttttgtgcatattttcacctgcattattttttccctagtttttaagagttctttaaatatttaggatacaaaagtagaatatgtgtatgtatgcgcacgcgtgtgtgtgtgtgtgtatctctgcatactatttttcctagagttgtaatggatgaaccataattctttctctacttttctttatggaaaattaatggcagttcataatagttttggtagttcaaagtatagttcaagttgttgcttcagaacattactttattagatgcttgccatgtgtcaggcccctagttaggcactgaggaggctttgtggaagaaaggcaatgttttggaggttacaatttagtggaagggatttaaacccaaatattaacttaacactgtgtcagatgctgtgaaggagacataaagatgctatgtgactaataacagggacttgggttagctgggtgatcaggaaggttttaggatagttttttaaagcattgcagaggtaattgtcctttttggggattttgatattattattattttttagtgcttgtttagaaccattcacccgacagctgagatgattaggtcaacataaactcttgtatggtcaaaatgccatttaagtttagatagagggagaacaatgaaatagatattttctagattatatggtcttaggttgaaccataaattttctttgaaaactatagtttttaattttggtaaattttgagggtaaagtaaatgtagcattttgccatgtttactatcttatttaattttgtgatttatttagttttttagatttcattttaataatttttatgtttaggtaggagtggtgttttattaattcagtgttgttattacatgaagtatagatgaaaaggttaacactaatacaaaatttaaagggaagcagtttcgctaatcttgatgataatgaaacattcaaggaagtcttgataagcaaatgaaaaatattaataattggcattcaatctgaaagtaaatgttcaaatgtatgtttctatatgaaagcacaccttgatttacttcatggcatgttaatatgaaagttcataatttaatcccatagagaagactatttttcattatgacttgtagaaaaattttttcctgtgagaactaatgttacaatttcttatttggaaaataatgatatatatcttgaaagatgtattttaaaaatatataatgtatcttaaaatgtgttggtattataatcaggttaaatctgttgaaataaattgtaatttagtttttaatgacttcctttctgttgacaattatgttttgcgttgacttgcaattattctattggttcatactagttaagttcctaaagcaagcaagtaggaagttcagttccttttttttgacagttgcttgatttttacagcagagcatcccagggagtaagctgtattactagtaaattagacatctgcccaaagagctctattcagtagtccttgacattactctgaaagaaagatgaatttaataggaattttgcctttttttcccagacactggccaaaagaagaccctagacaagaaagatggaagacgaatgtcttttcagaaacctaaagggactattgagtatactgtaagttatttgctttcgaaaaagctatttttctttgtaagagtcttctttaagacattctctgtttatactataaataagacaagcattgttaattgccttatttttaaaaatctgtatttcactttggataattgttttattttttagttgttgtttttttctttaaagagaaattttactgagatataaaggtagttatcctagaaaatttaatttaatatagatgatagtttactgagagagttcccatgggccaataatttttattaggttaggcttttaggaaaatttttagttctttagaaatgtgatcttcattatattcgcagcagtgctagtgatagttataatggcagatgggatacataaaagaaaagttgatattaatcttccagtataaccttccacattaaatcatttgtatttatttatagctaactccctttagctctaaacattgagcttttttttttttttctgtattcttgaaatgaacttcaaatcttcctgcagtcagctggcttttcacatttctggttactctgggaaactgaagtgagaaatcagctttggtatatggtatgctgcatatttgattgaatgtaaagattgtttatttggataatgttaacgtgttgtaaagcacttttaactgagcttaattttgttattctgtgtttttctaacataactgtattaaggagaacagcaattttaaacattaatttagcatttgtatcattatgaaaccgtccagtcttggtttgactcttattttccatgcatctttaaaattgaacaaattatcaaaattctaatttatactctattttgatataccattcatatatagcggacagtgtgagattttaaatatttttaaaaggaatcagataatttaggatgaaataaaatttactaatatcaagataatctcacagcatattttaaactcaaattgcgtgtgtttgtaccttctctgcataattgagaaaataagttcaaataagttttttataggtaacctttaaaatttcttcgtctttacaattctgcagtgccaatatgaaaaatttagatatatacatgtttttatcatgtttattgtgtttcttcagcctaagaaatcatgtcactcataaattctagaaaaattcttggtaattatctttgattgccattttctcctccttcctctattttgtttctccagaactctaattttttattgaaactaattgtactacattttgctatcattatgctttgttgaccttgctattattttgattgtatcttctgtctgctttgctgggtgtttgcctcttcttaattcccaatgtgagtggtcccttgtttctttttgcttttctattgacattctattacttggagtgcttaagaactttataaactacgtggagtgagacccaaactttttttctatccctccctttctagttgcttgcatttcctactatcacttcatactaaacaaattatggaagcctcttaccaattcttcttcctccatccttccacaattcctgattttctcatttccgttccctttcagtttgttattcattcaggttgcagtctttagagtcagcatcagtttgctcattcacatttgcttccctgacctactgctactgctgtcaccacaactccattcaatccatgaatgtcttctcttgagtcttagttgaaatcttgtaccttaatttctttctttacatttttattactttaaaccttatctttgtttttctgcatcctttctctttcttgttccagtaatcctagccctgatgccagtaatatgagatgccacttgggctgttttgttaccttcatcatctcatttaatagaatcactgtgagaataaaatgtgttattattaattatgaaagtacttggtaaacttacagattttactgcaaaatatcatttgtttacagagaccttttatatatattatctcggtaacataggttttatatcagtacattgtgtagatggggaagtttgcatagaaggatgtaggcagaactagattattattgtattaacccaaatatttggcataaatttggttttataaaaccattaaggaaaatatgtatattattgttttacatacacaaacaaatgcacacgcacctgcttttcctgacttttgaaatcttctataacctaattctaaatgcctctttttttattttattttattttgttttctggagacagggtcttgctttgtcgcccaggctggggtgcagtggtgctatcacagctcactgcagcctcaacttcccaggctcaagtgatcctcccacctcagcttcctgagtagctgggactacaggcatgcatcaccacgcccagctaatttttgtattttttgtcaagatgggattttgccatgttgtccaagctggtcttggactcctgggctcaagtgatccacctgcctcagccttccaaaatgctggaattacaggcatgacccaccatgtctgacctctgaatgcctctttatcgtttttagagacttaactccatgtaatcaccttcccaaaaatttgtgcttcatgagtctactctggatggtttaggaggaagaggacagtatcccacaaatatgttatgcttttctgtctcttaactatgtcagttctgttatcttcactttgaaagttcattcctttctctctacttttcaaattcccaacccttcttcaaggcccagctttaaatcatttcttttctgtagtcttttctggaaaatttggattacatggtgcttttattcatactcaaaacttctattgcattcattattccattttaaattgttcatcttttgcataaccttttctatcttagtttccaactagattgtaaattccttgtgcaaaatgacttttagttgcacttatttgtgttttcttcagagctctctctttttttttttttttttttttgagacagagtctcgccctgtcgcccagactggagtgcagtggcgcaatctcggctcactgcaagctcggcctcctgggttcacgccattctcctgcctcagcctcccgagtagctgggactacaggcgccgccaccacactctgctcatttttttttttttttaatagagacggggtttcaccgtgttagccaggatgttctcgatctcctgacctcgtgatccacctgcctcggcctctcaaagtgctgggattacaggtgtgagccaccgtgcccggccttctttagagcgctcttaatgccttgtgtaatggggactttaagtggttatattatattggccaagtgacattttcttttagggtaattgatgaaatctcattatttatgatttctacacatatgatcatggaaacgtacgaatgattcagaactaaataactcaactttagttcaaatatttttctaatttatatgtgcaatgacagaatatatgcataaagatcattttgagtttaatacaggtgtactttgcaaaaatgaaattagtatgttgctagaagtcacatatattttagaaactattcaaaggaatagtgtattattttaaaacctttgtaaaatgaaaataatcagtttttgacttttaaattatgttttgtattttgaaattacttgaagtagagacctacatgtaaatgtattgtgatgaagcctttactctgtattgtaatagattaagagcatttgctaacaaaacacagtgtttcttgacagttattttcaaagatgacaataccagttgttaatcaaatgtaagctggtccctagatatattaatgctcattaaatattatagtttagtttttctgttttaaacattgaaataatttattttttcttttaaacaggttgaatcaagggattctttgaatagcatagccctgaagtttgatacaacacctaacgaacttgttcaattaaataagttattctcccgagcagttgttactggacaggtagtatcttttttttaatgtgctgatgtttagaaacattaaacagaaaggcagaaagtatttattgtactgtagttaataatatagaaaatttgagaataattttatatgtgcttttaacaaatcatattggccatgtaagagaaaattaactgttttatgtctgtattagtttcttttttaatacatattgaaaataattgtagatttttctttttaaatatagttacaaagagctttttaaaatattcagaacaatatatgcatatgataaaaaattactttatcaaagtaaggcatccctccatctcaaactttcagtttcttttccagaagcaaccagttggcagtttgcatttctttcaggaataatctagcctacttttgttgttgttgttgtgttttaatttaactttgattcttggaaagtgttgtatttaatcacagttctagttcagactttttcacgcgtgcatggtattacattgtattgatatatcatacttatttaaagcattagactatttctactcttttgctaaggtcaatagtgctgtagtaaacatgcctgtacacatctgtttttctttaaatgtaagtatttctgtagggtgaattcttagaagtaaagttactatatcagaggatatgtgcactttaaattttgctagctattgccaaattgtcctttaggagtgacacctctatagtgtatgacaattaatgtttcctcaccctattccagccgtatatattatcaaatgtgtctaaactgattttaaaggttcttttttaaaaatgtttttatattcttataatttgaaaatttttatgtttttctgtttaattggtaattgttaatagtgcttgcttatagaacaccatctaattattaacacttcattttaactaaatctttgtgtgaatgttttcttacaggttctgtatgttcctgatcctgaatatgtctccagtgttgagagctctccatctctaagccccgtaagtcctctgtcaccaacatcatctgaggctgaatttgataagaccactgtaagtatctctgctttgcaaagatggcgatgaagaaatctcactttgtctacattgactgtcttgttttttacattccattttgactatggttagaatgaaatatttcctttttattttgttgcttaagtttgtaaatcccagctttaaaaataagacattcttatgaaaccatatagcttaaattgacttacctttgtaggtggtggttgtgggccaaaaatattcatcaactcttattttttaaagaacatatataatttaacttacaaaggaatcttacccaaaaaacatgacattatcacagtagaggaagttcatgtccaatttgatgtttatttcatctataaataaatgagtatatagtacttagaactcttgagtttaattttgacacattgccttttaaaaaataatttatcatcttagtcatccaagaattgacatagtagattaatttatctagcatttctaaggaatgagtgttctaataacttacattttacaaatgaacttcagggaactaaacttcatttaataattttgattaaaatcttctgaaaggaattatatattatatatttctttgcctttcatagaataaattacatgatattattaataactatttttctccttgcctgggaacttttttctgcatgtgtgtgtgtttgtgtgtgtgagaaagagagagagaaatgaggcctttttcatttatttgatggatatcttctttatataattatggcaatactatgctttagaatgcagtcacatgaaaggaatatattacatttgttgtcatcattgataagaataaaagtcaggttttaatggtaggtattacttaccaaatgacacaatacctttttgaacatagccatgccattttcccatgggacttacaaagagatgtactcataaggggcaatgacaaagtaactacgtagccttaggttaatttagcctgtgtttcaaaccctaaagcagaatgatgaaaatctaagctgtagcatcatgcctgactagaaacctgtggggtctcttcctgttcctcggctttaacctaaatctgcctgtctactggctttcttggaaggtataagatcaaagaaaacaaaatgttgaaagttaagggagcaacaaggccaggcctcaacctgtgtgaaaatgtaccccttcttacttttgccatttgactgaaagagatggagaggataaagttatgtgaatgatcttttaatcctcagtgacttagctactgtcaaagatggaccaaaaaacttcctgtaatttggccagtgatatgagtaaattctttgtccctgggatagattaaaaaaaaaaaaaagaggtgagagattccttaaagaactaaaagtacacctaccatttgatccagcaatctcactactaggtatctaccccgaggaaaagaagtcattatataaaaaagatacttgcacatgcgtatatagcagcataatttgcaattgcaaaaatagggaaccaccccaaatgcccatcaatcaacaagtggataaggaaaatgtggtatatatataccgtggaatactactcagtcataaaaaggaatgaaagaatggcatttgcagcaacctggatggaattggagactcttattctaagtgaagtaactcaggaatggaaaactaaacatcgcacgtactcacccataagtgggagctaagctatgaggatgcaaaggcataagaatgatatagtggactttggggactcaggcaaaagggtgggagcagggtgagaagtaaaggattacacattgggtacagtgtacactgcttaggtgatgggtgcaccaaaatctcagaaatcaccactaaagaacttactcctgtaaccagacacacctgctccctgaaaacatattgaaatggaaaataattaaaaaaaaaaaaaaaagaggtaagagaagagtttgtaaacttctctttacatggaatgatactctttacctgccatcaaagagattatgggcaatagttagaaataattcttacaacagttgattgtgtaaattttagttgtattttttttacctaggattatattcattaccaggctccaggataatatttctatgactttctgcatatctcaagtgcctatatttctatatttctaattattgggttttatgtctcccatgctgtataaatcccttagaaataaggatattatgttttattagatatagtttacattttcattacactaattaaaataatgtctattagtattgttattatatgtttttcccagaaattgtcagtttatattaccagcaaccactgataaattttttgaatgtccagcttagtagtggtttactatgaagctaaaaatatgttcctggctttgtcggcataaagactttcattggtaataattcgttttcacttaaaaatattgcattttgagaatttccatggaaaactattttttctttatttttcacttttttttgttcacatatggaggaagaaatatagaaggagatagaaccaaagtaatggtaaaaatcataaaaatagctaaaatgtagtattgcaacaggtataattctaagcactttaaaagtattatttatttcttatctcaaatttatgaggtaggcacttggcctgggtttctgtgtttgtccctccagacttactctgtattctctagtgtcctttgggtggtagactgcatcagtgcactctctcttgcccttttgcttctgttggtggttttctttctggagcagttgcagaagataagggggaaggaaagagagaataagatggggacatatttattctcctagctccttccctgtaaggttactccagagtgaccacattcttcagcatctcatcttatcttttgtcagccctttccacagagccatctctaaatttaggtatctgtttctcccccttacctctttagggatagaggagtcttctgttattgttcaccctgggtttttgtacaccatatgtacctttgtaaatagttccataattaaatcctcttaaaattattcagtttctaccgggcatagtggctcacgctggtaatcccagcactttgggaggccgaggcaggcagatcacttgaggtcaggagttcaagattagagcggccaacatggtgaaacccatctttactaaaaatacaaaaattagccgggtgtggtggcgggcacttgtaattccagccactcaggaggctgaggtgggagaatcacgtgaacccaggagtcgggggttgcagtgagccacgccactgcccttcagcctgggttacagagtgagactctgtctcaaaaaaaaaaaaaagctcagtttgatgtgccatctgttttttctagtacctgaccaataagtattgtatccattttatagaggaggaaacagaggaagagaagttaattattttgtgtttaaggtcactcagctagtagctaagctaagattctaacccagatgggcttggttcggagcccatattttttattactactttatagctggaaaatgataactcagaaacactactcttgcccaataaataattggacccaaagagttaagtaatatttaatcattataaaagtcgatatagtaatagctaccatttcgcactatcatcttcctaagattctttaaatctctcattttttgaataaatatagaaacctgcttttgttttgtacacctttggtttttctcctttgtactgtaagttcacccattatgctaatgccattttagggtaaaactgttaatgtgttatattcaggatgaagttcagtggaaaaatgtttaaaataagtaatatgaaaaaacgaaataattttaaagtacttatgtttatattaatatactctattgaagggtgggatatgcagatagtcatattctctttaagataaaacatggtataatactctaatcaatctaaaatatgataaaaatagaatattaataacacttgaattggatacacatgatgataagacaatataattttgaaaaaaaaatacttttaagagattctgaggaaggcctaggaagtcctaaaggaggaaagaggaaaaagtataaaatagcaatagaatgtaggcatattaaatcttcctttttaaggataggctgtgattatactgctacagtagctattgtttttttacttaaagagtgcttactatgtatttactgtgttcatttcagaattttaatctttaacactttaataacattttaattactttagacttttaattaatctttaaccccatgaggtaggtacaataatcatgatctgtatttttaaaaatgaggaaagtaaggcatagagagaagaatgatggttagtaagtggtagaactgagactgaaaacctggcagtcaaggtctagattctgtgttgtgttcttaactactttttgtactgcctaagtaatgaaatgatgactactagcaagtgcaggtactctataactgagacatatgatctaaattaaatatatgtgtcacaatttataggaactaggaagtttgtagtaaagaactgtgtggaagtaatgcatgaaatttttgcttggccaaagcaaaaataaaaatgtagaagatttagaaatgttctttaattacctatattagtttcctagtattatcataacaaagggtgacaaattgggtgggttacaacaaaagaaatttattaccatacagttttggaggctggaagtctgaattcagactattggtacgaccatgctccttttgaaacttgtagaggagaatcatttcttgcctcttctaactggtgtttgccaagtatcattggcattccttatcttgtaaatatatcaccactttctgccttccttgtgacaagtggccatctacttcctgtatgtatgtcttcacatggtggtctcttctttatataaggaaaacagtcagattaagggcccaccctactcatgtatgaccttaccttaaattaataattacatctgaaaaatcctattttcaaataaggtcacattctgagatactggaggttagggctttaacattatcattttgggggagacagtcaaaccataacattgcctcataaaattataattatagagaatttatattatggagctttatttatattctagaattttatattttttgtctttgaaggaaaggggaaatttagaaaactttctaattctagtcaagtaagattttctaagagatgtttagttaattttcttcatttaagatatgttgaagggttaagttaatttctcatagggttttgggaagcttgtgaatatttgtaaaatattgtgaaaacttttttaaaaacgtctcttttttaatcatgatagtcacataattaattggcatcttgaagtggtatgcctgtatacctgaaaatagacattaattacaagtaatagcagacatgcaagaaattaaaacaattttagttaggaatatcaaagtagtttgaaaaggttaaatatcgcctgtgcttcaggaattgctttcacatatgacatcctttaacaattcacaaacataacctctcttttctctctgtgcatatatagaatatatattttttaacttaaaattaaagacactaatatctatcatatacaatattatatgttatatataaaacatgttttatctcttttatagaatatataaatcgtaattttttctaaattatgattttaacttcaatgcttttagacttcaatgttaatataaatatatacaacttatgtgatatataacttatatattaaatgtaagcttatgtattataataaaactataaatatcaataccactcaaatgtgtaaataacacataaatcatatatactacattcatattattacatataatttagctttgatgcttttaaacctattttaaataacaacttagtaaggaattgttttttaatatgtactttttaatagattatactgtaattatacctcggtcttatattcttagaacaaaattttatggttagtatctgaaaaattaaactttataataggacttagtgtttgcgaagattttaggaaacaaatattttatatagaagaaatccctgtatttttaacatcacaagaaatgggtaaattactagatgagagtttttttttttttcctagattccagatggaaacattatttccataattagaattaaaaattgatcccgatattttaattttattattttattctgtatttgattttaaacattcttaagttcttggtcccaggaagtagagattattgaacataatttatagacagtaaatggcaatcatcgtatatattggattgaaagaaaaatacagcatacactgcttcaaaagtaaatgttttctttaaaggatatatagtatatacgttgcatgaagtaaatacaaatgttggtatttctgtgcctgtatggattttcctcctcaatcttcctttgccctacctatgtgttactagagaacatttctacaaattttcaatcgcaaaagaggaaaaatacaataaagccaaggcaagaagggaagtggacagtttggagttgctaattcatttatggtaatggtttataataacatacaaatcatattgtataatatattctacaaaaaaagataactctaggtgattattaaactttttgtaaatcatttgccctagcaatgctttgcttttttacatttgaatatttggggcaataatgaggctagatagatagatatagatgtttatatttctatatttttaaggaccttctctggtggctaaaacaaaattatgcagggaagcatcagcaagccatcaaatgagctgcaaaaccacctcattaataatcacagtttaaaaatagcattcaaaaccatctacatagagatactaatactttgaatagtgtacatttatgtaagttacggtgaggtctggtaattcctctgaacaactttgatcttttttgaaagtaatctccttttttgtgctttgctttgagcatttgctaatctcatattctttttaaaagaattacattgacaaattggtattgctatagatactgagttcagactttcaggtaacctcagagatcatatattgttcaaaaaggcatatcttcatttaaggaaagcatatgacaatgtgcacatatatatacatatatatatatatatatatatacacacacatatatttatatttgtgtgtgactaatgcggttaactcagttttgggggaattgaggaatcacaaaatttgttgatagctttttgccagtttgcaggggaccctcttatagctctgcatcagctatttttttcttagcatatttttgagttgtttggtagaagatttgaaagggaagcgatacaatattacagttaagctcactggtttgtgtgttgataacataggtttgcatcttagctccttactcatttgtcaagttattgaacttggctaagcttaagttcaacaaaaaaaaaccaagaagcgtatatatgtgtgtgtgtgtctatatatatacacacacacacacacacatatatatatacacatatatatataactatacctctagtttgtttttaaaaaatgttttaataccatgttgtttccatttgtttttccttataattctctattttattttgaccattccaaaacattctgagaagctggttcataggcttcactgtaagaatggtcagtagcaccaaaaaagttaagaaacttgtgatctagtggaatgggatttatcaactgtagctcgagatttaaaaggctattccagtgaatgggttctgctgtatgcttaggtactaaggtaagctttccacctttttactgctcccagcacctgatggatattatattatatggtcttatcagagtcagtggtttaattcaggagcatctgagtgtgtgtgcacgtgtgtgtatgtgttgggtgtgggtacaagagatgtagtgttcactgttctccagattattttattttttaaatttatagatatgtgtatctccctattaaaaatcactataaatgtaagtttaacctgtgtttgtgatctttattgaatatgaaaatagtgccacttttgtcctataatttgtacgtaaaaatatttcgggctgacttccagaatgcggtgaaatgaaacaacacttattggggaaagctattcatttgactttttaatagtgtgctcatttttattttgttttctgcttttttttttctttcctttaaaaaaaaaaaaaagaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaaggtaaagaatgacactttagagaagacctttaatcatgctttagttattactaatgtatgatagtttggcatttacattttaagtcatcaatgtcagaaaatgcttgaatattatagaaaggtactagtgatactattattttgggttagtatggatgttgcttataacttagagtctggtgatctgttgtaattgttaaaagtaatggaatataaataaattcactaaggcacagctaagttgctgttggtaggatatttcaaaagtgtgaataaaatgactgctgccaggtactgtgtggagtgtgaacttctgtataactagtatagcacacaaataggaagatatctagtatttattgagtaccttctatatgccagagagtatttgaggtatcttaattattttatcaattcaaaacaatcttgtgaaataggcagtcatatttcttttccacagggaaaaacaaaacaggaagggttcataggaaaggttaataggtccaagatctctctataatggccagaattcaaacctagtcagaatcttttttttttttttttttttttgagatgaagtttcgctcttatcagccaggctggagtgcaatggcgtgatctcggctcactgcaacctctgcctcctgggttcaagcaattctcctgcctgagcctcctgagtagctgggattataggcactcgccaccacatctggctaactttttgtatttttagtagagacagggtttcaccatgttggtcaggctggtcttaaactcctaacctcaggtgatccacttgcctcggcctcccaaagtgctgggattacaggtgtgagccaccgcacccagcccagaatctattttgtctgcttcactttgttgcttttctaagcaaaaacttctaatctgaaaagagaatatagtaaagtaatagagttggaaaataaactccagattttgctcaaaaaatgtctataacatgatactgcctttagaattcacacatgagaactatttctttgaagtataattcataaatttatgagtatttgaaacacataataagcatttagtggtatgcattttgccctaaatattgttttaaatgttgtgttttcattttcatttactttaaaatattttctcttgatttcttctttgacccatttgagagtgttttatttttctagataactgtcttttactaatttctaattcgattctgtgtgatcagagaacacactactatttgaaggctttatttagacctgttttatggtctagaatatcgtatgttttaataaatgtaatgtgtgcactgtaagagacacattatatttgtgttgggtggaatattccacaagtgtcaatcaaatcaaattgagtgatagtgtcctgtatttctgattttctgtctgtcagttgttgatagaagaattttgaactatctcactgttattgtggatttatctgtttttgcctttcagttttatttatctgtttttgccatacattatatatttatatatatatttatatatatatttaatatatataaatatatttttatatatatttgatatataaatatatttatatatatatttgatatataaatatgtttttatatatatttgatatataaatatgtttatatatatttgatatataaatatgtttatatatatttgatatataaatgtttatatatatttgatatataaatatatgtttatatatatttgatatataaatatatgtttatatatatttgatatataaatatatgtttatatatttaatatataaatatatgtttatatatttaatatataaatatatttttatatatttatatatatatttatatattaatatatatatttaatagataaatacatatatatttaatagataaatacatatatatttaatagataaatacatttatatatataatatatatatttaatatataaatacatttatatataatatatatatttaatagataaatatatttatctatttacatatttatatatatttatatatatataaatataaaatatttatatatatttacatgtatattataatatatatctttaatatgtcacattctcactttaagtagcattatatatgccactttacatatagtacacacaccttacaacagtatacttttatttcccccttccagcctttgtgttcttatcgtaacacctcttatttctacatgttataaacacaattcattgttattatttttgctttaaaaagttaatttaaaataatttttaaaataagggtaaagtctattatatttatccacttacttattccctacacttgtcattccttttttatagttgcagatttccatttgtatcatttttccttttatataaggacttctaaatttcttacagtgtaggtcagctagtgataaattctttcagtgtttatttgccttgaaaaagtctgtttttccttattttattaaatgttactatcatgtttatgtatattttcttttttttttttttctccgagacagagtctcactctgttgcccaggctggagtgcggtggcctgatctcagctcactgcaacttccgcctcccaggttcaagcaattctcctgcctcagcctcctgagtagctgggactacaggcacatgccaccacgtctggctaatttttgtatttttttagtagagagggggttttaccatgttggccaggctggtctcgaactgctgacctcgtgatccgcctgcttcagcctcccaaagtgctggggttacaggcgtgagctaccgcacccggcacgtttatgtacattttcaaaattatatgtgtgtttataaaaaaggatccctaacttttaaattttatgccactttatctttttttggtccattgaattttttttaattaatatactttcatttttagagcagttttaaatggacggaagaattgagcagaaattagaattcatatttatactctccccctttccccagtttcccttattaacatcttgcttttgtgtgctatatttgtttcaatcaatgaagcagtattcaggcaccaaggaaagcccataagattctctcttgtacattctgtgggctataacaaatgtatagtgacatttatctatcattacagtattaccagattagtttcattgggctgaaaatcctctatgcaccacctgttcatccctccttccctttctttccctgaactcctgataattaatggtcgtcttactctctctgtagttttgcctttttttagagtgtcatatagttggaatcatagagtatgattgaatgaattcatattggcttctttcacttagcaatgtgtgtttaagattcctccatgtcttttgcggattgacaccttaattctttttactaatattactgaatattccactgagtggatgtactgtagtttatccattccactattaaatgacatcttgatcactcttaagttttggcacttgtaaatgaagctactttaaacattcatgtgcaggttttgtgtggtaagttttcatctcaggtaaaatatcaagaatcatgattactggatggtatggtaagaccattgttagcttagtaagaaactgaagaactctcctccaaaggacctgtgctattttgtatccaataagcaatgggaatccctattccacagcctcaccagcatttgatgttttcagtgttttagacttcagccgttctaatagatccgtagtggtaatatctcactgtgttaattagaaattctctaatggcatattatattaagcgtcttttttttttcctattcagaaatgacaaattctttaaatcgacaaactcatcttcctcaagccccagaccatggtaggcagccctccctctccgtcccctcaccccaccccttagccacagtgaagggaatggaaaatgagaagccatgagggcctctgccagggaaggctgccccagatgtgtggtgagcacagtcagtgcagctgtggctggggcagcagctgccacaggctcctccctataaattaagttcctgcagccacagctgtgggagaagcatacttgtagaagcaaggccagtccagcatcagaaggcagaggcagcatcactgactcccagccatggaatgaacggagggcacagagctcagagacagaacaggccagggggaaaaaggagagacagaacaggccagggcatggcggtgagggactgaggcccctaaattttgatcccaggggaaaagaagaggccagttggtccagttttgatgggtatggggaagggaatgtattagtaagcacgggggagaggctgccaacaggcacctcagaggtgataggacaggctgaacccctcaccctgacagaagggagcttaagagctctggggctctctgggaatgtcactgctaaaatatatatctacatgtatattaaccactcgtgggagggcaggggcaaggcctggggtgggatcaaaggatctggtgtggcatccagtagccagtcatgcctgcctgagatgccccccatctgtagcccgatcacgttcttgccctcttgcagctggttatccgagaagttccgaggattctccttggatttcttagggaaccagttgggatccccagagaagagcccatcatcccaggctactgccaacccacccagattcctcagcgtccgctgcacacaggccatgttctttccttcccagaggtccacagtttggaagatgtcagtggtgttaatgccatagcgctcagctgcttgcaggaactgagagatcttctccatctgcttgaaggccatggtggaggcctggatcttctttactgggacctgccccttggggtacagtgcattattgagctcacataacaccgtgccatccttgagccagttctggaagttctcgcgtccaggctgggaccggcccacatcctttcggcactgggtggtgatccactggatcaggatctgctccagatctgcatcatactgtttctcaatcttctgctgcacctcctggctcaggccataatgcaggtcccctgttggccattccaatgggtggcggtggctgcggggagcgttcaaacgggctggagagcggcacactcactcaaggcaatggctgcagctgccgagcttcttcttacatgcttattttctacccagatatcctcttcattttcaaaggatattttcactagacagaattttcagttgatgaggttttatttcttttcagaactttaaaaatttactccattgttttctggcttgtgtttttctaaagtgaagtcttgcattatttttatgtttggtgttctgttaaaaaatgtgtctatctttggttgcacttaagatgttctatttatcactgattttgagcaattttattaggatgtgccctggtatatttttttctatttgttttgctgggggttcctttagcttggttctgtaggtttatagttcatgccaaatttggaaaatatttgaccagatttcttccaatattttttgcctcccatcctctctttcctcttctttgggaactccaattctgcatattttaggctacttaacattgggtctcacagctccctcatactccattcacttttttccttctcttttcattttggataattttaattgcttgtttttaaattcaccaattttttttctgccatggctaatctactcttaatcctatccagcatatttcatctcacacattgcaatttttctccctgtaagttcatactgggtcccttatattttccatatccatactgtgtataatcttctatattgttgaatatggttataataattgttttaacgtctttttttttgtactctgttacttctgggtctgtttgcgtttattgatttttctctttaatgtggttcatttttttctgtttatttacatgcctggtaatttttgattggctaccagacatcatgaattttatgtaattggatactgaatatttttgtattcctacatatattcttgcactttttatctgggacacagttatttcttgatcctattgtggcttttatttctttgatgatcacttggtaatggcttgttcataagttttgttaggaccagaatagcctttagtgtgtagctaatttttctccttactaagacaataatacacttgtaagtattctgaggctttgtaaatacaagatttttttttgctttaatgtttagtgagaacacgaactattcttactgtgtgggcgctgactattgattcttctgctcctttcaagtactctcttcttatcgttggatagctgcgatacatgtaggtggtaatcagtactcagttcaaagctggaagggaaccctttgtagacctctaaagctttctcactggacagtgctcatttctgggttgtttgtttgttttgcttgttttttctctgcctgtggactggaaactttctccactcagtatgcttcggtaatcaaagagctgatcttatgtgtttctccttattcaggtatcattgcctagcattccggtgtctgaaaatattatgtcacatattttgttcgtgtaagtttggtgtgtgtatgcatgtgtgtgtttattgtagttttaggcagcattagttcttgactagaagcagaagttcatttgatatctgaataaaaattttatttaaagatcaaagcaaagataaggtcattggcaggattaggaatgatctgcagcctagtgtttttggaacgtaatcccttgttataggctggctctgtgcattctgctgcacaaaaggagataagcaggaagtggtgctttctcatggaagtcgttttttcttttttcatcttcctacaagttgattatacaaaagattatttatgtaacaattatggaaacttattaacaataactataatggctaagttattgtggatgtaagactgaaaaaatatcagtacaagcttttctctttgctaggatggattcccaattataatgattttatctcttagtatttgcagaaatattgtaatgtaagtggtaatttttcttttgcagatagactttattttttttactttattttctaatagaaataatttctctttagaagattagtcaggtaattgcacgtaaggaaatggaagttgttaatacaaaagaataatctgtgcttaaagtttctgaagttcatgtggattaagtagatactttaattgaaaacgtcttgctcataatagtcttaatataatcctgataatatgtaggagttatgaaatattttaaaaataatgagatgggagtgctttggtataagcttatgattttcaacttgatcaaatgaatttgagaatttactttttcaagacattttcatgaattttatgttgaagaaatgtttctcttggcaaactcttgatttatggagaatgatgtctaacagattaccgcagaaagccccagctgtatgggaactttgagtgtgtagcagagggaaagaaacttaaagaatatatcagtgtgtctttttagtaatagcacataagggagattcctggaaagtaacattagcagattgatcagtctagtgggtaggacttcaaactctttctaatccaaaaagtagactcatggttttgagatgcttttcaaatgatttgtatagttacagtactaggattaaggtattaaggtatatagagaattaaaagcattatcagtatactgaggcttttctgtcatacatagctagttatcactgtctttgtgaaaatcttcctaaaagataaaatgtagtattatgctagtgaaccaaataattggttaaaactaatgcaaaagtgaaatttatgaaatggagagtaacctgaagtgtttcagagaatttagagcttgattttttttttatttctagttgattgcttggtttcctttctcaaataagtttacagaagatgggagagagaaagttatgaaagatcagaaacctttaaagttgtttttttttaatatcaaatatactctatccttgattatctacatcttggattatcctagacaatgtaaatgttctctacaatgtactttaccatctctcattgacttgagttggtatgtgacccaggaatacaaactgatgtgtatggatctcattaaaatattaattgaaagagaaataggctgtagtttatataaagttactccttatttaggtggtccacgtcctcaactaaaagaggtgctattcagagtttcatatggattccctctccctcaccaaactgcacacacacatatactcttctctccaatattgtgtgcattaactgtatgtgatcttgaacatccgcagtaactttttttcacttgtgattggatgaccattttctgtagatttactttttattttatcatttttaaaagcaatatctgccataacttaatttttatattcttaaagttgaaccaggtgaattcacagagctgaatatggacttgggaggaggatgtgatgccaaatcaatcaggatttgagtttttctttttctttggataagaagctatttagtttatttttaaaattctttctggctcttcatttttacagttacaggatatatagtggactgaaaatttgaaaatgaaattaaggaatgttgcacccttggagtgattatggattgtgacttggatacagaggaattatatatagcataaagcatgaactagctggacttcaaatcctagctgtttaggacaagtttccaggtgtttctcaccattagtttctctatcagtaaaatggaaatggttttacccatctcagagctatgattgtgaagatcaaataagcaatatgcatataaagcatggtacatataaagtattcaataaatattcatgttagtatgatcagctgcctgtggaccctagtttgctcatttataaagtaagaaggttaaacttttaagatttgtatcactatttatttatttatttgttttatttttttgagatggagtctcactctgttgcccaggctggagtgcagtggtgtgatttcagctcactgcaacctctgcctcatgggttcaagcgatttgcatgcctaagcctcccaagtagctgggattacaggcacatgccaccaggcccagctagtttgtgtttttcagtagagatggggtttcaccatgttggccaggaactcctggcctcaagtgatccacccactttggcctcccaaagtgctgggattacaggcgtaagccaccgtgcctgccctgtatcactatttatataaatatatttaaaattttatagcttttcatggtgagttaaaagtatatatacactatatactttagatgtcatataatctacttaattttacagatgaagaaataagcccagagactccttgcccaaggtcacaaatctaggtagtagtagagtcaagtggaaacagattttttaaagagatgttttaaagatattatactcttttccttttataatattatcaacattatttattgagtctgcactgtatacatgacactgtatttggtacttgtagtgagggaataacacaggaagcagtatgcaaattaacataaaaggtggcgcttcttaccttactgaagttacctttctgatatgaggtaactcagtattttactcagtttgcacattttatttccttacttgattgtctttggggaaatatgatattctacctctcctaaagaggagaatttactgggaaaacttgggttttaataaaaatggtttcatgagaatgccacagttcctgagtgtactatttttatatatggcctaacatcagaagaaaattagtaaaaatagctagataatttttgaagtatcaaccttgaggattaaatgttactttcttttttcaccttagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttatattcctttgcaactttattgtatctagatagttgacccttgtctaataccttaactatttttactagttttcttatagctgccttttattttgtcaataatgaaacgaaaatatatgcattattgagaagattattcttaatttgcacctgggatagttatgaattatcttagatttgtatttgtgtatgtggtcagagaaccagatatttgaaaagtaacctatagtgcccatttaattcagtgtttaccagcctttttattcagacacagcttccagtcttctaaattacccctgtgagcaatcactgttgggataattttcaaatttcccttggaagtgactgaagagctgtgatttgagagaggccacatgagcaaagagctgacattgctgtgggcaagacagcttttttttttttaattgattgatttatatgtttgcaatcttctctcccagtataaaatacagtgtaaagtacagggaagaaaacccacaacttgctcaaatataaagagttaactttggaatatactggtcagaggatttgtgtgatatgttaagatagctgtgagactacagtttggacacagcttttgaaagtaatatgcttgtccaaagtaatggccagaaagaaaaggaggaatgggaaataaaaggagaaaaagataaaagataggtataaaaagaaaggaaggagaagtagcaaggaaggaaattgatatgtactaggaaataacctcctcattccttcatacatgactaccaacattttaaaattgtcttcactttaactgatactgatatttatatccctgtattagcccacaggaatgatagctgttttaaaattaacccttgtggggcagagcaacttacaaaggaaaaaagggacaaattatttttgtttctgaggaagactaaatgaattggtagaatatctgtgacagaataaaatcctttgctcaaaagtctccactgtaccttccacccaacagatattattttgacttggtagactaatctttagagctgcagataattcctagaaggtgttagtatcctctgtattagttatatttgtagatcatcatccaaggccagtttcagcaaataaggattattgggaggtggataatgggatgagacaaaggtaaaagagtgaaggattacattcaaagaagaggaaggatatatacatatatggagagagagagagagagagtcattggtgagattctgttgtcctccttttctttctttttctttttctttctttcttcttctttttttttttttttttttttttttttttttgagatggagtctcgctctatcacccaggctggaatgcaatagcacgatctgcaacatccacctcctgggttcaagcggttctcctgccttagccttccgagtagctgagaatacagacacctgccaccacatctggctaatttttgtatttttagtagagacggggtttcatcatgttggccaggttggtctcgaacccctgacctcaagtgatacactggcgtaggcctgccaaagtgctgagattataggtgtgagccacgatgcctggctttgtccttttccatttgcaatatggtactttggggttctcttattctgaacaatccatcactgttctacaaggatgctgtatagctcttccctttcaaatcactgttttgtcattcattgtcagctggaaagtgtcacctggatttaaatatttaaagatatttcttcagaaagaaatatctttaaattctgccttatggattgattaaaaacaatatttggcacaaaattagataaataaaacaaatgtatgccaaaaatgaggtataagatttgattgcttttcttctgtcttatgctccttgggaggttgatttcaaaggtattattatggtattacattcaacagtagtaacatcattgacataaatgtttagcctttcagcatattaaatctgaagagtatagcacttttctaaatatatatcctgtcacgtttgttatgtttatctcttacctaagggtcttctaattctttaaatgtacagataaaatttctcaaaacttttgcccggttccaacaccctatagatgcagtatgagtgcatcaccagtagatgacactattgtatatttaataacaaactagattcttgtttttttaagatgaatcagatacaaaggcagcagagatattgacttcaactaattaatacttcaaaaatttatccatcctagttatagaaattatgcatacttgttgcagaaaaattggaaaatactgaaaagcggaacaagacaaagagttacccagcttcaccattcagagatagccaattatttttgtgttgacttactttacaatctttccttttcagcatattttacatggttctcaaactatgtatgtataaatgttaatgcttttttcattaagaactcatataattttcatttatcacagacttcttgtaaccatcattttaaattagcaacttacatttcatggtatagaggtttacactccctctttccagaacttaacttttgaacattagtgtttacatatacaaatgtcattaaatctgaaagtctagacccagttatgaaccattcatttgtctagtatctaaacttttcacctgaacaagttctcttagaggtattaaagagtatagttgttagcctgaagattttctctatatacttttgcttgagttttattcagattggttttaagccttacatttgagccatatattttaatttaagctctatttgaatgtaaataagcactgtgtgtgtgtgtatatctatggaaatcagtttatttttactttattgggagatttaaaattttaattaaacatttctctgtgtttattttccatattccatcagtgagtaaattttagtttagaattacagctttacccagggtttatgtcatcaagttcccttcaagtggattacttgcaaggaaatcttactttgatatttcctaaatattaagcaattgatataaaagtttgacttaattacttgatttatagaattacttggtctataaggttaattatttggtcatattgaataaatcagattttttatattctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagtaagtgttatagagtaaatgaagttagttcatccaattgtatggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccattaaaaatgtcttttttcatatataacattttaattgccaaagttgtaatcccatcttttataaaatgtacagttaaacctaaaagtgtacttacagaattcttccacgtatcgagaagtttcatcatcatcatctaattattttcttttaaaaacctgccctcaggacaaataaaaacactattttatctgtcagttttctggtactgtttacttctgaaaattacactattttcagtcttttatttctaatatactgtgcttctgttaataaattatgggttaaatggggtataacaactaacttagctaacatttctgatattctattagaatgtttatcccagactagtccattcacatgtgaacttttctttcattttttaaattcaaagatttttgttttgctgtaatacataaaataaaatttaccatttaactttttaaaattatggtaaaatgtaacgtaaatatattatttgaagcatttttatatctacaatgcagtggcattagtacattcacattgttatgcagatcatcactactgtccatttccagagcttttttcatcttctaaaactgaaactctgtaccccttaaacaataagttggccaggcatggtggctcactcctgtaatcctatcactttgggaggctgaggcaggcagattgcttgaacctaggagttggagaacagcttgggcaccatggcaaaaccctgtttctacaaaaaaaaattacaaaaattcgtcagacatggtgatggtgcacacctgtaggcccaactactcgggagactaagatgggagaattgattgaacccaggaggtcgaggctgctatgagccatgatcatgccactgcactccagcctgagcaacagagcaagatgctgtctcaaacaaaaaaataaaaaacaaaaaccagtaacttgcttttctcccttcctcatagcttttggcaaccaacattctactttgtttctgaatttaactactctagatacttcatgtgagtggagtcatacaatatttatccattgatgtttggcttatttcacttgacataatgccttcaaagttcatttattctgtaatatgtgtcagaatttcctatctttttaaggctgaataatattccattgtatgtgtgtacattttgtctgttcatttgttgctggacattttggttgtttcaaccttttggctattgtgaataatgctgctttgaacattagtgtacaaatatctgtttgaatccctcctttgagttttttttgggtatattcccagagtggaattctggatcatgtggtaactctatgtttaatttcttgaggaacctccgtactgttttccatagtggctgcaccattttaccttccctgcggcagtacacaagatttgggtcagtttttaaaataccgaattttcttttcatcatgcagttgagatatcctgaagacctaagggctgtgttcagtagatattaaaataattcatatattaatacttgaaccaagttctataaaagatttaatatttttcttctgtaatatttttttaattcaaaactaatgcatgttcagtaaagaacatttggcaaacataggaagattctagaaaatttataaaaatcttctggaattcatcacccagagatgatcattgttaacattcaatatatctgtctttcttatagaacaaaatcatatgtgttaatttgttatttacatcaaatcaagattatactatactgttgtatcctgcttttttatgtcatgaaccttttcctatgtgattacagttctttgaaaacatggctttaaaggccctaaaatttatttaaccatttgcttattaagacatccagttgttattaacgatctgtattgttaagacattttaaagaatgctgcccagcattcttcaaaacatcaaagacagaaaatgcatctgatagttatcttatattttgaagatctttgactgcatctttgactacatctgatagttaccttatattataaaacctttgaaaaagataaaataatctgtttaagctgatgatgtggtggaccaattttgttgtgggggttgggggtttaatggggttaggggaggttattataaccaaatattaaaaggacaaaaattgatagatgtttttaaacagtcatctctaaactgttaccatttggtttcttctttttttggaataattagttttaagtaattttaagttacttaatattctgtaatagagaaatattcaaactttctgatctttatgactttataataaaattatgtaataaatataaaagtgtctagtccaattatgagaagaatggtgaaagctcatcgttttaaccacatgaaaatagtggggttcccatagattatctaccttgtgtaatactgcacagaaaaagccatgatgagtacccaggtctcctgactataagtgctatttcctccagtgtgctgccttggtaagctaatcaatgtctgggttcctaaattcacctatatattcagaccctcagtatactctatcagcacctctggttgaaagagttagaactaattcgttcttaattaactgtccaaacaggtggcagaatctaacatattattgactgttttattacaattttgtatacatgtaaaagcattagaaacttcattaaatttttgtctgaaacaaccatgttaagtatacctttaaaacttctacagttatttagatgtcattcaaaaagactgatagagaatatgtagaaaattatatatatattatgtgtgtgtatatatatatgattgctttagtatgggtgttgaaaatgtaacaatgtttctgaaacttttactttttttcttaatgtccttagacataatttttattcattaacttggctcttttgttaagtttagtcatgttgtatctgtgactttacctttgaaggaaaaaaaatataaattaagaaaatgtactttagcaccactaaagtgaggttttattctgtaactatttgtcagaattttgaaggtaaagttaactaaactacctaaacttggtgtgtgagaattgaataaacactgtttgcatctcaattctaggttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggtaaaaaacccatacgacaccttgagagcattattgagattctttgaactaaaattattttgtgtgtcaaaataccaatgataaactattgaaacatagtttatgattaaaagcagacaataagtctatttgaaaccattttgcccctactttataatttgccccatttttaattgcattcccttttgtagtttattatttaaaaatgtgaacaaatatccaatttgggtagtaaagagacttaagataccttggagcaagaagattcatcaaaatattatttgatatagctccttcctgaaggcagctaatggtgtataattcctttatattaaaaattcttcaaatattcattaaatatcttctatatacgtgacactaaattagctactaaaaggatgtagtggtcttcacaatatttgtgtgtaccctttgcacaattagatttttcatcataagttttaagcggttgtaaaagatgtctattgtactatcttgtcaatttttacattttaagtaaatagtgttacttatacccagtagaactgaaacattataacaactttccctgtactattattcacttaaaattactttaacagttagacattgcatcattactttttctctttaaacttctatttccataataccacctcacacaaactcattacaacgtactatatttttatccccattatagttctttgcaacaaactacatatacttaacacatttacatatctgtgtgtgtatattgaaattgcatttattttaacattttctgtgacttttgtaaaaacagtaaagggtttaaggttttaggctacctgcaagccaacaacttagtctgcctccatttggtgcatgctgggagaaagcacaaacatctgtacaacagcagtaatcagaacatcagcaattgtgtgatttctctgtacctcctttcctacaaaggatgtgaaaaaggccaagtgacagctgcacatacctggggttattttacagaagaggaaccataagtttagggaacctgaatttttataacagacagtaagcatggttaccctttgctagacagtaagatactatctctacttctaagataatgctacactaacatacttgaaaagatactgctgagcaaaggtattacacataaaaagtaaaatatcataggaaatgcctgtcttaaggagatagatagacctttcctatatccattgatagattaatatgtttcattgaaaggatgagataggactcagcatcagttctgcctctcccttttatttttctttataagtactgagaagctttgttcatagaaaagtcagtgagactgaagagagtttcattttaataatgtcattcaattatttaaacttgtttctatataattccaaaaattaatcatttttgtcacaatatttttagtgatcatcagtggacaactccattgaaaactccttcagttttgcggaaatcaattaatgagaaacaacctgacatacagaaggacttattacccagtctttataatcatttcctgtctcaacaccaatcttgggcagcctaaaagtttttatactgtagggcatatcccattgtaaattctgagtaggtgaagatatgcccttcttttataaattagaaaaagtgctttagtgaaagcagataacaggaaatctgtaaaatatcttgaccatactgtttttaggcagattattatgagcaaagagtaacatatggaaattggagatacgcgaattgattcccttagcaccatcttacacgtttgtgtacctcttggaaaatctttatatgttgctttggaagactacagcttttaggcataaaatgataatgctcttttcccttttcccactccaccatatatagagtaagtacaatgtgtgtcttccacaacattggcttaatcttaaaatatgatttgcataattgatgaatacctgaaagggacagagcctgatattcaaacgttccagtgatgttgaaatcactacaatgagaaatgtaactatatttagttaaaatggacataaaaatttagtttttctcattattcttggttttaatgtttacatggaattccctattttaatattcattcttttatcttggttaatattcattacaaattagtattattaggattctgatctttattgtagacataaaacttaggaaaactgctgcatagatagtgagaaattgataaaaaggtaagatgttacattgaaagataaaatgtagcaccttttaaatatgttagctgccacgtaaagaatggcaattttaaaaatcattatattgaaaatataatttctagaaccatggttattaactggtatatgttagctgaaagttatataatcaattttcaaaaacatgttaattaaaaccaataaaacgtagatatttgaaatgtgtgtgtgactctcaaatacatttatcagggaatgtaacaactggctttagtgtagtaaacaaaacattgaaaaggggaacctgagatttctaagattagatcatctgtctctcaacactgtatgttcctagtatcatttaaaatttaaggacattacatttctattaacttggaaaattgtatataatgtctcaaaataggccattaataaattgtttacttgtattttagatcattagattattgtaggaatgaggtcaaagttgtgtatctaatttccttttccatcactagtgtctttaaagaagaaaagctttataatatacaacatctgaactagtcaaacacatgccaaggaaaatcttaatttggttttctaaagaacaacctgacagaatatagccaaataaaatgtttaagttaatgccttcctgatagtagaccttttatattaatataaaacaatatattttgtgtatattttaagtcttcaagatttatcaagatattttacaaatataattttttaattctggcagcacagaatactaggtatattaatagtcacttctcctaacaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtaaggagaaaaatatgaagattttagtcatctttttagtttgtatgaatttatagctttatggtagtacaaagtataagtgatgtttccacaaaagaggaatttttttaaaggtcaggttcactatccgtgtttatttgtggttattgaatgaatctgaatagtgactttaatactatatttgtcattctgcttttgctttaaaatactagaaaacccactagcaataaaatgacttttattgagtgtcttatagaatatttagtttaggaaagattaacattatggcaaagaaggaaataattttaattttgctgttatattaattttcataaaacatcgatttcacatctgatttgttttaatttcatctcctccatggaggaggtacggcagtcatttaacacatctgtgcatagtatttgcatagcatctatacaaattactactcctttctatgtttcagacctaagcattatcttgacttaaatttttcaataataattttaaggaaataagcaggtgctaattttataaagtagtagaaattttatatgctcagatttactgaacttgtttaaatggtcaaagttatactaacaaactttttgtaactcctcttagatatatcttaagattacatattaccttttacatgctttgtcttataaggttggtagggtggcaatatctgttggtgttgcctagattagtctcttcttgatgcattagaaaatgtagagcagatgctaaaatgttataataaatgtaatcaaatttttttattcattgggtgttaatgtttgtggctgttaatgtgatatgaatgtatcttgcatgcacttaacatgtatagtaattgaaggtatacatggcttgtcttttgtttaaaatgcaaactgatttggaatgtgtctaatgtcattctgtgtagtatatacagcatcagtttctactgtgactccaatataagggagggaaagaagaacatatcgaccatgtattttgggttattttaatacttaaaccaacattatcaatcttcataccagctttattcataatggccccaaattggaaagtctcattagcaggagaatggatgaatacatttttgaatacttacagaattccaaataacaataaaaaagatctactggtacaggcaatgacatggatgaattttacaaataatatgttgagtaaaagaagcctgacacaaatgaacatatactatgtaatttcatttacacgaagttcaaaagggcaaaactagtcagaaatccatcacactacttgatactgggctgtgacagggtggctcagggacaggagggaactttattgcgttctggggatgttctatatgttactctcagtggtggttacttgggtgattacatatgtaaaatatatataatatatataatacgtatataatatatatatgtatcttatatatatatatattatatacatctatgtccctgagctgtgtttttaagattagctttagaaggtacttaaaatagcccaggtgatcaaagatacgtacctaactaaggcagcaacagttgaaggtagagtggaaggtgatgaaataaagctagaagaaaaggtattagctagctaattacacaggattcagtgacaacctggtaaccataaagttatctccagcttgggtggcacggtggatggcagaattgtcagtcatgaacgggaattgagagctttctctccattggggttggagtacttaactttggaaataagagactattgactattttgattcaaaggaactgtctcagtttctgtgcaagactctgcagggtataatttctaaaggaaaaataaatctcctcaccagtcctttgaccggaattggtgcagttcaaaagaaaatggaagagaaaaaaataattttggaaactccttgctacattgtctgaaaatattaccgcagtatccagtatagcagcactagccatatgtggctattgagtacttgaaattcatgtaatgccactaagggactgcatttttagttttaattattaattaaaaaccgatacttggttccattattggacaatttttaaatatattaggaataacttagatatatgatctactttttcaactgtaaatttcatgaaatctaaatatgatctaaatcagtctaaatctaattaaggtcaagtatttcctatgaaaatttagtgcctgaattgagatgtgctgtagtgtaaaatattctacttcctatagccactagccacatgtaaccattgagcatttaaaatgtggccaatctcaattgaaatgagctgtagtataaaatacacactggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaatacacactggattttaatgacttagaatggaaagaaaaaagaatgtaaacatcttgtttgtttatactgattaatattgaagtgataatattttgaatacattaggttaaataaactatattaatacaattaatttcacttttttaatgtggtgtctagaaaatttacaattgtaatgtatcttacattatattgctcttgtgcagtgcaggtctatgcctcatggatactaagtgcctaaaaaaatgtttgttaaactagggaggccgagggtaacaaataaaaaatgttaaactagggtggatcacgaggtcaggagtttgagaccagcctggccaatatggtaaaaccctgtctctactaaaaatacaaaaattagctggacgtggtagcacacgcctgtagtcccagttgctcgggaggctgaggcaggagaatcacttgaacctgggaggcggagattgcagtgagccaagatcacaccactgcactccagcctgggcaacagagtgagactccatctcaaaaaaaataaataaataaaataaaaatgtttgttaaactaatgagtactcatttaagtgaaagagtaattttaaatgttaacatgatttattttaaaacaggaagaatttggctaaagcccttatataaaacagtagtacttcagaatgtgccgtgatgttttttatttttttgttctacaaaggaatggagaataggtgtcctagaatttaggatgaacttgttatggctaccaacttgggcatcagttagatttaaactaacacctctactcactgttattctgctttagtgatacttaaaaaagatctttattatccctgactgttactcaagcagaaatatattgctagccagaaatgtatacattgactggggaagtttgtatatgataaatttggtaaacttattgtttgcttttttctccctttccctatgtaagtgtcataaggcagggatttgtcaatttcatacactattatatcttcagaactaagaattgtataggcatatagttcattctcaatatttattaatggataaacttgggcgtagattaaaattaaggtataaagcttctaatctttcaagattgctctatttcctgaaataagttcttacatcagttgtagtaaatattttcataaagccatagattctggacattttaactaatagtccacagtctgtcatttacatttttttttgttctgtttaaacatattcagtgaaagggaatttgttacctcaaagggcaatactttacattttaggacagctctgttagaaagttatttgttacaataagcttaaggaaacatatctttgtaaattggattcatttatctttattctgtcttccaatgcaagtcaataacaacaagaaacattttctatttactgcgatagtgtgaaaatgtttgtcttcccttttaatcttgtttcagaattattttttccagtacttcaactgtttaactttatgaactctattcagatcttattcatatcagtaccctaaaatatgttaaaagagttcataaactatggcaccccaaattactaaaatgtacacttgggatagcaggaaaaattccgtaatatttttaaaaattttaatttccaaatatgaacattgaagaccagtcctattgaagacagacagaaacatatatttactaagaaaaagaaaatttagccaaattttaaggtggtcaggagtaaaagttcctaatgataaatcagttcctaagtatttggataaaggatctgagaaatactattcttactgctcacgatgtgtaaaggactgaatttcctctttttgtagtgttactttgtatgccacatgataaagagtactttggtgtgggtcgggcgtggtggctcacgcctgtaatcccagcactttgggaggccgagacaggtggatcacgaggtcaggagatcgagaccatcctggctaacatggtgaaaccccgtctctactaaaaatacaaaaaattagccgggcgtggtggcgggcgcttcttgttgtagctactcgggaggctgaggcaggagaatggcgtgaacctgggaggtggagcgtgcagtgagccaagatcatgccactgcactgcagcctgggcgacagagcgagactccacctcaaaaaaaaaaaaaaggagctatgcctgaattaattgcgtcaacatggctgctattgataagaaagcatgtttttaaacaatcaaggcacaaaatgattaaggaaacctttcttcatagtgaaccaaacttatgtttttggtgtgatacccaaataaaagaaatatgcattatgagtcttgcttttggggatctgataaccttatttgataactgagaaggaactacttattacagtctttcccctgatttctgccggtattcaacacaggaagtcaataagtatatccagtgttgtgaggatactgtttgatgtggggctttgcagttctgtgataaatattactttctgttttttgatacagattttttatgccttttcactgaaaagggaagtgctctaatggcattttaacaaattgtcaggcaagtcctgaggtgaagatgaggcagaatgcctattgacatctgctatttcgtgatgatcgcacttttgttcaataaatatacaaaaataaaagattaatagtaaaacaaattcacatgtgccattcagcttcatcagcttatttcttctgtgtccctccttttctccaattgttcatagttattcaaatgtcataaaaatatttagaatacatgtaatatgtacagtatgtatttttacaatttgttttttgagtcatgatccaactaagttctcaaatgctgcagttagttaaaatatctcttaagtctctctaaatgtaggttcctcctccattgctttgctttgcttttttatttcagtttttaagaaatcagattttttttctgtagaatgtcacacagtctggaatatgctgtttgcatccccatagtgtctgttaacatgttattctaccacttgaatgattgatagatctagagcaatacacttaagtatagattatcatctttattttacagataatttctttgtatttttttatttattttattttttttgagatggagtctccgtctgtcgctcaggctggagtgcagtggcgtcatcttggctcactgcaagctccgcctcctggattcacgccattctcctgcctcagcttcccgagcagctgggactacaggcgcccgccaccacgcccggctaatttttttgtatttttagtagagacggagtttcatcgtgttagctaggatggtctcaatctcctgccctcatgatccgcctgccttggcctcccaaagtgctgggattacaggcgtgagccaccgtgtctggcccagataatttctttaagctggttttttatttggctaaaattctcttagtggttaatctctaattcagagcctataccttttccaccataccaagtactcaactttggcggaacctttgcatcatgatggggagctttcaaacatatcattgccaaggtcacaaatcagaccaattaaatcagaataattggggctaggacctagttatcagtgttgtttaaagctacctaggtagttacattgtgcagtcaaggtgcgaaaactagtataccaccatgccacaacttcaggtgttgtgttaaacatatacaatattaagactgtggaagactctttagactatattgattataatatagatcagcttttgagttcctgtcatgcaagttatatgaaatacttttcatattcctttcatctgggctgctgcatcaaaaacataaatttggttcactatggaaaaaggtttgtttaatcattttgtgccttgatttttaagaaaacatattttctcctcagtaacagccatgcagatacaattgatgttgtcatagctcccttacataccacaggacttccatcatgttgtgtactcagagatactacaaggagaggaagatcaaaaaacataccaggctgtaagtcaatgatctttgaactttgtcttcttcaactttgtccatcaaataccctttaaaatttaatatatttggcaagtgcctgaggatccagtagtatagcttaaaggagtgaccaccacaataagctcagattcatgtaaaacttttcattcagctttataatttatttgttgtaatataaagatgaatttggaatttcttatcatgaagtcaaaatggtaatactgtaagttgaatcgcttttatcctgccatcatttatcatgagacattacatgctggacaatatcagcatccaccccaagtaccaacttcaagaggctgtatactagaattttctgaaagtcaaggattcattgtgtcacatgttcagtatgccagtcttgctgcttgaccacacaggcctcaaaggtggagctttttatgctaacattgctttttggttcctttcctttggattgacttttccagtccttttgggataaaagctggcagagaaagctttccaaaatttttcatctctaattttataccacatgtacttcagtatctttcatactacaaacctaattaaagtatccagttctcctaggatgataaataaaaacagctaagaaactggttttattaaatcaactttacttgatttatttagtctcccacacatttacttgattaaattttaagaacgaatttactaagattatgtgttgatagggtgtgtaacagtatttttcattcttaaaatgattcgtatttgaataaaattgctctggcttccctcttgcttctcacctttgccaaaatactgataaaaagacattctgtacagttttggggttttgaaacaacctgtatctttttaggtacatgacattagtcacattttctcaataattgaagtttagattatttaagtataaatgtaaatatgttaactacttactatataaacctctatactattattcaaaatatgttagaatctgcctttcagcttagtttttaaaataatttatagtctttccattttgactttagtatttagtgctgtcccttttagttatataagtgtaaaatatgtaacccgttcttagcattgtaggccataacatttatcacattatgtcattgttggatttggtttttcactactatgtggtgattgccttgtggagccagttctgttttcacagctatcattaagtagagttatggtcaggatcattcattaggtttcccagaaaacttctacaaccgtggttattgctgcaacttttaagaaacaccttatcaggagacttcccttgtttggttaatatcttatttcctaagctgacaggcagtgagtattctggtgatcattttattaaacatatgttttctattattattaaggtacaagtaacaccaaaattaaaactgagttaatatgttaaacgcacaaaaccctcatgatctcttctcagtctagccagcaaaatccacatagaattaattttgtccaaaagtgaaggaattctttgtgtataaagtcactacattgagaaatcacatttctcagataaagggaatttttttaagtattctttttttttaatactgatcgaataatcaaataatattacaaattataactccagaagaaatttaataaatctaaaaaagaaatcagaaggattaaacacttaattagaatttattagttgataggtactgactttcataatacggtcatgcagcacataatgacattttggttggtcccctgagattataatggagctgtctcttagtgatgtcataacatcatagtacaatgcattaccctctctatgtttagatatattttgatacacaaatccttatcactgtgttacagtcacctatagtattcagtacagtaacgtgctatatggtatgacctagaagtaataggccataccgtataacctggttatatggtaggctattccatttaggtttgtgtaagtacacactgtgatgttcacaaaacgaaattgcttaaagatgcatttctcagaacatatccctgtcattatgtgatatatgactatatttctatgttgagaacctgtatagttacaaatgaaacttttagactgtttatgttttcttttattagcatttggcacccaggttttatgcctaatatggtctgttttgactactgattatgttatcttaaagttgttatcgaccttaggagagttttgaactagtgttttgctttccctgttaaaaatattcttcaattgctagcccaaagttatgagctataacatttccattaaaaatctttatctaggccaggcgtggtggctcacacctgtaatcccagcattttgggaggtcaaggcaagcagattacctgaggtcaggagttcgagaccagcctggccaatatggtgaaatcccatctctattaaaaatacaaaaattaggccaggtgcggtggctcatgcgtgtaatcccagcactttgggaggccgaggcaggtggatcatgaggtcaggagatcgagaccatcctcgctaacacggtgaaaccccgtctctactaaaaatataaaataaaatacaatagccaggtgtggtggtggatgcctgtagtcccagctactcaggaggctgaggcaggagaatggcatgaacccaggaggcgaaccttgcagtgagccgagatcgtgccactgcactccagcctgggcgacagagcaagcctctgtctcaaaaaaaaaaaaaaaaatacaaaaattagccgggcgtggtggcgcacacctgtgatcccagctactcaggactctgaggcaggataatcacttgaacccaggaggcggaggttacagtgagcagagatcatgtcattgtactccagcctgggcaacagagcaatactccatctcaaaacaaaaaacaaacaaacaaaaaacctctaatatagactgtcagaagaggatttatgggtgacagactagtttatgattttaaatattaaaattctaaaatattactttatttttaaatttattattattttttgagaaagggtcttgctgtgttgcccaggctggaatgcaatggcacactcacagctcactgcatcctcgaactcctgggctcaagaggtcctcctgcctcatcctcctcagtagatgggactacaggtatgtgccacctcatccagctaattttttttttttagagatagagtcttgctgtgttgcccacgctggtctcaatcttctaggctcaagtaatcctcctgcctcagcctcccaaagcactgggattacagccacctcacctggcataaaataataaatagtgagtagggtaaattatatattatagcttctatcataccattcccaactcaaataggaagagatataaggtaatttaataacttcagttcgaataaagtaaaggaaaaggattattaaattgaatatctgaattatgagaacagattatgttcaacttgtaaactggtagtgttttcaaaagtgctttgttttatatcccatcatgttataataataacaattgacatctgcttcaaattcttggatatctaggcaaatttaaatgacttagcaatatgtattataaatactacaaaaacagaaagggcaagaaggagacttactgagctcattttatgtttgcctgacactgtatttataaatttggatgacttcgagaaacagaaaaccacactcagaatagcttaaacctgttgtttctcgaagtgtagttcccagaccatcagcagcagcagcacctgggaatttgttagaaatgcaaattctcagaccccatttgagtctgattaattagaaaccatttttggagcccagcattctggtataacaaatactccaggtgatattgatgccggctaaaacttgaaagccactgatttaggtctctaatgactagttctgtccagagatgagagccagcctcctcagaaacacatggctggaaggatacctgagcaaaatcaaggccacttcaggaaggagttgtaagggtggatattgaataggcaaccaacagaatagactatgccatgcttggtggtttttggttttgtttttaatatctcatttaaacctcattttggaacacacgtcatatttgttattttagaaaatgtagctggaagttatgacaagctttcaaaatgctgcttccaccaccaccaccaccaaattatataatattgctgatggttgttaggagagtctgtgatggaggggtggagtgtgaccacaatgcactgtatgtagaagagaactttcctggtgtgaagataatgatggtgttcctatgagggactgtgggagagattttagggtaaatgtagtggggctgaatgagaggaataggggaaatggttggtatgtgggggaggtagggtgttactgtggggtgtgctgtgccctgtgtgagtgcatgctggaatgtggaggaaggagatgggagtgggggtttggttgggatgcagtattgcgtgttagaaaggtagtgtgtgtgtgaaaaggtggcatcatgtgtgcatacaacaaagtgaagtggaaggagctgctttaccttaaaatggaagaaattttcaaatgtatcatcatgatattgatattctgattaaaactgaattctagatagttttagtttatatgtatttgtagtttatatttaatctttaaaaaattcacttctttgcttatattcaaaatatcactggttagtgaagtatatgtaggcatagtgaatataactaccttttcaagaaattagatgttagaaaatgcaatttaaaaacagactgtgtaacaggcagagggattttcaggtcactttgaatatttgtgtaggatttatttgtagcatattggcttggtttttacacagtcattctgtaaaattttagggtggaagagtccacaaaaggcatcttattgcttaaaaaatgttcacataaaagatacaatcttatagtactgttagctgtaagtaaggaacataattttatgactatatgaacaaataacaaaatgttcattcaaatcattcatgtgctttaagagactctggaaattatatttactacttttttgttactgggttacttttagtatattcatgtactgatgtttggaaatataggctctgtgtctttaaacttttgagccctttctttgcacatttgggtacagtgcaaccaaacttaagcatgggaaattctctcttccctccccagctttacagcctccactcaggactatcattgctatggatactacttagtgattagctctctctcttgtcaatcaaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtaaatcttagtcaattattttaatttgtatatatactagtcttttcatggtgacattatgaaaaattatacaatttctgaaagtttaagcatagaggatatttatagaatacaaaattttatgattgtacaaagtaccttgaagttgtttctgttaattctgagtatcttcaaaaagggaaattaataagggactgtaattttgtttcatattaagtgttttgtatgttctacaccaacaggaagatatcaaatcttaattgttgccttaatgttttttattttagcttaactttttagaaaaatattcagaattttctcttgcttgaaaataaattgaatagaacagagtaaattaattattattgactggatctcaaaccagattcttttatgatattgtttacttaagggtataattttaagaatctgactaaaaggttttttaagctgttcaaaaagttttcaggcaatgctacctaatacaaatcttcaaacgatatcctagtaaggaaattcagtcaaccatactattgtaagaattttatttatttttctgtacgtgtacattgttataaaatgtattgtccattgctctttctgtggtaatttgggattatattttgcttatgaatgtttattttattttcacttaattgtagatgatttaaaatccaataaggactttggaagatgcccccaaagcagcttgccgcccttaaatgttaagtgtgtcaaaatattaaaattttaataggtgttatttttaattgtaatttcaaaattcatttatatgttacatcagcacagagggatttaggcacctgaaatgattgaatttttaaaatttgtgattagatttaccagataaatcagttaacaccgttgttttttttttaaaccaagaacaatgaagctattcatacattttttttatttgaagtttgaataatcatttattcttagtttgcaaagacttcaatacagtttattacaaatacaagcaaaataaattgtggttattctgaaatttataggtcaatctaattaatgtgcatcaaacacttacatttattacagtcaccacgtccaaggcctgttcattctttatttttatttttatttttgagacagggtctcactttgtcacccaggttggaatgcagtggcgggattttggctcacttcaacctgggctcctgggctcaagtgatcttcctgcctcagcccggcaagtagctgggactgcaagcatgcaccaccacagcccgctaatttttttgtattttttatagagactaggtttcgccttgttgcccaggctggacttgaactcctgagctcagctcaggagatctacctgccttggcctcccatagtgttaggattccaggccactgcgcccagccaagttctgttcattcttatgggaggctatataattttgtcagatactttatttcatgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaaaaaaaaaaaaaaaaaaaaaattctaagagaataaccagtatttcagaacaaatgaaatttgactttttggagtttataatgtgtagctttttagaattcttcgtctttacccaacaaataatatggccatattattactacctctgtaagagagattatcactgaggtatctatagataccttgacagttttccaaatgcctatgtatgtagtatcacatgaccttacagtaaccctgtgtgttaaccagattgttttgttttataagtgagttaatttacatctcaaatacattaataactaataagcagcatacactcctaacaaaatgcatggcatgaaattaaccttttgccagttagcttcgatgagaaccatattgatcaagcatgcttaagttttgttatcttttattttttaaaggccgttttatagtttattctgataacttaaactttaatcattcatttatttgaagctattcatgtatttgatatattcatgtgccatactctaccttgttagtgtctgtcaataagtcgtaatttacttgaaattataagcccattttataataaggatttagtcttaatcaaagtcacaagtcattaaatagcatcagtgtttcattgcctttatcagtagtcactaatttcatcaccattttcttagtttaggccgtcatatatgaacagactttttttaaatttaggctttcatatatgaaaacacaggagaaaagtttgtatgtcgaattgtttacatctgttcaagaattagctgacaggtggatttttaggaagagctaatttaaatgtaaaaatctttccagtgacttcagcctgagataataactataatgataaaaataattacttgtactgacagtgtataccaaatattgttctaaacacttaatatgagttaccttatttaattctcacaaccctgtggaatattactttatcatctccattttacaagtgaaaaaacagggacatagcaatcatactacaactagtgcaagtcagagctgattttttaatctaggcattctggctctagctgatgcccttaaactctttgccatacttgccctcaaaaatcttcagaatataacaagaggaagagaattatttatttcatatatttaatgtatcagaacctattttatatatactttatacatattatttatttctcataaaatgtaaagtatttccatttgaagaatcagaaatggggaaactaaatgaggctccctaagttcacaaaactaataaaaatcagaatcaaaattaaggtagcagtctaaaaccaaagccagtattcttcaatattatgccgcctatctatagtagatagtcataagacatttattaaccagtatttatgtatgtcttatggtaagtgaaacatcttctgctctccagtcacaacctagttgaaaaaagtatacacatatattcaatgtagaatattttttcttaatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaagttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgacattagtgtgatatatgttacagtgtatgaactaatattgatatattgtcatgcagagtctatagtttacattaaggttcattctttgagttgtatattctgtgggttttgacaagtgtataatgacatgtatctagttgtagaatcacatgctataatttttctgccctaaaaattccctgtgccacagctatttatcactcattcccttccagtgaacacctggcacccaccggtctttccactgttttgcgttttgcagagtgtcatatagttggaatcatatagtacgtagccttttcagattggcttctttcacttagcaatttttatttaagactccttcatgtctttttggcttgacagctcatttctttttattgctgaataatattctattttatggttttatccacttctttacccattcacctggtaaaggacattttgctttcttccaccttttggcacttatgaaaagaaactgttacaaacttttagatgtagattttgtgtggacataagttttcaactcataaataccaagtaacatgattactgtatcctatgttaagggtgtgtttgctaggccagtgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaactgccaaactgtctttcatctggctgtacccattttgcatggcatccacaacaaatgagaattcctgttctccacatccctgctgacatttgctgttgtcagctctttggattttagcttttatttaaatagatgtgtagtgatatctcaatcattttaatttgcatttccctggtgacatatcatagtgagcatcctttcatagtcttattttccatttgtatatcttctttaatgagatgtttattcatatcttttgtccatattttaatcaggttgtttgatatcttactgttatgttttacataaacatagagatagaacagaccattgtctccttccttcctatctgtattccttcatatattttggataacagtcctttatcatttatatatgttgcagagattttctagtctgtagcttgtctttttcattctcttgacagtgtctttcacacagtagaagtttttaattttaatgaaattcaacttaataattttctttttcatggattgtacttgtggtattttatctaaaagtgcaccttcagacttagggtcaccaagatttttttcctgtgctattttctaggagatccatagttttgtgttttcctctgtagtccatttggtataaagactttgtctcaattgactgttctgcaggtggatatccagttgttccaatactattggggtaaagaccattatttctcctctgaattgtctttactcctttgttaaaagtcagttgactgtatttatgtgggatatttctgagtgttttattgtgtatcattgatgtatttgtcagttcttttgccaaaaccatgatgtattgattactgtagctttatagtatagtaagtcttgaagttgagtagtgtcagtcttccaactttgttctttttcttcattgctatcttggctattctgtgtctttgcatataaactatttctataaattttagaatcaatttgcctgtatctacaaaatagcctggtagaattttgattgaaattgtattgaatccatacatcaagttgagaagaactgacagcttgacaatattgagtcttcctatctatgaatgtgggatatgtatttaaatcttttgttaatcacagttttctactttttttcacgtagatctctatgtattttgttagaattatatgtatttcatttacattatgctaatataaatggtattctttttaactttcaaattccaagttttcattgctgatataaagaccattgacttttgcatattaatcttgcactctgaaagcctgccatgatcacttattccagtagagttttggttgattctttgggattttttataccaacaatcatgtcatctgctaacaaagacagttttatctctttcttccctatttatataactttaattttctttgaatttaatttatataactttgtcttattgcattagctaggacttcctgcataatgtcaggtaagagtactggcaagggatatcctttccttgctcccagtcttagtgtgaaaggatcttgtttctcactattatgtgttgtattaactgaatttttttaatacatgttctttatccagttgagggagttcttctttattcctaacttcctgagcatttttattagtgttggattttgactagtgcattttttgtatctgttgataagatcacatgatttttcttctttaccatgttgatgtaatagattacatcaattgattttcaaggctgtaccagtcttgcgtaggtgggataagttctacttcgtcgttgtatataattctgtacatttgtacattgctcaattcagtttgctagtgttttgttgagaatttttgcatatatgttaatgagagataattgcctgtagtttttctttcttgtaaagtttttatttctattagagtaatgctgtcctcacagaattagttaagaagtattccctccgcttctgttttctggaagagattgtggagagtttgtataatttcttcgtaaatgtttggtagtattcatcagtgagtctatctgggccttgtgctttctgttttaggaggttattaattattgattaattatttaaatacatatctttctttctttttttgagttggagttttgctatgttccctgggctggtcttgaactcataggctcaagtgatcctctcacctcagcctcctgagtagctgagataataggcatgcattatctgtttcttcttgtgtgacttttggtggtttgtgtctttcaaggaattggtttgctttatctagattatcaaattagtgagtgtacagtttatagtatttcttcattattcttttaatatccatgggatcagtaatgatggcccctcttcatttctgatatttattctctcactctcatctatcctggctagaggtagaggtttatcaattttattgaccttctgaaagattacaaaattggcttctggttccattgctgtttttctattgattttgtttttaatctattgatttctgctctaattttattttcctgtgcttcagatttaatttgattccatattctttcatctcttagcatctcagttatacttttttaaaaaacttttttaaatggttcctctagaatttgtaatacacattttttttagtatagtttacatggtgaaaccccgtctctacaaaaaatacaaaaattagccgtgcgtggtggcacacacctgtagtcccagcacacatctgtagtcccagctacttgggagactgaggcagaagaatcacttgaacccaggaggcagagattgcagtgagccgagattgtgccactgcactccagcctgagtgacagagggagactccgtctcaaaaaaaaaaaaaaaagaaaagaaaaaaaaaaggatatggggatatggctccctcccctcttccttcccttttttttccttttcccagtattgatgaaagacaggaagtgattttaaatgcagattttttcaaatcaaacttcactaatagaattaattctggatttttttttttttttttttaagacaggattttgctctgttgcccaggatggagtgcagtggcttgatcttggctcactgcagcctcaacctgctgggctcaggtgatccttccacgccaccaggcccggctaattttttgtatttttttgtagagacgagatttctccatgttgccccggctgttctcaaactggaatgttattttgaaagcagtagttttaatttgggcaaaatggggcaaagtttaacataattcaggtcttattttgtaataaagactgttaatatatgatgagatatagtagaacaacggcttatgtgacttcaaggatgctgttgtatgctctttttgtttgatacagaagctcagaattatatttccttctttaacatattttttgagaccaaagtaagtgtaagtggcattgattagatagtatttctttttctcttgcatttccatttactgagaaagtagtaaaaatggcacattgacatataactagcagatttttgttagtgtgcaagacattgaagaaagggagatttggggtttgttttggagtaatcttggggaaacactggaacgtccataaggtattgttctttatatctaagagatgaacgtgttcttaatcatgggattggcagcaactgtgaattttctctagtctctgtttttgttagtccatttgtaatagtgatgggtggatttacccctgcctttccattggtaattctgtagaagtaaaggcttaggaaaatactttctctttgtgagggtcctttgtcaaagactgaaaagactagagagtggcatttaattctgcagagtataggtcatggtacttagttcctatagataggagttagcagtatatccaaatactttattccttaagaaacgattttttagccagtgaatgcacttttaattggaaggtcttggttttctcaactgtttactcctaataattcagagcgtgataagggatattttggagaaatgtattcattttttatttaggtttaatcttttgggtaaagtaataaattgtatacatggagtatggtttaccaagggtttaaaattaatgtaagagtaattccagtttcctcatatatactgggaatatatagctcttttatccctttattttgagagaaggaagtatatttctgtactcaaattcaaatctcttttttctattaactcacagacttttttttttttcttacagttttctgtatcctcacccatcagggcatgagtaaatgtttaaggttaaggaagcagaaagtttttaagtcctagaaaaaaatataattgaaaaaaataaatttgaaagagtagatttgtgacatgaaagaaactatgactttatcaagtgttattaagataagcttagccttatggcgatttattgttctcttattagtaactcctactctcagcaatgctgatacaattaggttatgactgatctcttttgtaagcataatttaatttcacttccacccaggaagtgtttttcttatagtaaatgaaggagttttagaatatagatataagataattgttaactggagggatagaaggaaagcagagaattagataagttatttttgacaatccttgtctaggagactattggattgaaggccatgaaaaaagaaagaaaaatataattggccattaaatatttctagagacctgttttgctgggcatagaaaagcaagcccatgatgttttttatttttagtacctaatttttcttttatctttattgaaatcctattgttcttaattgaaagtccttcattatttttatctaatactgaaatataaaaattaaattcagaataatcaaaatgttaaaaatagttgagatgtcaaacctgaaatattctcattcaaaaataaaaaccaaaaattaataaggaggctctttggccattatcatttagtctccagggtaattggtgaaaagtaatcaagtaaaagtcatatgaataatagtagttctcattaatatgttctgggcactatactcagtccttaatatgcatttcctcagtaattcacataaaaccagatttgatatgcacttttactattttcattgttttataacaaaattgataggcaatggggaacccaggtttatctgacacccccccccatccgcccccagagctagagagaataacagcttctggtttctaagtacagagtcagctaacatattgtatgctttgttgcttcacaaaattcaatataataataatggccagaatggaaatctgtccagcctcttttccttttttctattctcatgtctttcagaactttcaacaagtttacatagcttttcatagttaccttaatgtttactggtagccagttccttttagttggctaaataaaaagcctttaaaacctaggttcaaaatctaaactctttatgagccagttggattaactcattttgtggtcagagcctctgtgcatttttgattgattacaagaggaactagtcatagctcaagagaatcgtcacatatttatcacaccattagcgttcactgtagtatggtaactgtttttagaattatgtcatgatctgaaaaagctgtaactattatgtcaacctgaggaaacttacctgtttttgtgggctttctgtaatagtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacgttatctttaatgttagcaaagtatgtgttttatatagtgttttctgtataaaaaactataatttctatttactaagttgaatctatatggaatagtccataaaataaaccttacataccaactagttggatgtagtagtgaaaatcattcatggatatttcactctagtttgatatataaatctcttggattttcaacatagagtggggaagaaatcctaattacagttctcttcccattttaatttctcctcttttttttttttttttttttttttttgctgtttttctcaactgtcagtggaattattgtcttcctgtctccatatttaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttctttcagcgatgaggagttttcattcatttaacgttggaagaatggtgttggttttgagattgaatcttttctaaacaaaatctgaaagatatggtactataggaaaactaataaaaaatttaatagcaaggcttaaatattttatttaaggctatttcatttatatcagcgtcacatcaaatatctcaataggataaactgttcttgaggcattcttggttggtattaggagtacattggaatagtacagtttagacacagaactggataaattacttaaaattctgtgaaataatctttgtgattttttttttagaaacaagaaagcaatgtaattgaaaactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaagccagctagctgacttttgcccttcaagggcttaattaaagatgcatgcaactatcttctttacacagaaatatggggatttatcattcctaccagtcgttcctcatgtagtggatgagaaaacgtctgcttatattgttataaaatcttttcctacattggctacatcatagatattagatatgggccatcttttgccctataaaatcttaaggttaaagatttagccacattttctacgatataaagctttatttatctgaaaagtctgacaattttgaaagcatgtcacaagtttacattaatgcactacctctatttactgttttagattactacaagggaagacataaattcaaagcaggttgctacagtgaaagcagacctggagtctgaatcttttcgaccaaacctaagtgatcccagtgaacttttactgccagatcaaattgaaaaggtatgacatgctcacatatgtgcatttctgagtgtgagtgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcgattaacttgttcaaggtcacacagggagaagtattaaagcttgattcctaacttggatagtctgtctccctagcctattatttaagagatattttaataatcaagctaatagtctatcaagtatttttgttaattcaatatggaaggcaaaagcattaagtaatctatgtttcttatctctgttctaatctgtgtctggttcagggtgattctttattttcctaatagacaattaatattttattctgagaaatgtgtaatacttttcaatcatcttagtatctttgagaataataatttctactgttaatttatttttatagcctatattatataggcaccattacattccagctggcattagtattctacataatgaacaacaagctatcaagtaaatactaacactttgttttctaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtatgaaacaccaactgcatagattgcttatcctttaagagcagtaacagtaacttttagcatatttatttgataaacattactttattagtgcattttattgtttaactgataattactgggtacttttaatatgcaaggcaatgttgagtattacagaggatagatatgagcatgatgattaagaattactgccttcaaagggattatagagtggtagaaaagaacatttgcacataccaacatctctaatggtggggaaaatggtaggtttcttagaacctagaaaaagtgaggaaataagaatgaggttcatgggaaaggtagaaattgacagaatcttgaataatgggtgaagttttgattaaagataattgtttgaaggtgatagccagaacaaaagcacaaataagagtaatattggtttgttcttcaaacagcaagttcaagtcagttgtaattggaaactaatgagaaggtaaaatagcaatattagaacaaaacactggtattactaacacttttagtgttttatgtgtcaggaacttgactaatcacttatgcattatgttatttaatcatgaaagccctatgagattgatactgttatctttatattaaagaatgagtcaactatgacataagctcatcaacttgcccaaggttacatacccaagaaaaagtatttgcaccaatgaaaatgaatgaactgctgctacatgccatggcataaatgaatgtcacaaacataatattgaattagaaatcaaacaccagagagtaactttcttatgatttcatttatagaaagttttatcagtgggccaaatgaatctatagtggtattaggctagtaactccttcaggtagttgagactattgatgagaggaagcacaaagagagcttctagaactagtagtgttctgtttcttggtctgaatgaatgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattcatcaattttctcattagggtactgtgtgtcttgtataagatcatgcacagggttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatcccaaaatttaaaaactaggaaaaaatctgtatttccattgaaaaaccaatatacttcatatttgacaataatgtaaattatatagcagctaaccatttttccctttttaagtatgattagattaaactataccagatttctattttttgcattttatttaaacatatatgatgaaataatgcttactggaataaatttgttagtcgtgtcattgaatatgccttttttatccttaggtttttggtgcgttagcatctgagccactgaaagtgagtgatggcttttatggtactggagagacctttgtttttacattctgtccggagtttgaggtaagaaccactatttcaatattttatttataaagagttgacataacatactgcccaaagcaatttatagattcagtgctattcccattaaactaccactgatattcttcacagaattaggaaaaactattttaaagttcatgtggaacccaaaaagagcccaaatagccaagagaatgctaagcataaagaacaaagctggaggcatcacgttacgtgacttcaaagtatactacaaggctacagtaaccaaaatagcatggtactggtataagaacagacacatagaccaatggaacagaatagagaactcagaaataagacctcacacctgtaaccatctgatctttgacaaacctgacaaaaataagcaatagggaaaggattccctatttaataaattgtgctgggagaactggctagctatgtgcagaaaattgaaactgaaccccttccgtaaaccatatacaaacattaactcaagatgggatagagacttaaatgtacaacccaaaattataaaaaccctagaagaaaatctaggcaataccatttaggacatagatacgggcaaagatttcatgacaacaatgccaaaagcagttgcaacagaagcaaaaattggcaaatgggatctaattaaagagcttctgtacagcaaaataaactatcatcagagtgaacagacagcctacagaataggagaaaatttttgcaatctatccatctgacaaaggtctaatatccagaatctacaaggaacttaagcaaatttgcaagaaaaaaaacaccattgaaaagtgggcaaagacacttttcaaaagaagacatacatgtggccaaaaaaacctgtgaaataaagctcaacatcactgatcattagagaaatgcatatcaaaaccacaatgaggtaccatctcactccagtcagaatggctattattaaaaagtcaaataacagatgctggcaaggttgcagagaaaaaggaatgttttattttgttgttgttgttgttgtttttgaggcagagtcttgctgtgtcgcccaggctggagtgcagtggcatgatctcagctcagtgcagcctttgccttccaggttcaagcaattctcctgcctcagcctcccaagtagctgggattacaggtgtacacaccatgcctggctaatttttgtatttttagtagagacggggttttgccatgttggccaggctggtctcgaactcctgacctcaggtgatccaccctcctcggcctcccagagtgctgggattacaggcgtgagccaccacgcccaactgaaaaaggaatgtttttaccctgttggtgggagtgtaaattagttcaactgttgtagaagacagtgtggcaattcctcaaagacctagaggcagaaataccacttgacccagcaaatcccattactgggtatttacccaaaggaatgtaagtcctcctaatataaagatacatgcacacaaatgttcattgtagcactattcacaatagcaaagacatggaatcaacctaaatgcccatcgatgatagactggataaagaaaatgtggtacatatacaccatggaatacaccatatacaccatgcaaactaatgcaggaacaggaaactaaacaccacatgttctcacttataagaaagagctgaatgatgagaacacatggacacatttcaggggaacaacacagaccttgtgtctgtcgcagggtgagggtgtggggagggagaggagagcatcagaaataatagctaatggatgctgggcttaatacctagttgatcggatgatctgtgcagcaaaccactgtggcacacgtttacctgtgtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcaccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattggagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaattaaatgttacataactatgaaaaacgagtgctaaaagaaagttttattgaaaactgtaatgaacacattttaaaaacttgataaaagtaagttgctagaaattgctactatgttaggtttaggtaaaacacccataaaaggttagaaaaagatatttaagaatattcatgtctagtttgctcttggatttctcaaatgattttaagttctcactgtttaaagaaattgaaactgaaaatcataaatacccattatggtcatggtttatttaagaactgtgatcagtaaatatatatgcaaagaaaaggccttggccctatgttaaaatattatccaattaacatacatttctgtttaatggtaaaagttaatggcatttgtgtccgattttttttcaactcatttacttctttctcaattttttctattaaccgtccaactcttggtgtctgtagagtcaggagaaagaagtatgtgtgaaaagttaacaaaattttgagaaattggaattgaaagttaagtgatagagtgtgtgctttcaaatttagtcatataaacactgaaacccaaaccaccagagccttctgtgcggagctttttgtggtgttcttattcttatactgccagtcttggctttgttaactcgtttgagttttggagaactaactctctataataaccatttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttgacgttagaattcaaatttgtatattatgaaaaagagagtataatgtatttgcaagaagtagctcaagtgtagttattgaaactattgatggagtatttgtttcttcattttaaaatactgttcagtttattcactgtttattaagacccatctttttctttagagcacagtggctctttgataatataaagggaaatatctcagtacctttgaacttctctaatttttaaataactgtgatggaatattttatttctcccaatgcatagaacaagtccaattgttttcatgttattctactctggagaccatttggaatgatattttagacaataatggaaatggggtttttgcttgcttgttttttaacaattatgaatcagacaataatgtgattatcttggcattgcaagtactgtgaggagctttgttttttatttggtatcccagcctcctttaatctttgcattgttgggaggtaggctgctctggtcccacctagcctgggcttagcaagcaacaactccttcctttggtatttctgtctttcagtattagacatgggtatgctaaataattttcagacttgtaaaagtgttacattatttgtatcccacagttgaggatatataatgataatttattcagaccaccaaagaatattcatcatcccaggttattctattattaacaaattttcttacaacttctctgtaagtaggtgtttggaggatataagtagggtgattaaaaagtgatcatggttattgtagccttctctgttagttttagttgttgaactcagcatgtatttacatggtccaattataccttttggggggggtatcattcagccctcccctaaacagtagtcttacatgtgattctgttagctctccaacaggtccactcaatctagtggcttataatttcaagattttatgggtgctttaagtcttcaaaaatgtcatacacaatgccattagatgtctgctggaactagattttattgtacaacatgatttcaccaagctagagtaaccactgggttatttgataataaattaatataagttttcagtgtttaaaggagagtacagcttcagaaagcagaaactacagggagttgatattccagaattccaagggaaaagcaccccaaaagaaaaatgatgtagtggacttaatgtaggctttggagtccaatagacatgattcagattctcacttcaacatatgctgtatgtggtaccttgagcaaactccttaacaaatctaaactttccttagctataaattggagattaaaccagttttgtagagagattataaggaattcacaaggatataatttttgtgcaaatcctagtatagtatctggcatatagtaagtactcaacaactgatagccacctaaactgatagccacctttactcattttctttcatccaacatgatctgttcccttctgataccaggaagaattctgcctgcagtatcattggctgcatgagctataagacattaattaaagatttagaagactacttttattccttccacttccttagccattctcttttcagaaagtcgtatgaatcatctttgaaagcattgctcatataaaaatacactttctggctttctgggtgtttcacctgggacagatctgtaacctcttaaatacatttacttaaatatttggatatcacatacctttttgaaatgctgatgaaatgcagaggtacccattgtcctaaaatgaatatacaaataatccaattttatatgtgatattaagaaattgacaaaaatgttgaaagcttctactcagggcttcagaaaattcaggttaccttggaaaaaactattcatacttggtaataaaacttactgcagcatcagtgacattcatgaatcttgaaggtcaattttgaggtactacttagatgcagtcatctgagattacaactagatgtcttaatcttttattaaccctttcatatttagcagaaggtttttatgagcaagtctgaccctttcatattctcctttctaatagattggctatgatagtctattcgcgcttttaaggctcatggattcagatatctctttaaaggcatgttgttgccagtagagttagagtctctagaagtctattgtcataagaccataaactttttaattcaaatgcgtttctaatttatctctgtattttccagtgccagtgtctgaaacatgataaatgcacatttaaagttgaacaaattagacaaatatgaatttcaatttgaaccttaacaaatgatggcttcctcatgggacagggggcattttggggacgatatagttttgcagtgcttctgtatcacagactctggattgttatgattttcagggtgttcttgtatcttagcaaagtcccattttcatttatagaagaggttcatcagaacgtcatcactggttatcccattacagtttttttgtactgtcaactctcttcttgagtgacactggatgatctctttacctggtcattgtgaattactatactgatctgtcttttctgttttgttgtgaagtaccaactctttttttttttttttttttttttttttttttgagatggagtttcactcttgtcgcccaggctggagtgcaatggcacaatcttggctcactgtaacctctgcctcccaagttcaaatgattcccctgcctcagcctcccaagcagctggaattacaggcgcccaccaccacgcctagctaacttttgtattttttattagagacagggtttcgccatgttggccaggcaggtcgcaaactactgacctcaggggatccaccagcctcagcctcccaaagtgctgggattataggcgtgaggcactgcacccggccccaactcttaaaggaaccattctacatggtcactgtagccaccttctctacttagaaacacatctctatacttaaaatttgtatatgtaattaatatacattatatatttgatgctgttttttattacagagtataaataaatagttcctttcttttgttctaagatagtgttaaaaatagatcagttccaggccaggcacggtggctcacgcctgtaatcccagcactttgggaggctgaggcgggtggatcacaaggtcaggagatcgataccatcctggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaaaaaaaaaaaaataggtcagttcctctcccacacaagtcagttaactctgtaatgccatgtgactcctgatggcaagcctgaaggtcagaggttatagccacccaaattatagagttgtgtaagtctttacaattacctaatatgcttttcttttttgtgtgttttaatataattgacaaactctaccccagagaggttaagtgacttaactaagtttgacataagttgtggccactgagttgacagacaagtcttgatcccagaccagtttttttctttcaatgaaatataactgcccatattttttaaaaaagcctccgcctcctaaactctggctcaattctgctgacttgatatattactttagatttagagaatcccaagggatagctctctggatattatgttaattaatagtctttgccccctctcctcttctattaggtaggaaaacattttctagagaatagaaagaagtcctctcataacctggtgttttcccctctcggttatgtattagataattagataaattggaccttataatctatctgttaagttcctgttatacctagattatatcttggttcttctgcttgaatctcaacatcacatatttgtccatttaaagtcctttcaaactgagctcttttgcaaacagcttcctatgcaggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttcttttcttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaa

SEQ ID NO: 1438 - DNA, 482516 bp, Homo sapiens; identical to SEQ ID NO: 1437

SEQ ID NO: 1439 - DNA, 304770 bp, Homo sapiens
aacgagacatctagtacggggctcacaggtaacagaactctgatcagatccgccccggctcccacacagctataaggttgcctgcctgcctgcacagaaatgacgaaggacaaaaacagcccagggtaggtgggatctatcagcctccatctgttgttacttcctgtgttatgaagaaaacgtttcctagttccattataaaatagctctctgatttctgtgcaagtgagaaatcaaatctttgtgtttatgggaccaaacagatggatttctgttgccatttggttcctggcgaagtgggaccgtgaacaaggcagactgccgaaaacataggtactaaagaaagggaaaacccttctgatatgtttgctgtgcagtattcattgcatacgatccctttcaaagtcatagttcttcgtatttttaaatgctgtttttcctaatttcagctcggcaccacctatcgtttatgaacacagttttattgtttggtgtaagcggttttaaatggcttagagagataatcataatttgtattctcaattaaaatatattaagcacatatatttcagtatgttgtattcagcttaaatatattatttaaaataatctaaaattacttgaaaaaaacaaaatcatgaaaaatgttgtctatattattctgtgaataatagtttcaaccacttaatattttaaactaataatagcataggtctagcaacaaaaaataattattggaaattcttactttcagttgttaccggcatagacctcattacaggaataggcctcattgcccttggtagatgaccaggtgctcttttagaaaatcagttaaaacaaaagtgcagaaatctaccacccccagaagcaaactacctttactcatgaattctcattattcctgactgtaagaatgcattttctttttcgttatttctgtcaggtatagataacatcattgatgttgttaacatcatttaaatttcaagattatattatgctcttatataattaaagctattttgttctctggtataaagtttataggtgggcaggtaagaaaaacacaatttttgaaagttgagtacttaaccagattacttaattagcaccctcttctgcctggcttgacatttatagttaatcatgaatttgcatcttggaagccagaaaacaacaattatctggaaacttaatttaaaaaatataaattttgcctgacttatattttaggggttgaaattgccttgttaagaattaacctccctcagctgatgttacccctctgatcacttttgactcttcgtttaattataagtaaataacttgcagtgcttcttgcctcccttccatcaatatttaaacaaggaaaagcattcatagctgtgagccaaatgcagctagctacatagaatatggtttagtcacagaaccaatagaattaccagaaacctcagcaagttattcctttagaagtagtcccagatacaacaccacttctactcaaagccaaagttattgttgaatgtaggctacacactgttctgtatgctttgcctgtgttaacggcatcatcacaaccactcctgcaaagtttgtattgttataattcccattgtaactgatagcatactgagataagaaaagagtaagcaaattatccagctccacgcagctagtaaatgatgatggtagagtccacagaagcttggtaatagatttcttaaaaattaaaataaatccaatcccaaattacttgtttaaaattccttttacatttccttcattagatattcaaattacaaaatatgtacatattgatacaaataaaagaaaaatcttaatgatgccacattaagaggatttcttttacttttttgtcttttaatttttttttgctgtcccttggagtcagtaggggccacatcccctttctaatcctactctctgggcatggagagcactttcacatttttcttcatgcttgccacatgtatgctgtctcacaggcatgcacacttttaaacaaaaataacaatataaacattactctgaaacttgatatttcatgaagtcatatatcatagtgcttactccaggccagtaaagttgtagttgagctttgcattgatgcataatatttcatgtgatgaatgaatcataatttattcatgcaatgatggatgttcagataagagaatgatcaattccttgagtgttttaaatagacacctgacagaaagagtgaaatgagctaggtgcttttaccaaagctaaggtctgcttatgaagacgttcctcataacgctgcaatttcttagtgattaagtgatcaaaattatgtctggatgcctcccaagtacacatttcttaaattactccatatcacctgaaagaatgtggtgaatcttttcatgtttgtccgtgtgctattttcagtttagattctttgtagcaaagtggaaggaattgggtacatttaatattaaatttttgttgttggaaagggaaaaaaacactaaattattgcagttctaaattatggtttgaaaaggaaaagcaaaagctatcaaaatacgaagcaggaaaagagaggcagctctgaaatcaacacattgcctaggacattctccctaagagtctgctcttcttggctgatgcagcagcagtgcactgtacacaacaaactgccagtcccaaactccttgtagtgccaactagcattccaagtaaaacagagcagaccttttaaagccacctaagtatctcttgagcataggagtatgattccttaaatgctcttatactttcattttacagagctctgaaagagggtgctttttttttttttaagttttagttttaaggcaaagcaaagctttggcaccgattgataatttgcctgtgcacctcagaaaagtaattcctttcttaagaacaaacagcttatctagtcattcccctaacttttcttgcttctagaactgaagcaaatttgctaattttgtagtattctgtaaagcagcaaactgtgatattcagtgaagttctcactgcaaattgggaaccgagaaaggatataacacatcctttgcactcctatagaacctatcaaggctaaagatgttgagcctgactctcttaacagctccagtgtctgaaataaatattctaatgtctaaatgaaattgtgctcattccctcagggtttagtgtaaaacaatatgctcttgaggtgaggacaagaaggccgtcacctgagcatgtgagttttcatgttgatactctgaacattccattctagactacctggaatcaaggaccacatctgagtgtgttatacttgcaaacagtttggcttattatcattgcaattggaaatcttacaagcatatatactggctctaatatatattttatttatacagatgaattatgcccatttaaaaacaaaaaagttatctgtagaatacattatagttttcattcttatacatggatcagaatagagttaagaatgtgttcttttagctttgccattttaagcaattttgtatatacataatcattcacttggaagccagttcagtttcaatttatataatgattgtttttaatttagaataacaggaaattttcttttttctttcaaatattagttttgataatgttgaagtatgctggttgaaaactttatgattttgaaatagcgcagagacaggcattacgttgcttgatatagtataagattttgattgttttctagaacatcgtctctgttgagattagcaatagaagttttaagtattctgcatatatttccaatttggttcaacatacatttctttagcttttattttttgcatgtcccttgactttttttaaaataagaatattcaaaaatgaataaaacatgattcctgctctccagaattttacaggttagtgggtgagactgagagttacatgcttaaaaacaaatgtgtgtaacagcaggaacgctgctactgctcaaacagtaggaagttaaaaacacgagaacgtgagatgatttggggagcgggagcatatttgactaaatgtccactgtgtgctcagtttggggtcccagaggctagccgacatattgtatgcaggacacatggaacatagtctagctcctaactccatctgcatttggtttctgtctggtaagctcatgtgtaattacagactcaggacaaagaggtggttaattcttcaatggtaaattaaatatgatacaagatggaaaccgaactccacaaatatccagaagagaagcatgatattagctgaaatttttattccattgcattttcttaaatctgtgaaatccatgtaagtctgaacttaaagacagcactatcttttaatttagcctataaaaatttcagcaaaccaaaatgtttgttaaaataaccattaaccacatatatatccaaatattcattatatatataaaatttctttaaaatatcatgctcagaaatagagtaagttttaattaacaggaaaattgtttcatatcttgttatctttaccaaaaattaaaaatcaccaccaacaacattctgtatctatggataccttttctttctgttacgtcaaagtgcatcatggaattattctgaaaatagggccacctgctctatttgatattggacttttaaagaaacaaaagtttaacttggtcaccaatttactgttcctggaattgtactttatgagaacatttcaaattaattgcatccttaaactggggtcacatttgaaatcttgtcctttgctttttgttgtttgttttgaaacttgttgaaaattcttcccaggattctttctatgtggaatccaatttacagtacattttaagggcctttttaaaaaacataaaatgaaacataggcaatcctttagtggatctgtcctgttttaggactaaattgatatcttttaatagatgtaaggccttttggattatctgccccgaacttctcccactattgataggcatcttgtactaagccatagccatatattgaaaattgccccaaatgtgctctgctctttctcacctctttgtttttgcacaagcttacctctgcccaggatgccctttcttgcatcgtagaagaatgtacaatgacttccttgtactacttcctcaagtgcctggtcagatgtgactgccccttggagatcttttccatctccagtggtgctgtgcacttcgagctcacccagttggctttactgcacataatcacattggtgtcatcacatcacccatggatctctctctccctcacctgggaagactcttctttgtattccctgggcttagcatggtgccttgccctaagtgttgggctaaccaaaggtaaagtacatggaccactttgaaaatgaaaaatatgtttgatgatagaatagctctcaaatgctttagtatatttccatcaatgtgaaggcagttgaaattgtctgctggatttctttgatcatgaactatgagcagtaggaatcatgttgattaaattctcttttttctttctctgcctgtgaccatgccttaattcaggcactcattatctctcacacaaactatttcaagacttttctaactattcctcctaccaccagttccttttcctgccttctctcctatatgccactgctagagctaacttccctcaaaatgtttctgattgcatcactcctattcttaaactctcatggtggcatccaattataatacatagtccaggcctttcagccataattcaggacctgagcctgtaagcactgtaagatgtgagacattgtcatgttttcctcactgttatccccccagcatatagcatagtacttggcatagcctaggtgcacaatgcacatgggctgagtagcccatttcatcaaatctaagatggtgtgatcagaaaacacaccattattttacacactgctaagaaaaaaacctgccaattaaactaaggcacaaagcattcttattctttgaatttttattttattcttattgaaaaaccatttttatacttcaggaaaaaagattttattatatgtcactctaatgcataaataaaagggaaacataagaaaaatacattggttaaagtaattattacaactttacattttaagtttgacctttatgaatctctttctacctgcaaatcattgagatttgtgtttttccacacagtattctccatttcatcaggagtattagagttgaagcatttcttaaaagagtgattttaggcaagtgggttgcctgacctcaggagtttgagaccagcctgggcaacatggtgaaatcctgtctctactaaaatacaaaaaattagccaggcgtggtgacatgcacctgtagtcccagctactcgggaggctgaggcaggagaattgcttgaagctgggaaggggaagttgcagtgagccaagatggcgccactgcactccagcctgggagacagagtgagactctgtctcaaaaaaaaaaaaaagaaaaattatatatgtatatatataaaatttaaaaagtaattttatttcaagttgctgacacctactttgcaagttttgatgtccatgtataggtagtgacaacatcaaaactgctaccaacccaacagcatcttcatttcagaggtgttaaaatgttaaaaaataataataactaaagtccgtctcagaattgatgatattaattgtcttattcgtggaatcaatatatggtatttttagtctgtccccaacatactcttccagtttcctcttcccactactcaatccctcacacttttactccagactatgagattttgtgaactggggcagatgcttttttgactctgtgttgttgcattcattccaatgtaattgccatcttcaagcctttcttacttccccagatggacggggtctcttccgccttgccaccctctgagcattttgtgtatacttatttgaatacttctgacaatttttagtatgcatgttgaaagataagaactaacactatagtacttttgtctgtacccttgctgcttgcacacagctattatttgataaaacttgattaaatatggtttgatatatttccttccttttatttgcttatggagtggtttagagttccagagttgtccagggaggacttctgttactattgcttttatatgacttggtgcccttggtcaagcatcatttaacaaaggatttgttattttgagttagtcagaatatttaagttttgtgttggccaaggcccatgtcttacaaaataaacaaataaaaagctcactaacccaatatttttgtgcatttcatcaggattgaacaatctatttgataaatgacaatttatatcttcacaatttttacactaaaatcatcccagagaccggaacctaaataagacaactaaaagcaattatagaactttcaggagcaagtgtaaagtctcagttgaaatactgtctattgataaaaacattagccaaggtcaaatgcatgtcctttaaaactgtcttctcatttcattactgagtgttaaaattaagagtctgtgtctgaattcctgatgttagtcatgagtcattctatttatagatgttaatgtaattctcaaagagttgccaacaaaggaacaggtgatgaccccctagagcagtgttactgaaaatattgtcagtccaatcagtcacctggcatactgggcagaaatgcagttacctggggtcagagtcatacctttggactcttttgactcccaggattctgagtaattcttaaagaaaaggaagtttgaaagtttgtatttttagattatgatccattgaatctgataccatgaaagatatatttagtgttttcccaatagacctagattaatacccaaattccaatagagctcttgcttctggactgtacaattcaatgctgtttagtcacataattcaaaaactttaaaaaatattttctataacatttttataactagtttttcactattaaattctgtaaacttaatgacatttcacttcaatctatacaggaagttaataacttttcctttgaatagatagaagaaagaaataaaaagagatcattttgtattgtatgctttccagcggaaatgatctatgatatagaattaaataaaaaactttttaaaacaattctgagtcactgcaagcactcagagagatgtgagtcaccataggtcacccagaggatgaagatatagctgggaacagaacgaagatactgtctttctgtcccttacccacttgcctgcttcctccaacaattcaaattcattcattgagtcatatgaccgtctcatagtgttgttgtttcctgaatagctttttattaaggattttctgggcttctagtatactccgcagaagcagaattaacattatttatcttaaaaaagcattggattatttacgaaataaaaacaaaacttgaaaaaatgatcaaataatggattttgatacatctagcaccattgccttgttttatttttattgataaaataagtatgttggaagttatttaatgccatcaatgtaatttgaagaagaaacaaatggaatctatcttgatgagcaactattgtgggttttttttctccacaccatgatttcacctacatgttttctttgcagcttgcataatctatagaatatccatccatgataacataacaatacattggcagctatttgattaccttttgagcgttgttaatccctctgcccagctcttctttgaactggtcatgaaatgaaacattaagtcccatgtcaaccaaaggaatgatagatggatggagactcaggaatccaggagaccaaataaagaaacatgtgtgtgcatgtgtttgtgtgtgttgtatgtgtgtgtgttctttctgaaaattccagttgcatttattatttgcattgtacataataacacatcatcaaattgacctttaattaagtggctaagccatctgagtggcattattgtttagacagttctcatcaaaatttttagtagttctccatttcttgagctagaatttattagttgaatgcctacttatctattaaagacatttgataaatacctccaatgtgccagtcagtgtgccaatcactgtgctaggtactgggattcactggtgtgcacaataattactttggattaggtcaccttttattaaaagattaatgctgttgtcccagaagtgggttagttagttgtcttgggataggtttctgataaaaagatgattttggtccctttccctgtgctctctaatgttttctttacattctaccttctgtcatgggatgatgcagcaggaaggtcctcacaagttgctggcaccttgatattggactttctagtctccagaactttgagaaataaatgtatttcctctttaaattacccagactgtgttattctcttatagcagcaaaagccagactaagacagaaaattggtaccaagaggtggggctgtgccatcataactacctgaaaatgtggaggcacctttggaactgtgtgacaaatagaggctggaagaattcagaggagcaggctagaaaaggctagattactgtaaatggagcattaaggacaattctgatgaaggcatagaagacaggagctatagggaaacctaaatcttcttagggattatttaagtggttggtctcagaatgttggtagaaatatagacagtaaatgccattctgatgagctcccaattagaaatgtagaataaggtattgggaactgaaggaaaggccatccttcttacaaaatggcaaagaagttggctgaattgtgtccgtgcctgaggactatatggaagacagaattgaagagcaataaactaggatatctggtggaagaaaatttttaagtaaaattttgacagagctgtgtagctgcttttaactagttatagtaaaatgcgagtggagagaaatgatttaaagactgagtttatagctaaaaaataagaacagaaaaatttggaaaactctcagcctggctgcataaagaataaaaaagcatgttcaggagagaattctaagggtctgaccaagcaactgatcactaaagagattaatatggatagaaggaagccaagttctatttatcaagataatgagtgaatgaccccaaaggcatttcaaagatttttgaggcaagctaggaacttgagggccagatttccagagaggttcccttaaaagctcaatatttgctgcccaggtctgccatgggactctgctccctgcattctggtgcagtgctctttggctgccccaactgtggctcagttgggcctagatgtggctcaacctgctgctctggaaggtacaagctgtaaaccctggtgggtgtccacatggtgctaattctacagacatgcagattacaagagctgtggaagtttggctccctccaccaagatttcaaggactgttgtggatagcctagtggcccaggaagagatttctcacaggagtagagttactgcagagagcccccattaaagcaatacctagtggagccatgagagtggggccacttccaagatctcagaactgtagagctaccagcttgcagcatcagcctgggagaactggaggcatgagactctaacctaggagagctgctgggtggactgagcccagcagtcccacaggggtgggactgcctgaggccttaggagcccaatgcctgcctcagtatgcccaggttaattctggaactatgaggcaatgttgttttccctattaggttttggacttacttgggactagttagccctttcttcttgcttagtcctcccttttaaaatgagaatgtatacccaatacctgtcctaccattgttttttggaagcatgtaatttgcagacttcataggctcattgctagagagaaatttatctaaggatgaattatgccttgagtctcagccatatctgatttagatgagactctggactttgggcttttgagttgatgctggaatgagttaagacttttgggactgctgggatggaatgaatgtattttgcactgttagaaggacataaatttggtgagcctggagtagaattctgtggtgtgaacatagcccccaaagttcatgtgttggaaacttaatccccagtgcaacagtgttgggagatagggcctagtaagaggtggttatatcacctcttattaaagaattaatgctgttattggggagtgggctagttattgcgttattgggtgcctgatgaaagggtaagtttggcccccttccctgccctctcttatgttttcttccccttctgccttctgccgtggtatgacacagcaagaaggccctcataagatgctggcactgtgattattggacttcccagcctccagaactgtgaggaataaatttatttttttattaaatatccagtctgtatttttccattatagcaatacaaagcagacaaagacaagcgcattacctatacataaagccagcatactcttatctgaaaaaaaaaataattacttccttctaactatctagcttctagcacaggttaggaaaaatcttctttattcctgtccccatctacaataagctaaccattatctgttctatgcaggagctcttcattagaaggaaggcagtcctaaatcttgaaaagcccaggacatagcatatctgttgttccttttgcttaatatgtctgtcatgatatagcctcatttataaatttcttgtgtttcctattgcatcagctgccacactgtgtacttattcactaatttcgtaaaagacactccttatactaaaggctgtcagaaagatgatacatggttaactctcatttttcatcaggtgccacaagccagcacatgttacaatcaagggaagatggagcatccatacgtttctcttcctctggctatagagttgactgttgactgtcaactcctcacagtcacttattcattaattcatttacttgttttaaaataaaatgttttttgagtgcctgctttgtggaagcactgtgctaggtacaagagatgcaatagttgacaaggcagggatggtcctagccttaggaatttcagtttgtcacttgctactcacgttaaatttacttttaacaccattgctctcaatcactgacttctaagttgacagttacccaaagaatagatcactgagaatctctttacacctagaaatatctgtaaagacttacattacaccatcggagtctgccctatcctttaaaagctgcctttgtcagtttccatgcacaggattaagtgccttcatctttttatatatgagaaacatgactcgcaatcttatattctgcttccaattatctgaggactgcacagaagacaatgatgtggattctaatgagacacaaagacctgtgttctacttcctactattccattgcttggtactttgaaagtatttgcaccaagtaaagtgatgccttggtttcagaagcagctctaatggtggctaggggcttaaaagtctctaaaagtggctgtgcctcatgcctgggcaaaaccaggttcactgctggtgaaacaatttgtagaatattgtcattttataaaagtaagttaataagcattcatctgatggtatgtttcaaaaattctgggcatgttctccttaacatgtctcgttaaggaaaagactttctgtaaggcaaaatcgttccctgtactgagaatgtactagccatgtacactggtctaagacagatgactgatggatgagccaaaatcatagactaatatgaaaaggatgttttacagctatttatatacatatgtaattacgtataattggatgatatatttctatattagaagttatatataaagtgcaagtaagttaatgggcacgtgtatattaaattaaaatctatattagttatatattttatatttatatatttaagacatgaagagctgaacaagcagatgtttagcctgaaggaaagaacactagggggacataatagcaaagcacgtgtatttgtgaatctgtttattcaagagcagttagatttgtcctgtatggcctcaaaagcaaattagggctagtggtttgagattacgggaatggattttagctcactatgaagaaaaattttctcaaattcagatctggctagagtaagagtagtctcccctgggagacggtgagttctctttccttagatgtacttaaatataaaataattctagagagaaattcaccaggttcagtggctcatgcctataatcccagcactttaggaggctgaggtaggtggatcacttgaggtcaggagttcgagaccagcctggccaacatggtgaaaccccatctctacaaaaatacaaaaattagccaggcatggtggcgtgtacctgtaatcccagctactcaggaggcaggagaatcacttgaacccaggaggtgaaggttacagtgagcagagatcacgccactgcattccagcctgggcaatagagtgagactgtctcaaaaataaaaacaaataaataaaggaattttggagaggaatcaagcattgggaatgcagtttaaatacatggcctttaaaactattttaagcctggaaatacaggattcctgctgattctcagtttctttatttgtaaattgacaataatattacctgtcttgtcacctgcagattgttttgcagatcggaacagataatatgcgcagtgtcacaaaaatataaggaatgagtgtttctattgcaccaaaggaaattactcattaatgagtgtgaatcagatgtgactaataccacaggttattcattatcatctataagaaacattcaaattaaaacacctaaagatgcaacatgaacttgcatttttgaaactatgtttagagaaaaggatcctgactcactttaaagggacttggattactagtgaatttatttccattttgtgtttaattttagtcatttgtattaatgtcttctttttctaatatgtttaagatgatgggtgaccttacagactggtttttgttggtttattggtctgttggtctgttttgtatgtcttacattaaagaaattatggaaaaggataataatctgtcccagaaaatcctacctctgcaaataatatggcagaattaaaaccatttagagaacttaagttagatttcccagatttatgtattcacattcctataatagtttttattaaactttaaaagttacaaggtttacctgattgttatgcttcaggcagcgcacagatgtatacatgagatattatgttgttcctcttaattgctctttctgcattgaatatgttagtttgttttttcacctctgtttaaatcattacccattcatatactctacaattcctgggtgaactttgggaaaacactttgcttctctgaatgaatagcaaatgcaacacaagaccttggataagctatttaaaagtcaaataagagcctctgaagaatgaatcagtcagcagaaacattatcatggtgaaaacatttcctacttttctcagcatcatcatttattttgttttcctaaaactaattaatatattcaaaagtcaacaaaattttacttattaataatgtgcaataaacagaaacatttgccagaaagcactgcatcaggagttagaagacttggttctgatagttgctaattttgtgaccttgggagatgcattcacttccctgaaccacattttttctcatgtgttcaagagaacaaataatgatcaacccaccatatcttgaggaaggatcagtggggacaatatagataagtacacttaaattatttctgtagttcagtaatagtaagtgaaaccacctacattctttccaataataataatacctaacatttttataattctttattacacctcattgtttattatttccattttataggtgagagatctgaggttcagagggtttaaaatgatctatcaataccagtaaatggttgacccataagtcacctccactcttttgagtgaatacctgtttccctaagcccatattttatacactttggagaaacagaacagcaagccaaggagaacacagaaaaaattatggggagagaggctggttgtcagccttaataaagctcgatgctctccttacttaaatgactgtttcatgtgaccttcaactacaatagtattctaagtggagttaggaagagatttaatgggaggggggtttattgaatccattttcaatgtaatgcataaacatttagtttttctctgttaagtcaggtatcaatcgaaggcagtatttctcaacatgttaataattgtgcatgcctctcaaataagaagagttcttagacatgtttttcataatctccccttaataaaatgttaataacacaaatatacttcatgtctgtttatgttctttggccctttggagttccagaatcattatgctaagattttttcaccccaagacctaattttgtatgatgagaatacatgatggaaggctgagcaatgtatctctgcttagagaagtggcatagatgttgggagcacagcgaggctgtatcagtctgtcttgattcaaatcctagtttagccacttacctgctgtgtaaccttgctaaattacatatctgatctttgtctaaacgagcctatccgtgaagtagggattgtaagagcagcagcatcatattgttactcatataaagtgcttaggacaacactggcatttaggaagagctcaataaatgcttttttgctatattatggaatcctgatttagaaataggaaaacctgagctctaagcctgacttatctgtgtagcacagagtcaattattgctcagagcctcagtttcttcatagatacataactgatttcactcaaaactacagatcgttccaattgcagaatgtagttatagggtctcatctatttatctctacggttaagtgaacttacctatttttttctgttacttatttattaattttattttagcctacgaatttctaaaaatctctgattatattctcatagttttgtcttattgtagcctagtgacctgaacccagaatcttcatagaaaggtactgtattccacaaatatttcctttggaataataatagcagttaatgctttaaaaacattttcaagcccaatattgcactaatcctcaaaacatcttgtgatggagatatttttattcttattttgtgatgagaaaactgataccatagttaatggagtgaagtcaagctatgaggaaggaaatccaagttgtctattcctagaccgaaaatattaattaattagatatgtgcatctgtgagaagaggcttattgcccccgtgacaattttttggcattaaaaaatgcaaaaattgaaacaaagacataaagaagaaactattcatttcctgacttctattatggtatttttttttctcttcctccttgagtgcaggagctttcgacgtgacaaatgtcagcctatcgcagctatccttaggagatatccccaggttgcttggcactagtgcagtagaagtagcagtgagacagactcttggcagtcagtccatctgccttttctgttattgacttcatagttgttgagtggcaggtcttacttatcctgtagctggaagaaatattttttaaaaaacattcatttatttgatgagtatttattgagcacgaagcatatctcgggcttcattacgcaataaccatggactgtcatctcttatctgttccttgttctgtatcactgaggatgggcctcttctctgctgtcactacatttatactcattcattcattcaatgagcatttattgagtagttactatatgctaggtactagggataaagtagtaaggaaaacagtttgatcaaagttcctgccctcattccaggaggaaaggggagataagcaaggtaccttaatatatagagtatgttaaataattttcagtattaaggagaaaaataaaaaatggaagggggatgtaaaatgttgggtggggtgacattttaaatgattggccatggaaagcctcaatgtgaaggtgatttgggatcgatactggaaggaagtgagggagttagctgtggatgtctgcgagatgagcattcccagtggaaggaaagtaggtacaaaggcctgaagtgggggcatgcctgatgtgcttgaaggacaatgtgattaaagtggtgttatcaaggtggcaggaggggtggaggagtaataggagttgagttcagagaggcaataagaggtcaaaccatgtacagccttgtagttcattgcagagactttcgctttaacactgattgatatgggaagccactagaggtactgaacagaagagtgatgtgatcagatttacatgttaacatgatcattttagatgcagttttaagagtagactaaggcaaagcagagagaccaggtaagagatgctgttgacttgggctagagtaatggtagtgggaggatgagaagtcgtcaaattattgataaattttgaaagtataccctgcaagatttgatgagggaccagttgtggagtgtaagaaaaagagaaagaacaggaatgataccagggtttttgttttcagtaactagaagactagagctgtcattagcaatatgagaaacatcatgacctgtcaacatcctttctcttatatcactagatttagagtggataacttcaccaatttgaacataatggcaggatactattatagtactttatccaagagagaattctgagattggtttctattcttgagtattccatgaactagccgtatgatgtatgattcaaccacttactgtaagtctcaaatttattcatttgcaaatgagactgactcagacattatcttctctaagaagccttctttaatatcattgtccaaagagtattcatcaatgtctctactgacctacttctataccttgtataaacttctaatagtccacatattttgtgcttgatatatctgttttccttactataccatttggtcctcaattgagtcttataagtttttgcatcctgtgtacagcaacacatgatagacacttaaaatcttactttagatgatttctgaatttaatgaaaagatgaacatttgtcattgtttcatgaaattcagtgttcatagtataattttagaaaatattatagaagtaggaaggaaatattaatattattgttttgaaatatggattataccacccagagtcactttttttgtggggagagtgtggcagacaagagggacttctttttcaatgccaattcttttatccctaatagtttacattaaactagtgtagtttgatcatgctcgtgattattcttcagaagttaaacctttaacttagaaatcacatggttatctttggatttttttgctctcaattcaaaaatttacatcttataaacttaatttataagaatgtaatgtatttccaatccagtttacatttattgacttcccccccagaagaaatacatttttataataagtataaatgtagaaatagaataatgatgaaaggctcaaggcctgccactaagaaaatctacagtttgcatcatgtaatttagttatactggaaaacacataccacagtgttgcgtcatggaagagcctcaacagatgtcatttttctgtatacagacaatatcctcataatggatattgaatacatgtaaatatatgcaaaatacaaccctgattaagcatattaaaatataacttatactattgatggctaatagatatttttatttgatattgtacagctgataaatgatgatacttattgattacttacaacatacctgatatagtacttggtatttcatatttgcatctttattccacaacactataaactaaggagtatcctttccaatttttagttaaagaaagttgctgctagtgataatttcaagttttcagcccaagtctgttcccaaagcctgacatttttttcacttccaaactaccttccagagtatttcatccactgttgagagatgagatgaccaagacgtctcaaggtcaggtcaccagctgaaatccacttttcacttacttccttcattctgtctagtttagcaaacaacaagcaattattatcatgttcatgaagagtgggcttttttgtactaatattttcagggctagtcttggtgatggaagctgtattctgtgactatattgactgaacttgaatacttgctaacaaatatagtagtgggattcatcgggtctcaaagttgcttttaccctatttgcaagttagcctgtcactgcttcatggatgaccacaaagagctttattcctggtggcttgataggcagcatgaccctcagcctaagtccttgcttctggcctccatatctcacagggatgatcttgatggaagctatacttacaaaagaatattgagctttagaaatccactcattttattgtaagcagtaagcaaacctgctctttgtctggaagggtgacattatctcattaatcaagattgttcctggcaaatacactctgagaagtggccagggaaagaaaagccaaggccttacttacatgctttgcactcctaatgagatgtgtaggagcacaagacatccatggaggatatctctccccactggattcttgtatttctgaacttcaagaatctaatctttcttagagacaatgttgacaaattagtaaaaccataatttcaagtatccaaattgtaccaatggaagatagtaacgttttgctaattatttctttgtgtttagatattaatcccaaatggcctgggtgattaaattaggttaaagtatgagggaaaagtatgtttagagctagaaagagagtgacagagatggagatggatggataaatttttgatccattagtctgtggtggtaatgattatgggaatgagacaggaagacaggaagataagtagcattgtgtatttattcattctttatctatttaatgataaatgtttgtccaacaccagcccccattctaggtcttggagagaacagccatggacaagaccaacaaggtcttcaccctcaaggagcttacattttaatgagtatagtaaggaaacaaacatgcaaacagtaaataggatcagaaagtgacaagtgctatgaagaaaactaaacaatttttgagtttactttagttaccatgttcccagaagacttctctgaggtgccaacatttgagcgagtatgtgattattagaagatagctatacatatactacatccacacacacacacaaaaaacaacaacacttcaggatgagtaagtattctgggccaaaggaatacatagtcaaagactgtaaagcagaagtaagctgggtatgtttgaaggagaacaagtatgtcaacgtggtggaaagagagtgaacaagggtaagattaagagaccatggagaaaaaatattagtcaaggggatggtcaggtagtatctttggggaagtcatggtaaggaattttgtttgtcactgaaagttttaaattatgatgtgatatatttggatttatggttaatatgggctacactggctccttatggcttggattgtggaacggattgcagttggacaagaaagaacacagagagtctaataatgtttgcagaacttgagccaagagaaagtacattttagggattacttcgtcatgagagacaaaaatatattgaagttagttgaaacagcaaagaatttatcgtaaggaagatagctcatgaaaatcaagggcagaaaggtagtcagtcgccataagaaactgactacatattccttttgcctagaatacttactcatcctgaagtgttgttgtggtcattgtttgtttgtgtgttgttgttgttgttgttgttgttgtgtgtgtgtgtagtatatgtatagctatcttctaataattacatattcattcaaatgttaacacctcagagaagtcttctgtgaacatgataaccaaagtcaacagaaagctatcaggaaccaagggattcattcgtattcatactctctttctcgtcctctttccctccctcccttcttgcctatagactttctctgctttggtaatctatggccaaccagaagttcttcagctccactttacgtaatttcccagtttgaatgcatgagaatggttacatatcttctctgaatctatgttcaaatttcactgaagaaactcttcacttgatttgccctgggccatatgtctacttctgatccaattggtcagaaatgagctgagctagaatacttaaattgggatggcaggagctgtgagagcacagttatacatacaagagcatgtacagtattggcttatagctcaattaatttctgcctcagctatagaaatataaaggaacaaatgtgttggctgttagtagacttgaatgcttggctagggttgacagaaagtaacaggttttgagtaagcagcacaatttagtcaagtaaatgggcagcttgtgattaacagtgtcagtatcatgagttgtataaattagggatcctcaaggtctcccttggtgttcccacatgtagaaaggttaaaacaaaagtgatattcaaaaacaggcaacagatatatcttacgatatgttggtaaagcctgaaataggcatctggagtgacaagggtaaaatcaggttgcagtaataaagaagttggtcagacaggtctgtagacctcattgaagaaggtgagtttaagcaaaggtgcaaatgaagtgaaacaaaggcatgaatgaaagacacaaatgaatctgcgaaacaggtatctgtgggggaagcattttaggcagggcaagtaggtagaacaaaaccccttaggtaggaatatacttgatcagtttggggagcagcaaagaagccagagtggctacagtgcaatgagttagtgaaagaatagtaagaaagaaagtcagtgaggtaatggagttggaggaagtatctcgtgattggcctgtaggctccctggactttggttatttttcagagcaaaggatagtcattgcaggactttgagcagaagacatcatctgtaaatactaaattttctcatataaacctattaaaagtacatacatcctatgaagtttgtatattaaaaaccagaagatgcactaccagaaaaatataatggaaaccattcttccagttatttccgtattttgaatgtagagctaagttttggtggcagattggaggtgagtgtgaataaaagaaggaaatcaagaataagtccgagtattttggcctgagcaactgaaaaaatggacttgccaccaaccaagatgggaaagactggggggtagaatagttggagggaaataaaagtttagtttggacatgtgaaccttgtgatgtcctttaggtgtccaaatggagatgccaataggtttttgagaattttggagagatctggtctggagatagaagtttggaaattgtttgcatataaatggtatttaaagccatggcttcactgaggcagtaagtgtagatagaaaagagaaggccaaagattgctctggggcatccaacattaataggtcagggagaagaggtggatctagcaaaagagactgagaagaagtgatcagtgaggtatgaaaagacatatgagtgtgacatcttagacattaagtgaaggaagggtatgaaggaagagggactgataaactgtgccatctgctaaggtaagcactgataactgaccattaggtttagcaatggtgattgctgaccattggaggtcattgctgaccttgatgtgggcagttttggtggtatggtaaagtgaaaacttgaccagggtggatttaaaagagaatgaaagagaattagagacaataaatatgagtccatgcttttgaggtgttttttggcaaaggaggcacagaaatgggactgtagtggctggggaagtgggatcaaaagaaagtatttatgagagtaaaaacagcatgtttatatgctgatattaacagtttagtagaaagggaagggtggattatagaggagagaggggaaattattagagcaatgggcttgaatagatgataagaaatattatctagtacataagtagacgattaataattttaatattaataattagcaataatttatctgggaaagtgtttctctattaattgcttagagagtttttcatcactgctcaaaaaccttttgtagcagcccattgcctattcaatccagcctaggaacctcagcccagcaggcaagatggttgtactctgacctcagtgtaccttactggcttcatttccttcagttctccctcctgtgcctaagttaaagaactttcacattaatctttgtttctttgtgtattgcatgcgatagactaggttattcagtaaccatagacctggtgctgaagctacaatacagctagattgcattctagattgttcccaatgttgttcccatgttcaaggatctcatgtatataaggcagcataccaagctagtgcttctgattttaaagtaataagagatttttttaaaatttgctctgaaggcaattctgaaagataagtttcaaaaatatttgaaacaacaacataatcactggggcattttcacgctacgtgcttttttttggtctttaccattttattttgaaataattttagacttagaggaaagttacaaaagtagtcacagcattgacgtatgtcctttaccctgcttcacctagtgttaatatcttacattaccatagttcaattattgaaatctggaaattgttatcgatgaaatactgttaattaatttaccaaccctaagtaattccattagtttttccactactgtcttttgtgtggattaggatctgattcaggatcagtttgttgttatgtctctttagtatcccctaatctgtgtcagtctttccttatcatccatgacgttcccattttcaaagagtaagggtcagttattttaaagaacgtttgagtgatgtttccacatcacgggattcaggatatgtaggagaatactctctggaatatatgagccaggatgcatttgtgcaaaaagtagtaatatgttataggcaaacaatataatcttaaagaccacattttaacagtttggggctggtttttttccccagtttaaatctactgaggatttcctattcacaaataaaaaggtgactcagtaaatcaagcaaaaaatgcttgagagtatgaagtaaaaacatactgttacgtgcttcaggaaatacaaggaaatatatgacataatcctttacttcaaatactgtacagtcaggctatggtgacaagacatagagaatatgttcattgttaatgaatttcttcactattaaaatgtatatgcacaaaagtttaaatgaaaagcattttaacagacaaatttactgctacagtaaaaggtatgtctacatgcagacaacttgctatcccatgcttaggtaaaggaagagacttatgcaattaaattacattattctgtcatccgtgtcactccagtcttttttctttctaatgttaatatccacacttgccctccatgtaaatatcagtgtccagtggttctatttctcaggaatttctctttgttaagccagagtaatcagtagtctcactccctatggtcttttagtctggactacaggtgactaaatttttacagctgttcttcttaaccttatactcttgagttttttgttttgttggttgtttttccctaacagtaagccatgttgcaaacttcctaaccagtttctccatcattctttttttccccagcattacccaaattatacattacttgtatgtagtataaaatctgcctttcactgcctttcagttgagtttaccataaaacgtttgactaggaaggatataaaaatttgtttacactatttggaaaaggagagaaaattctctgaatggggtaagtggattcttggttggaagctcatgttggataaaatgaccactcaagtgtttttttcagctctaagtcaggatggaacttaatggcacagcacaaatcggctgttgccacaactgggcaactggaaaatgccttttgatgatggtgattaaataaaggtcaaagaatatcactgcatcctaatggtagtcatcacacaacatcagcctttctcctggtgcctttgaaaatgtcacttgaaaagtctaaaaaatgctatgtgttttgtttaggcagaaaatgccctcattaagtacctcatgttttcgttagaaaaatcaaagaaatgttagggttctgagtactagattgtaggtttaaaagaaaattaaatgtaaccttttgttatgtaaaataataaactcctaaagtaaccataaaggctttatttttacacaaagcgtatgtctgttttctaaaaggctctaaaaagagccatgtgatatgatctcaaatctataggatgaaaaaacccacgttactgaagtagtagttaaccgtgaataatttctagtggaaagtgaagatttcttaagagagttattttcattttttaaggtatgaacttgagcatttgcggtcttgtcagggacagtagttttagttttgcctactcagtactcttaagaaaaatcagatacggagcctcattttctttcatattctgtctattcctctttttttttttgccaccattataagtactatagcccttatcaatggaaggcagaaaggatgtccaatttaaaagcaaaagtttacttagttgtactatgctatcatgaatctagttatatattatatatattatatataatatatgtattgtatatttatacacacacacacacacacacacacacacacacacacacacacagtatttcatgtaaatttcatgctaatgttcccttaggactgacaatatgtggactacgtaatctaaagttttgtttttttttttaatttaccaggtaaattgacatccccatgtgacaggggtaaatcttatttctcaaagtatgcttggaagtcatgagctttcgaatgtctgatcatgaacagcagcatactactggatgtgtagcttccagtgtctaggagggtttatggtaatctaaagaagcacattttaaagagatgcctatgtacattcaagtatgagaagtatttctttagattacagtgttttgggatacaaacactggaggtgaattacctgagagtaatatataaactccaataatctcaagaaggtatgtcaagggtagacaaatgatagctgcaattctaaatctggcctattgactatttttgtatggccttcaacctaagaatagtttgtactttgtaaaaagttgaaaaaaaaacaaaagaatattttgtgacacatgaaaactacataaaatttaaatttctgtgttcataaatgaagttttattagaacacagccatactcatttgtgtattatcaatggctgcttttgtgctacgtcagcagaggtgagtagttgtgacagagaccccatggtctgcaaagctgaaaatatttactatctatccctttccagaaaagcttttccaacccttgagcaagatgattttattcaattacttagattctctgtgcttcagtttcttcatctgcaaaatgaagataataaactgtacctatttcatagaatttttataagagaatgaagaggcagtatagtgtaatgatcacagacatagattctggaacccaaactgtctgagtttaaatcttggtcctctgtttaatagcttttggcctaggcaagttacataacatttctgtgcctgtttccttatctacaaaataaggaaaatatagtactagtacctacctcataggatttctgtaaaatcaaatgagttaacataggtgactcttgtacagttgacccttgaacagtgtaggagttagcggtgccaatctcccacacagtcaaaatccatgtaagacttttgactccccttaaaacttaactaatagcctactgctggccagaagccttacttataacataaatagtccattaccacatattttgtacattatatgtattatatactgtattcttacaataaagtaagctaaatgaaagaaaaatgtttacgaatatctaaaaaagagaaaatatatttaatatttattaagtggaagtggatcaacctaaaggtcttcatccttgtcttcacattgagtaggctgaggaggaggaggaagaggtggggttggttttactgtctcatgcgtggcagaggcagaagaggtggaggaggtggaaggggaggcaggagaggcaggcatacttggtataactttctggaaatatatcatagtttctgtctgatgttttttactttttcagtctctaaaaatgtttctgtactgtactgtaccaatccttcttccactgtttgctttagtttcagtgcccatatcttatgagtccattttgaaaatgaatcaaagaagtcttgaataattggaacccttctgccagattttctaatgtcagtttgttttctggcattgcttttcttatgccttcttcctcattgtctggcactggttcgaaagcactcatctccatcaagttgtcttctgttaattcctgtcttgtggtattgattagctctttcatttcttcaagattcatcccatgaaaccctttatttctcacctttctttttttgccatatccacaatctctttcatgagttctttgattggctctgtcataaattctatagagttgtgcacaccctctgaacacagtttaatccaggatgaatttcttgctttgggctttatggctttcacagctttttctataacaatgatggtagcttcaatggtgcagtccttccggattttcttgacattctctttatcagttttctcttgcataacactgacaactctttccatagagtactgtgtgtaatgaaatttaaaggtccttatgaccttctgatctagaggctgaattagagatgttgtgtttgggagcaagtagagcatcttcagttgaactcatggaggtctgggtggccaggagcattttccgataccaaaagaacttttaaaaagcagtccctttctggcaagatacttcttgaattcaataactcaaagcgttgatgaacccaatcaagataaagggttatcgttgtccagaccttcctgttgtgcagccaaaagactggtagctgatgtctatcatttcccttcaaggttcagaggttagcagctttatagataaaggcagtcctgattataaacctgactgcatttccacaaaatggtagagttagcctaacccttcctgcctttaatcctggtgctcacttctctttctcactaataaatgtcctttgtggcatttttccccccagaatagggcactttcatctgcactaaaaaaactgttcaggcagatatcctttctctagtgattttcttaatggcgtctgggaacttgtctgctgcctgttggtcagcagaagctgtttctcctgttgtcctgacattttaaagccaaacctcttgctaaaattatcaaactgtcctttcccggcacctcagttctccaactttagattcttcaccctccttttcctttaatttgtcatataatggcttttctttttctggaatcctatttgagtctgtagctatgcctttcttatagcaatattgtgcccacatgaaagcctcgaggcattttgcaaagtgcagtgtttctgtgtttgccaacagagctgcagccacgactacacaaattttcttttctcttttcacaatggtccctatgctggattcacttatcctgaaatggtgggcaacccagctgcagacctcaatctacagtacatatcaagcaattaaacttctccttgtaatgtcatgacttttctctgcttcttgggagcacttcagcatcactaattacactttatatgggtcctgtggtgttattcacagtttacggtattgtaccaaacatgatgaaaagtacactagaaccatgagaaatcactttttccctgtgacatgtaatttactggagagacagactgctcacacagagacgattaccatctcatggtgttttaaggcatactcaatacttgcaacacttgagctcaccacaataacaacaggaggtgggtacaaaattattatagtagtacagtacatacatgtattactgttaattttatgcagttatgattgaatactgcatctttatgtttgtttacttttctctagactttgaatggctctgtgtagggtcttcaagtgtgtaagttttaataaatttcaacttttataatagatggtgtatattttatggtaataaatgataaaatagactagtatctaaacatattttatgcatttgtgacatacctttttatttttttcaatatttctaggttacaaagttcatctacaagtttttttaaattatcacaaatctccaaaatattttccagtacatttattttttaaaattcacatgtacctggattctcacagttcaaatccatgttgttcaaaggtcatctgtagtgtctggctttaatagtgtaatttttttattattggtgatagtattgtgattgttttcatctacctcacaagattattataagaattaaatgtgataattcatgtgaaacttagggctcaataaatattagctgttattgtttgttattgatgagacacatttccagctgtaatgtacaggtgtatctgtgattctcatgttgactggggattggatggctgtcagaataaaagggagtaaaagggaagtaaatttaaaggccttccatatgattgatacaatatttattcctacatttaaaatcatcggtgacactgaccttaacttgacagtaattattaactagtgctagtgtccttattgaccttgttatataaatagttgagaatagtttattatcagtgtgcgaattttatgtaactggtcattctacaaagattgagtgtgactgaaggagtccttaactttttgtgtttatatcattatttcacaaagcacactatccttaatatattaaaaaaaataaactgataagccttctagccaaattgccgtgaattcaaaattactggagtcaaagtagattactttttattgtattatatattttaggccatctcaaatcaccagaagttgacaaagattacattttaattcacacttgcaaagtagaataaaagggcaataaaaaaatctcatggttgaattcttttgtgtcagaatagtaagtaaggaagttcttggcaaagagagtaactatataaaaaaggatgaagtgaagtgcttggctggtagagaattttttgtttagagataaatactggacttagttaaatccagaaaaacagaatattttaggatgacagttgggtaagttagagtgagatgtcaatgcctttgaggtaatcattaaatttaacataatacgtatgattaattctaaaaaataatttgtactattatttaatttttcctactgcttgcttttcattataaacccattatgaactttagcagtaagaaaaggttttcctgcaagcaagatttaaaaattagaataggtttctaagaaaaattggacagtgtgtatatacgtatatgtgattgtgtgtgtatactttgttataaagtaggaaattaaatttaactacatttaaatagtctatgatagtttgtttcttatccaattctcttccagtcccatacttttgataattcatagatatcctccattaaatactatagcaattcaatacccagaggagaaaaagtgtgacttcctcagaggagaaaaagtgtgacttttcaataggttgtttcacttttacaattccatcctaactaaatactacattaacataaaaaactacaacaacaataattagctttttggatctaaatattggcctaaatatttagaataatacagtgttagtatctgtcttatattgtctgtttctctaggattgtgcctgtttaaactacttttggaaattagtaccaacctaatgctgttaataattatgcatgccatcatgtcatgatacctaatggaatcataagttaaagtctttcattcaattcccattaacatagtctatgcactgtctcatctacctaataagtctttattgccttctgtagtataactttggattttctctactgctaataggaaacaattacttccactaaattcacttacactgttgcattgtataattccagagagcactattgcatcattgctccccaccccaatccccctggtactgtgcagtacacagcctgcctgaccatccacagcagccatgacattgctttctttgcacaagcacagaggaatacaatttgaggtatttatgtttactatttagagacagacaattaattgacataggatttacataaactagcattttcataaagatccagaatttgataacatgacttagttaatataaatttaatcaatattcacatctgttttattctttggcagttcatagttattcctaaagtggaagcggcacttgggaatataaagatttggactttataatttactctccaaaagattatagagtttttactttgatttaaggaacaaacgtgaaagactttactggaatgtaaatagttttggcatatttacagtgcaatgttttcagttgtgaagttggttagttatgtaggcgggagctgtaggagttgtgatagtcagtatattacaagcattttgcaactccctgatttctctatgtttttaacaactatggtagcaatgcctcaaatttctgggatcctctgttaccccacagtggttccaaaagaactgattactttttcattaatcctcaagctatatgtgataaataattgggaggatggaaagatgatggaaaagaggaaaaaccttgaaagatcaactgattttgttaataccacacaccaatatgcagacccagctctgatctcttttttttctgcattgtgatatttgtccaattatcttgcttctaaaattcaaacctattatagccatttcattttctgcattttttctcatttcagtgtaaaggccttgtgggagaaggttttactttagtctttaacttggcatatggaaaaatattaactgctatgtgtataataattctcctttttttccttaaaatgctatttcctttgtactactaatgtactttgattggttgactggatattgagtgttaaactatagaagtatttcagaccacttgagtgatagctttgcttcattctttcgtgtgtttctatatggttttataaactagataatgctacacaataagggtttactgtgagccctcagtaaacccttattttgtagcatagcaaaatgtgctccaacaatgggggaggtatctggctttatgcatcccttccgccaatcaccagccatgtaaatttatacagtcacataagatttctgagccttaaattcctcatagaaataaaaaatacctgccttgcctatctcacaaaagtttgtgtggatcaaattatttaatgtacatgaaaaaactctttagaccaataaaatgtcatatgaatccaaggaagagaatgattgaatacttctcaaatgaattaaggtgacagttatcatataaaaacttcattgcttcaggtcactgagtaaaaataaattggtaactctgactcctacgtaactatccccagcactgttaggacagtgtatggcttaccaagtaaataaagaaaaccaggtaatagctagaactaagcaagaataatgaggtggataacagtagcctctcatttctttgaaaaatttatgttgtgctgatcataagacaggcaagtgctttagtaaaacatactcagatcttagaatcttaaatagttgggccgttgtcacacataagacccttaatgttacagactggagattgaatgggaaggccttaccatgaagctgtataacatggttttctgctacctacttaattcggcatgttaaatttaaacaaataagcttttagaaaatcatactaaagagtttcaacaataaagagaggctgactctcagaaatataagacaaccagatacagaaggcttttcaatattgattttttaaacataagaaaactttctaaggccatattaaatggttctccaataaagtgttttaatagctccagtaagaacatctgactggctgctttctatgtgagcaggacttgattgaaattgaggaaaagatgaagcatctttaagctagagagcccggagggtaaattattaaaatgagctatggagaattggggagagcttgcactcaaatttagtttttgagaaggaaaagtacaaatcattctatacatggaccaactcaattttgccacctgttactttaaaattttaacctgttttactttgaaaacaatgctaaaacataacttgatggactcatagtttgattcctactaggtcgatattgtgtctcagaattaaattgtccattaatttttattgtattctgtagcatcttccacctaatagtgatgcaaatgaattatgggtagatgaagtaattctaattttcctatatacttataattctcttgggcttccatgagcagaatatgtaagataatacatttgagatactgttatcagaaaattggggataggagagtacacatgaaaaaatgacatgtacatagtattcaaggatgccttcattcattcattaaacagacatttattgggtgccaaatctgagacagaccccttgctggtttgcatttaaatatatcgtgggtatttaatgaggaaaaaggtatgaaattgccaaaacaacttagagtaagtaacatcaagctgccctcatggcctttctatacttccgcatcttggtggaggaagtattagtgataggggctgtgaagggctgtggtatgggcatgcctgctccaagcccccagattatctggcagaaaagaacgaagagcaagaattaaaagccctccccaagggatccattcaagtaaatgttttagcaatgagtgagtgagatgatgaggcagtgtgggatattgggaagaacaagagttaggaactgggggaaaaaaaaaaaaggctcaaatcccatccatggcccctgcaaagctctgtgatgttgagagagttacatcgattttctgaacgactatttcttcattatgaaatggagtttaaaaaatacctactactcaagcttgcacacagtgtcccgcatagtttttggcccatggtaagtaattaataaatatgatgtaattaataaatatgactttccttattactgtattgacacaacaatatcagtagtatagtttgatgagcatcagatatccatagacttaaataacagacaaaatacatctccttcatctatcttattaactgtagaatttcttttcactcattttgattcaaattaagtatggaccatctgttccaggcttcaaaaactctttcaaatgagcagtggttttacacatgtcatgatgtgtaaaaatttagatcaatttttttagtaatgagtacagagtgtcttaccagatatcatttcctaaacacttagttgtatgagctttaagttactatgaagataaaataatcttcacagttaatgacaccgaacatgtgaaagtgctttgaaaattgtcaggcaatatcctaggtcacttggtcatctgactccataggaaaatatggcagcaacagcttgctctaaccattaggggaaaagaaatacaatataccaataggtatattggtatattggatattgtaaagcaaatatcatgcttcacagtagtcagctgagaatgattcacaggcaagctttgacttgaggttatgggcatttctatacaaaagaaagtgtcagtcagtagagagttagtagcaatgaaaagacaaaatggcaactttgtgagggacgcttgacctctagtgccatctggagtgggggacagggtggatatgaccatttaaacatgattgaatttagaaagtatttcctgataatgtcattattaggaaatactttaatgtagccattaaaaccatccacttaactgggctcggtggcatgtacctgtaatcccagctgtttgggaagctgaggcaggaggattgcttgagcctagaagtttgaggcaagcctgagtgagacctcatctcaaagcaaacaaaaaatccacttaaccccatctgcaccaagaagtttccgattataatatagttatgaattattagtttgcatatggtccaatgaagtatctggtccacttgaaaacatttctatttataaattaatgacttggcattgtgatcttaatgtattagtcttatggtaatttgattatatgcagattttctcccatggatgaacaaccaaatttccaagcccacagagttgaggaacagattctgagaaatagtgatgtcattataagctaagggagactatctggggaaccaacctcccccagataaccttgctgaaaaccttctcattcaaaatgaagctattatatcctagactcaaataaaatgattgaatgtacatttgattttgaagaactcagcccaagggaatttgaatcacttgttagtctctcactctgtttgtaaaaatgtatgactaggaaatctagattcccttgggtatggtgatgatttctgaggtacaacactaatgacatgatccaaggaagaaaaaaaatgataagctgaactttattaaaatagaaaaatgtctgctctgtgaaagacattgtcaagagaatcaaaagatgagccaaagactgggagaaaatatttgcaaaagacatacctggtagaggacctttatccaagatatgcaaaatgctcttaaaactcaagtataaggaaaaaataggacaactatagttaacaattattgtttatttcaaaataacaaaaagagtagaattgcaatgtttctaccataaagaaatgataaatgcttgaggtgatggatagcccagttgccctgaattgatcattacacattgtatatgtgtaccaaaatatcacatgcgctccataaacatgtattaatacaactattatgtattcataataattaaaatcttttaagaaagcaaacaaaagaaataaaataaaccaattaaaaatgggtcaaagatcttaacaccacactaaataaaatatacagatggcaaataagcatatgaaaagacgcttcatatcatatgtcatcaaggaaatgcaaattaaaataatactgagataccactacacacctattagaatggccaaagtccagaacactgacactaccaaatgctgacaaggatgtgtgacaacaggaactctcattcattgctaatggaaatgcaaaatggtacagccactttgggggacagtttggtgtttttttaaaaacaaaaacaaaaacaaaaaaaaactaaacatatacttaccacatgacccagcaatcacactccttggtatttatccaaatgaattctcacagaaacctacctactgatatttaaagcagctatatttataattatcaaaatttggaagcaaccaagatatccttcagtagataaatggataaataaactgtaatacagccaaacaatggaatattactcagcactaataaaagagctctcgagccatgaaaagatagggaggaaacttaaattcatattgctaaagaagccaatctgaaaagactacctactgtatgattgaaactatatgacatttgaaaaaggtaaaactatggatacaacaaaaaaatccattgttaccaggggttcaaaggagagagagataaacaggtagagcatggataatttttagggtagtgaaaatactctgtatgatactacaatgttggatacacatcactatacattcttccaaacccatagatgttcaagagcaagagtgaatcctaatgtaaactatggactttgcattattatgatgtgttagtataagtttatcaagtgtaacaaatgtaacattcttatctccccctaaatgttcagcctctttagtagaagagccatgcctcacttagtttttgttttgtaggacctagagcagagcactcaataaatgttttttagttcatttatcaaatagttattccattgattaatcaagcaaaagaaaactgttcacctatttcagagtgttagtctcagccatttgttttatacatttcaaagaaatgttacttaccatatggtccagcaatctcattactaggtatataggcaaaggatgcgaaatcagtatgtcaaagagatatctgcacttacatatttaatatggcactatttacaatagctaagatatgatctatcaatggatgaatggatggagaaaatgaggtatatatacatgatggaatacaattcagcctttaaaaagaaggaaatcctgctatttgggataacatggatgaacctggaggacattatgttaagtgaaataagccaggcacaaaaagacaaatttgcacagtgtcactgatatgtggaacctaaaaaagttgatctcataggagcagagaaaagaatggtggttaccaacagctgggacagagggggtgggggtggagtttgaggagatattgttcaaaggatacaaattttttattagacaggaggagtaagttcaagagatctattgtacaacatggtgactataattaataatatactgtattcttaaaaatgctaagagagtagattatatgtgttctattacaaaatcacgagatatgtgaagtaatacatgtgttaattctcctgatttagccattccacaaggtatagttgttttaaaacatcatgtagtacatggtaattatgtaaaattttatctgtgattttttaaaaaataaaataaaacatttttaaaagaaatgttacattacaacctctaattgcttccacttttacatttagctaatttcacaagctgcacgccatgtttcaaattggttttcttctagcaaattgtgcatgtgtgtattctctcagatatgaccttccaggttttagagtccactatgtcaagaagtaagacatattaaggaatctgatcttggtaaaaatttccagagtctacctacttgtcttttctaaatttgtttaatcagatggaataaattagagaaaaatactggtcgttttgtgaatttttaacaattcctttgtcttttttgcagtatttcaattacataagtagtaaaatttgtgtttatatgttaagttgcctgaaactgtggaaaatagacctatttttatttatattaagagtttttgagatttcttgtttcaattttcatttatattcctgtttaatttacatgcataaaatgactcttttcgtcttgtcatttgttatttaggaagaagtaaaatttgtgggtttccagtatagtacagcagttaaattcatatgcagagtaacttactgaaatgacaaggtagatgttattgtattataataagttataataattatatggtaataataccttcaacatcaatgtagtttttaacctgaaaaattttgaagttcaacgaaacaacagctttgggtaatagtgggtaaatatcccaaatattgtgaggccttccttgaatattaatccagacacttttttttttttttttttttgagacagtgtctcactctgtcacccaggctggagagcagtggcaggatctcagctcactgcaaacttcacctcccgggttcaagcgattctcctgcttcagcctctggagtagctgggattacaggtgtgtgctaccacgcccagctaatttttgtatttttagtagagacggggtttcaccatgttggccaggctagtctcgaactcctgacctcaggtgatctgcccgcctcggcctcccaaagttctgggattacagatgtgagccaccactccctgatctaaaccaggtatttcttttttttttttttttatgctgtttattttttaatttttatggatacataacaattgtacatatttatgggatacatgtgatattttgttttttttattatactttaaattttagggtacatgtgcacattgtgcaggttagttacatatgtatacatgtgccatgctggtgcgctgcacccactaactcgtcatctagcattaggtatatctcccgatgctatccctccccaccccccaaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttctggctgcatagtattccatggtgtatatgtgccacattttcttaatccagtctatcattgttggacatttgggttggttccaagtctttgctattgtgaataatgccgcaataaacatacgtatgcatgtgtctttagagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagttttcctatttctccacatcctctccagcacctcttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctttttagtttaattagatcccatttgtcaattttgtcttttgttgccattgcttttggtgttttagacatgaagtccttgcccatggctatgtcctgaatggtaatgcctagattttattctagggattttatggttttaggtctaacatttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagttatgtggcattatttctgagggctctgttctgttccattgatctatatctctgttttggtaccagtaccatgctgttttggttactgtagccttgtagtatagtttgaagtcaggtagtgtgatacctccagctttgttcttttggcttagtattgacttggggatgcgggctcttttttggttccatatgaactttaaagtagttttttccaattctgtgaagaaagtcattggtagcttgatagggatggcattgaatctgtaaattaccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttaaccaggtatttctaatgctgctgtgtgatttggcagagacgggataagccctgagagagcacaccccagcagtaccctcacttgggtgagtttgagcaattgccaggaaagctcagcattgtaagttttcccaggagatagatttcctttaataactatgatatgtgccaaaaatacaaacatttgatattagtgtatctgacatatatcatatcttatatgtagtagatactaagtaaatatttattggttgcttgattttgccattttgaggactgtattgatatgtttggaatattaaataaattagtgatgatatagacaacacaaaatatttatatgtattaagggaattgttctgatatggtttttaaaaaaatttcaaaaactatttcattttttgaaatagtcttctgtacttatcatgtttagttttatgaaaaatacttgcattctgttggcttgagttttgtgggctttattaacaagggattcttagtccttttatgtgctgtgattttgggaaaataatttaaccttttctactgcatatatttctcacctatcacataacttttttcctgtacataaggtgatcatataatttttgtccagattgaaatagttcagagagaatgaagtattattaaaaattataccaggacaactggcttaaattaaaccatcccaggcaaattggaatgtgggatcacccaaccatagccccattttcattaaataccacaaatctttattgagtactgttatttccaagacattgtgtttcagaccacagatttttaaaaaggaatacctttccccttcaccagccatcttcgccaccagccagcagtgttctgctttgatgtagtattttatttgtttttctttcaacaatacgttacctgcttaaagtatttgaaagccactgatggattagagtgcaggaatatggtcagtgtcatgagagagatttaaaatgctatgataaacagaggtaaaggaaagcatgtcttgtggaaggtaggaggatgcggtatttgattgattgattgattgattgattgatttttgagatggagtctcactctgctgcctaggctggagtgcagcagcatgatcttggctcactgcaacctccgtctcccaggttcaagctattctcctgcctcagcctccctagtagctgggactacaggcctgcgccaccacacccagctaattttgtgtgtgcatatttttagggaagatggggtttcaccatattggccagactgatctcgaacccccaatctcaaatgatcctcctgcctcggtctcccaaagtgctgagattacaggaatgagccactgaacccagctggatgcactattttaaaagagtgctttttaggatgatccttgagggatggtgagaaggactgaagatggaaatgtaagtgggcaagcaccccggggaaatatctctggccaagagtaagccttctattctgtcaccttggcttggaaagcacaagagaaggataagatggatttggcgtgtttagcgtgtgtggaggggggagctgtaggagataatgccctatagcattatggagggttggtgagccaatctgagggatatatacatttatatatttatatgatttatttgttattaaacaaatgatagtgctcagccccttcgcttgtcctgggtgtcctatctgcctttatactgactagtgtaatctcaatctggggttatcattcatttccctctgctcttttcagatctgcttcctcgacgctccgctcaatatgcaggcatcctgatttctactgacttgcaatgtgatagtcacagactttctcttgtctgcctcctttctgggaggagttatctctgccaatcttacttagatactggccttgctttcctttctttttcattttcttctgacttctaatttatctttgttcttccatgagtattcctctcaacagtttttagttgacattttatttcatttaacacacctgtaattaatatgtatgtgcagacaaacatattcatttgcctacagacaaacacatacatatacccatacaccagtgtgagcatgttgtttttccttgtttttaagtaacctttattttcacattttaactaatctgaaatagaactcttttaaccaatacataccattaatgtggtgatatatctcatcttcctaatccccataaaaacttcctatatgatctgtggcattttagaagtgtgcaaatattggtagtgtgaaatttctagttttcaagcctgtgaaagcaagcagtggctagttgaattatgtgtcacacactttgatacacttctgccgggtgaggaccagcaatatggtggttagaagaaccacctccaggggcacatggtctgctcctaatgtgtgtgacttctggcaattgtgtcaacctcatgtgcttcatttctttcctgtaaaatgaagctaggaatgagaaattcataggtatcaattgaggtggtttacgtgagtgtttagatcaatgcttaacacatgctaagttatctttgtcacctttagtatgttacctctcaatttaacaatgaaaaataaatgaaaaaaacaaaagtgatataaaatgctatctggctatattttattggacacaccagaggttctcaaactttctgggtttatccttatctcagaattttgtatggggcccccaaactaaaataaatacctaacattttgtgtatgaaataattaggtccagacaactgaaagataacttttgcctgatgtccatctgatatcaatgtgttttctttgaaaatttaaaattcccctgataccctgaggtgcctgggtcacagtttgggaatgacagaggaactcatttgttcagctcttactttctgactgctatttaactcatccaactttcagcaagtgctatgtgttgctaattcatgacttccctgtctccaaaacattttgatctctttagatagttagctcagaaggccctcagatgaaaactttaaaaagaaagctaaaacttcgggtaaagtgttgttttgtgtccaatagcctcagagaatctaaagcaaaatgggaggaaaataagagactaaattctcagtgtgttcactatatcagttacagttgcccttaaaacctgggaatacctgcttttatggttctctgaggttctttggcaggcgtaccaagtaggagctacttgaaggtcacctgcacaatgatgtgtgtaaaaggaatgtcttatgtttaccattcccccctccaggctctggaaacagacagcaatataacattaacattgtctgcttactgtctttcagatcctttacaagcttttaagttactgtctacaggtatttggggtataagaagctgattaggtctttgggataagaagctatgcctcatacaccttaaactctcaggccaattaacctctcaaatagtatatgttccatattaatgcttaccaaattgtgttaagacttcaacgaactttcaccagtccagaatcctaaataggagggtctgtgtttatgaagatctgggggatagacagggacacaagcctttatatatgaactgatgttaaaaaatattttttttctaaaatgcattgtggattttcccacattctggaaagctgtagttatatgtacagaagtacctggagtagaccttcaggctaggagacttttttttaaaaaaattgaactagtattcatagtaaatttttctaaaatgcattataaattattatacattcttaaatgctacagctacagctatatgggtagctaactggtggggaccttttgggttaagcaatgttgcaactatattacaatttagagaaaagctattttagcctgcagaaccatattgcttgacatgcagatgttagcatgctgcctctgtcgggttccagtatgcatttgtcatatacctgtattccctgcaggtgtcttctcattcctccttgttttcctttgagtgtcctccttttatctcttaccttttcccttcttaactcattttacacactttgttaccaccatagccaagaccatggtctatggaccatctgaaaccagacgggcctgggagcctatttaaaatgcactcccaccaaatcagaacctctgaggatgggccccaggaataagcagtgtaattaacttcccgtttgattctttcatgcttatattaactaacaatgtcgggccacactgaattctccatttgaaaaaaatacgtttttgctcttttgggactctctacacatgaatgtgtttctctcccttcctgagatttcactatcttcccaagccatgcttatgtcttctgggggcttaggatcggctaattgaatatcaaggttatacttgtttacattctacatttatatttatggttattataagagaggatattgaaagaaaaatggagctgggaatgaaggctaatttagtattacattaccaaaatagctctgtgaagcagtgtaagctaaaggtaaggacacactcttagaaggctgctttctgaactgggtatcaaagtagctctgcaagtttacatggtcttgactaatatattcaaccaccctaagcctcagttatttctttataaaaaggagatgatgatacctaccttgcatagtcattatgagatttataccagaaaatgtttgaaagagtttaaatctctgaaaattgtaagcatgttattattactaaacccattttacagatgagtcaaccgaggacagaggaagtaagagaacatgctgcagttcatagctcataaaccacaggaccagaaggcacctttcacccctacctgcccccttctacaggctttttcttgccagataattcattgccctctaggagctgaggattctgtagcatcaagtttttgcagtattaagattttagctctttttgtttcagtttttgtagcatttgatgaaaacttaaagctgattatattgtgtgtggtctcactaaaaacagtggcttttccctattttttaaagaaaaatttatatttgacgacctttcaccacacacacagtaggtgtgcactgtaaggaatgaaaggagccctgaaaatgatcccagttcccttaaagcctgaagacaggtgtctgtaagtcctaaccctccccaactcccatcagtatcctgacttatccacctgcatctacagtatgtagttggcttatgaatattgactgggactaaatgaataaatattgaatacctactatgtgcaactatatagtcacttataacagtgcttctcatttatatataaacaaatcttctgggaagtgatcaaaatgtaaagtccagttcagtaggtgtagaatgggacctgagactgcacttctaacaagctgttagatgacagcagagctgctggtctgtggacgaggtgattctggtgcacatttaagtttgagacacgctgtggtgtcccattctgccttttaaatctctgtgtaatactttttggcatttcttcattgttcatttgttatttattacttacatcccccagtagaatttaagttatatgagagcacagacgtttctaccttgatcatcactgtgttcccagcacctggaatagtgccagacacgtgtaggtactcacagtagggtagtggagctgatagccgatttgcccctgcacaccactgctcagtaatatttgtgattcagtacatgagtaaatgaatataggtattggtaatatgcatagatatataatagttatctattatttaatatacatagatatataatatttatatattgtttacataatccacataacattttgaggaatctattatcaaccacagtttgtaaatatgcaataatatgtgtctatttagtattacgggcaaatacaataaaacttactgaaatcaggtaactattgaaagtgttaggaatgaagagctagagcttgcactcatcctggaagaagacaggcaattctataaatagagagagaaaaggagaagagggtattccgtgtagatggaatgtagtgggataattttctgaggttttattcttaagttttattcctcttgacatctccatatttctgatcaattatccagttccctagttttcctgttgtagggaattttgagtgcaaaaagcagaagttactagaagtttgttctttctacgttttgtaaattccaaaatttgctgaaattatgctgtgtatcctggggtaagatagaagagagatggcttcttttgcagacagctagtggaaagagaaattttcccaagacagcaaagaattcggtctgagtgagaggatgataacttcaaatattaatcctttctgcaccacaatccccttcagcagtttgatgaggatgtcaaaggaagcattatattaaaaattgtttataaaatactttagagattggaataagtaacttgtgtgtttgtttattaattcataaaatattaatatctagcagcagatcaagtaattaaccttcatatagtgatgagcacagatttttaactataaaattatataaaaatctgctttttattcactgtagatttatagttactactaatactattgtggttcattatctgcatttataataaaaaataaatattaaattttcagttagaggttaattaaaaaacggacattattattttcctactcaagtccatggacccctgaggatggaccccaggttcagaagaagggcttgtacatcactttgaggcagtgcatatcagtcaggatagtctaggtcagtggttctcaaagtctaatccctggaccaataatatcagtatcatctgggaacttatcaggaatataaattctcagttccaatccgagtgttactgaaccagaaactctgggagcaggaccaagtaatgtatgttttcataagctctccaggtgattctgatacatgctcaagttttagaagcactaagctaaattatacttttgtaaacaaacaattaaaaaaaacagcctcaaatctcagtagtgtaaaatacatggtttattttccatttgatcttcattttcatcacagatagtatggacttattctgctccatgtctcctcaatccaggaacctggttgacagaacagccatcatctccaacattactagtactataccaggatagaaagagagctggagagtctcacattggtgattcttggtgcagaagtgatgcatatcgcttctactaacatctaattggccagagctagtcccatggttccagccagtaactacaaggagaggaagggcctggaagccagggagctaatgatgactaacacactatcaagatacagcaagatctcagagaagatggtctgctaatatccctagggagactattacagtcgcacttatgattcccttgcttgcagcaggcacagaaacagcagaatcacagccatgaaggatcagctgagacagtgggtgaactagtgtggcccaatgtgttccatgcaatctgtgacggaggtagaccaatgtaaaccaaagactgggagggtcaaggaagggggcacttccttttgctttagagatacttaagatcctgggatttttgcaccattctgggcacgggaggaaagcacaaaagtgattgagattgaatttcctgccacaggacgctcagtgttagatttaagttgattcagagaaatgtgatatttctgacacacttcaacacggggagaaaagttcatatccactagagctgttatctgtgtaaagtgcactagttcagcacttaacatggggcagtttagaggaggatttcataaatgcttggaagatgataaactcttcatatactttaacactaaattgacatattgacttagaaaagcctgagacctataatttttgtaaattcatattggggattcaattaatggagaaatatgagtcgttggtagttagtcactttttgtgattgtgacagttaattcatttttatctattagaaaattttacaggcattcagctagtatttttctgttatataattttccctgcctgccttgctttcatctcaaaataaagagaaggtattagccacgtagtgatgagaaagtagtcatagtaaaaattgaaataatacagtcttgggaaaatgtctggctcatgtggtgaaggttttattacttcacacttttggaaatatttactggagtcttagccactatgacaccataaatgtgtatttgatgaagatcaaaatctacctctgaagtgcacatttgtattgaatgactctgatgtttgtttcagttgcattgtaatgtgtattagatgattaaacccctcttccttgggggaaaggtttatggtagaaaaatttatatggtcaccatatgtgtgtgtgtgtgtgtgcacacgcgtgtgtgtgtgtgtcttcattgcatgtcagagagtgaggccaaacatatgtttcaccttctcactatgaaatatggacattttaatttctgcccacttgtggccctgtttttttccccattcttaccatgtatgtgtattgctcaggaaaactgatttatgggattaattaatgtacttttaactgggttcaaatgtactgtctcatctctgacttttgtatgtttgacttttgtcttctgattataattccatgctagaaatttgcttatagtcgtccttaagcaatagccaccaaaagttcttatggagactcctggaaatatgcttctgttgtttgctataaattacatttcacaatattgtagtaaaatataattttaggaaagtggtacaattgcatgaacatcaagtatctacacttattaacaccaaacatttttctcaaatgtatttttgaggtttattgcctagataataaatctatacatggagtattcctttaaacataaatcccaaaaccattttgctttgcaaataaatcaatcaagcgtgtgactcagatacaataaaaatatatggagggaaatattatatgtgataaatagtaaaaattttgcttactaatgaagaaatttcatgagacaatttgcagcccacatattgtagttttgatcaaaaagctttatacgaaatccagaatcctttaaatcacagcatggaccatagaaatgtgttttatttaagagactttaattcaagactgttgttttaaatcatgattgcatctttatgtttcattcaactcacatgttaagctgtgtgtgtgagtgtgtgtgtgagtgtgggcgtgtgtgcttgtaagtgcatgtgtgtgcatgtgtatgtgtaaattacatgatgcatctgggcactcattgcagtatgtcacttaaaaactttaaaaaaatgtttggagttaattttgttccaagataattttatgtgccattagttcatctcatcgtcttatataacaaggaaccaactgatgcaggttttacctttttagctaaagaattaggagatggccgggcgcggtggctcacgcctgtaatcccagcactttgggaggccgaggcgggtggatcatgaggtcgggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaagaattaggagatgtttaaatgttatatcctgttttccttgacaactataattttgcttgggagatgattaccagaatgactgctaaattactatttttctattggtctaatattttattcttatgaaaaatgttatttctagtggtctttattgaagaccagttgatgagggtcctcctaagtcaggggaaagagtgtatacgtttcatgtaaaatatccttcctctttgtaacccaaacctttgtatagcttggtttctctttcttagtctatgttgacagcagtacaaatagcataatagattcttctctgtatatttagagggtttttttccataaacttatgtgatactttgcttttactgtgtaggaatgatgaaaacacacaacagacccaccaccacctccaaaattgctgctgccattaatcaactcagtgcatgacagaaattatgaacaagtttcacaattttctcttttcttctttgacttttgaataactggtagagttttattctatgtttcatgtcacgggagaaaggaaccacaaaaatataactaatatgagataaagcaatatttgggttctgactccagcaatacccttgaagtcaaataggagcatgtgtggtagaaaaaagacgtgttctccccctaaaactctgacttgcttgtcactgtctcagcagtgacttgcaattgcaaatcattgcctgaataattaagcagcatttctgtggcctgtgacgctgagaagtgaatgctaaatatgtagtcactgagctttcatttgcttactgtgccaaaagccagtgacccaggaatcacaagtgactactgtctagctgctggctgtatgctgtatggatttttgtgctacaaatcatcatcaagtgtagactacttaaaggagctcctgtgaaattaccaaagaaataaaataagttagtatagtcatcaaggagaaatatagcatatattatactgaaggaagagaaagaccctctcatattattttatattgttttatactcagtacctgttttaagaaaaaacaacaaggaagtaaaaccaaagacaggcagtccggcgccaggcccgaaaccaggcctgggcctgcctggcctaaacccagcagttaaaaatcaactcatgacttagaaaccgatgttattcatagattccagacatcgtatagaagaacattgtgaaactccctgccctgttctgtttctctctgaccactggtgcatgcagcccctgtcacataccccttgcttgctcaaatcaatcacgaccctttcatgtaaaatctttagtgttgtgagcccttaaaagggacagaaattgtgcattcagggagctcggattttaaggcagtagcttgacgatgctcccagctgaataaagcccttccttctacaacttggtgtctgagaggttttgtctgtggctcatcctgctacaatacattgaagcgttacatccaagatgtcaatcttttccctgtatatttaaaatctctgcagagaaactgtcattttttaattatagcaagtgcataatgttttccttttagttaatgcagagtgaaatatgtgaatgtgcaacaaaattgctatatcatctaaatgtctgttctaagcactggggataaatcagtgaacaaagcaggcaaactttcaactcttacatcattagtaaaagggttaaggtcacagatgattcacaagaaaatgtatcattgataagtcgtctgaagaaaacacaaaattgggtgatggagagagttgacaaattgaagttgggtgatcaaggaaggtctttctgaaagggaattgtgagttgagaccagcatgacaaaaagccagatgtgaaattttagggaagatggatttcaagcagaaaaatcttcttgtacaaactcatacaactgcttctttgttgtttttttaagggacagagtctccctctgttgctcaggcagtgacacaatcaaggttcactgcagcctcaaactcctggactcaagggatcctcctgtctcagcttgccaagtagctaggaagacaggcaactgccaccacgcctggcttgaagttggtgcaatttctcagaacagaaaggaaagtgtgaacagaacagagagagggaggaggagcatagagatgaagccagtgaagtaggcaggggccaggttatatgggatcttgcagagtatggtgagtggtttagaatctcctctcagtgggatgagaagccaatggagtgacggacacgatctgaattatgttttttaaaagcactttgctcttcgtttgcagaatggaatgagtgagaggaaagagtggaagcaggagaaggaagccacagtggtatccaaaagaggaaaagtgggttagcctagggtgatagccagagcactcttttaggagtctcccaatgatccttgttctgaaatgcctcctgcctctgcagaacaaaatcctttccatgtaaatagttcgtgttttaatgcaaatgggaaggatggtgtacttcctccacatctgtttcctgttgcagggcttgggactgtcagtgctttttctccacatggaggttattttgaaacatccaggtggttttgatcaaatcatgtattcttagaatattattcttaagcttcaataataaccctacagatagaaagattaacataaactgactaaagaaatgttaactgccaggagattaaggcaatatctcaattcataatctatagtactttggggttaagctttgacttgcaggatgtaatttactgaccagtaacaaagactccacctagctggaacctcattccagaaatgtttcttttgataagattcttagatactgaaacatcatttttaaaaagctgtgctttgggaaatcaatttgggggattgtatcaggaattacaggcagcaatagcttcataaatgtgcaacccatgcagcttcccagggcctgtgcttagcaaggcttcacacttggtttaatgctgtgccttcattgtcttgaattcctaataattttttaacaaggggcctcacagttttcttttgtaccaggcaccacaaattatgtagccagtccagaattcagggctcaaaacactctatgaaaatctgttcgtctgctataagatatagaaagatagagacaggaaaggagcagacttgaataaaggaattctcagaaaagcaaattcatcaattataaaatttgagactttttagtctagtggttctcaggtgcctgtttacagtccatgcccaccagatttttacctctccatagcaaaatcacaagaatgatgatgccattgggttcttattttttagctaaatgtattcaactcaaatgtctgctctttattctgagattagattcacctataatttttgctgtaaaaatattttcgttttatataataacatgttggcaataggtagaagctttttctttgtatttaaagtaccttctgtaaaagaaaacttgaccatctcatttcagctcaatgcttcttggcagaaaagaagaagtcctttatcccactcctgtacctttacctgttttttctaatcccaggctcacttttctcttattgtaattattctcaataccaatgcctcaccattcacaaataactaaactcagttttgtacaactgagtaaaaggtaatcagaaacaaatccacacgaatattagaacttctggcaaggcaaaattgaaattggggaaggattaccctcttgcaaccaaactacttatctttttttatagttttattttataaatccatcctttttatgccccaaaggatagcaacatttttcttttcatctttgtgtctccagcatttagcacagggcattgtactcaataatccttcaatgaatatgtagaaactaaataaatataaataaataaaaattttaaactagaaatggaaggatgtctctcttccatttacaccttctttggcagtttcaacccttccttagccagagaacaataatgaccgtaagaaatgttaataaagatacactacatctgtaacaggaagttaaaattagacattttctctatttcagctaaaactgagaaggtaccttttactccctcatttcaaaatgaggcatgagcccaccaaataaagccttgaaaagctggtagacagggactgatttcatgacccttggctgaccgcccaatacaacagtgtggagattagagcaaggttttcagagagggctgttgttgatgttctgggaatcctgtcctatcccaacccttaagggtaaggggtgagggatgcctttaccttatcccaaataggtaagagccttcattgaaacaaaccaaagagcttgggggaaacaatggcttagactttgagtcaaatacgagaaatgaaaagggggagagactacagctgcttggagacctgacaaggggatgtaaagagctgccatccggtgagtatgctgaaacctgcggggcaaagaatgtttcgtgttggcaagatgtggccttacaagagagaactggcctgaaagagtcttggatcttgtccagaactgtcctgcaagaatcttagttctcttctacctgggggagggaggtaatgcgagcagaaagaacatggaggtctactgtcagagccctgggaaggagctatgagtgaccagtgggaagagctgctttcagtcacaaagagcaaactacagatatctctctagtgaggagaagacaaagaactcctaaaatatcccacccaacaagagagagtcagctttaaacacctaacaaaatacaaagagctgatgccagcaagtaagatccctggaatctagtacagtgctttgaacatagaagggactcaacagatgttggggaacacaaagacctgttccctcgttgggctaatgttgcaggaatgattctcagctttgtacacatgaaggaattatgaggttcaggttaagtgcctcacttcaaaatttaatttttagtccagaccagtgttgttttaattttactacactcacagttaagaggagtccagaggagcacccttgaaactatagtgctaatatcaagtttgtgatgtagagcaactaagtgtttctgagagggcttcaaggcatcctttcctgtgctgtttttacgttccaggttattaagcttatcttaggtgaagtcaagctttaagtggtagttactatgtgcctggcagaatacagggcactgaaggctcaaatgagaataagacaatccctgacctcaagtggctgatagcaaatggattaaaggcaattgtttatcatttacttaatgtatagcacgagctcaagaaatcttacatttctatagttacattactgtcactataacattaatagttgaactaggcttcccaacagatgtaaaagccttctaatctagagataaataaagattgtactttttgttatcatcagattttattattctttgatgatgattgactaaatatactaatgaggattgaaaaatatactgctttaaatagttatgtcataatttctatcagtcatgcaattagaagtacatatatggatacatattttttctattgccccttttttcctggctttgttaatgtataatatattgcttttctgcattcactctccatttgatttttctcctaatgtaatttaccacctgcagaagtatgaggcctggaaaatgcaggtgtgaaatgctcattagcacaataccaataaatcaacacatgtttaaaagaatcttctacctaaccctatttcttaaactgtgtattcagtcataattttcagatttaaaaattggtccaggttatagatcaggagatagctgtatttttacataactattaggaatgctgtggttttctaaccagagaaatatgacagtaatttcttgcgaaagatttgggacattgtgactgagccaaactaagaatgaaagaagatggagaaaataaacataaccacatgtcctataagtcttctgtatgaagacaggtgtgaagcctatgaggagggggtcattgattcatgaactgattgattcactcatttattaattcatatagtatatgtttttggtgtgcatataattgcaaagcactgtattggatacataaaagaaatctacttccttttgaagtgacttctaaaagacactccccatcagagtgtctaatgaaatgagagagacagaacaaagtggacatgaacaaatctgttggtagactttatgataaacaccatgagaagcaaatgagcagaatgcagtgctaaagagtaacctggggtgaagtgggagctagggaaggaggatgagagacaacctacttaaaattgtagggatggtctttcagaggagacttaaaaaataagaagcaatcagcaattcaaagagcattccaggtggaggtaagagcatatgcaaaggccctctggacagaaagagattcacatatttgggaatcttgaaggatatcaaggcaactaggacatgggcaagaaaagtggcccaagactatcagggcactatggaccattgaaagatgcttagaaattcatccaaccacagtggaaagccattcagttctttaaagtcagagaacaacccatttgcttgatgtttaaaaatgcttgctctggttgctatagcagagtaggtagtaggggaccaaggtctaaccagagagagcagcatggaggctttggtaacagtcgagagaaatgatgactaggaaatgaagaaacttaagatataatttggaggtataatagaaagggtttattgatgaatcagagttggaaagtgttacaaaggaaaggatgaaatatccttcaaggtttctgtcatgagcgactgtgtaggtgcctgctggtgccatttccagagattgggaagacaaggaggaaagtcagggtcaagtttagaaatcaagaatttgttttggacatgttaagtataaaatgtgttgcatgtaatggataatgccaagtagctagctgaatatttaagttccaagtgttgaggaaaactttggaggtaaaaacagagagttttggccaggcgcggtggctcacgcctgtaatctcagcactttgggaggccaaggtgggcggatcacgaggtcaggagatccagacaatcctggctaacatggtgaaaccccgtctctactaaaaatacaaaaaattagccgggtgtggtggcgggcacctgtagtcccagctactcgggaggctgaggcaggagaatgttgtgaacccaggaggcggagcttgcagtgagcctatcacgccgcagccctccagcctgggtgacagagcgagactccatctcaaaaagaaaaaaagagtcttcaggatataaatgtttaatcccaaagaaatagactacaatatctagggaaagagtgaaaatagagcagagggaggcccaactggaccaagtggattaggcccctggatattccaaaatacttagggattgaatcaaaattacaaaatatttagaggtcgaatagaaaatgaggacttgggtcaggtgtggtggtttatgcctctaatcccaacaagttaggaggctgagatggaaggattgcttgagctcaggaattcaagaccaagctgggcaacataatgagaccctgtgtcttccagaaaaaaaaaaaagttgggcacagtggtgtgcccctgtagtcccaggtccttgggaggctgaggtgggaagatcccttaagcctaggagttcagaggctgcagtgagctataacagctgccctccagcctaggagacacagtgagagcctgtctcttaaaaaaagaaaagaaaaagaggcttattcaaggaatagtgaaaaagggaatatttggagaattatgtcagggaatctatgaaagtagaatgtttcaagatagagggagtggttaaaaaaagttgagtatttatatgtgccagtgtgtatcatgctgaatactttatctggatggtgttatattatccctcctatagactattgagttgagtactgttattagatccattttacaaatgaggaaactatggagagattaagtaatttgcccaagatcccataataagaaggcaagtgtcgaatgccaggcattctaacttcagagtccatagtcttaacccttgtgctattctcttccacaaatacacccagcaggtaaaagactgagaaaaataaatatcaaaaagtaccttttgaaattgactacatgaagttacgaaaacctgagttgttttgtgaaagcggtgagtacaaagcagtattttggagagggttgtgcagggaatcggagatgaagctgtgtgctgaaaaggagagaagaaattagaggaagggaatggtggccttacagagaaacagacttgaagtgatgtgaagtgtttgcgctgggtgaatgctggcaggaataagtgagcagggagcgagtgaacaggataagagagatcacttcggagtaaagccttgaaaagggagtgtaggaggaagtttttctccctttcctgcatcccttcctttgtgcgtaaaatagaaatgttcttcctttctgaaggatttcaaagagaatgttggcttttctttcattctccctgactcatgcctccccagaggaagaaaagtgacttctgaggctgtgaaaaggaaggactctggctgcatgacccagcctcctctggcttcttcttttgggacctgatggccctcagcatgtccatcttaactcctgctccccctggggcaatctcaccaggacactgcttctccaagtgccagcttggggtggggtccttgccccctgtgtctatttctcaattagttcaggacttacagaaggaagagagtggttagtacattaaaacccccagtataaagagggaatgcaattaggtttagagaacatgtggagagattggctttggcaagaagaggatcatgttctcttctgtaatagaaagaaaagttttaaaataatggggaaagataatgtttatagagtcactgctgagaagaagaaaagtgatttctgtaatgtaatttttaacattttataattttttttctgaataaagtctgaaatccaacttggttgtattgggagcactacatagctttcatgtgtgaagccactatcatctaagcagaagaaaactagaacagatacacctagtgattctcaaactgaggaagaggatgtggcatgccctgtctagggtagctaatccgaatttcgatagggcagctttcaaaagaaatcatttcaatcaacaatgtaatcagtaatgcaatcgtacatttttaaaaaccacaaaatgtcatttttacttaaaacatttataatgacttaaggatgttttatattcatcaataggatgatttagtttgaagaagtcaagaaacaatgggttacccagagtgttttccacccaattcctgaattaaaatgtagctaagaatcatattttctgtaccttcttttcctgtcttttgtgtcttcttttggggaaagttaagagggtagatcgttggactacattgtcattttaactataaaccactggactttggcccagattattattacctgcagaagctatcttgattaagtttggagttgccttatgttgtgcataagcaaaactacattttaatcagcttgtccatatgatttatagagatagtttgtaataggccttgttaaaaataggtatctttaatcagcaatattggataaaagcctaaagtcttaaaatagtcatatttattctgattccttcttcctaaaatgaataaacagaaagaaatcgatgtggcaatagcgtgttacaaatcactccatcaaaggtaatgaaattaaatttcatctctgtgagttactgcaaaagactgtttaacatttacaagaatttgacttccaaatccttcaagccctaatctttggatttacataatgtgttcctactttcagccttttccagttgaaagactttgaagttccaaggcaaaaactgaaataaattggaaatttgtgtaatttcaaagtgaatgcttgtgatatagtgacataatcagaaagcacatgagggaaaacccatacaaattttgctactattaactcagtgtttgaaactttatagtagaaagatgatatgcaaaattcttaaagattgctccaaggaaacatgctacatatttctaatcaataaaattaaaatatctgatcactagtttgttgaaagcgttagatcctggacttaaatctagatctttgattttagagcccttgccctgttttgtcccccagggcactatagaaaatttttgcatgatgatatcaatttatcaaaactgcagagtgtttatttagaaattataaaatgacttagtgaataaaaaattgaggtattatttggatttatcttagtattaatggtggagaagaaactgtttcttttatctaagctccaacaaacattctttattttttctttaatcagagtctcgctctgtcgcccaggctggagtgcagtggcgagatctcagctcactgagcctctgcctcctggattcaagcaattctccttccttagcctccctgagtagctggcactacaggtgcacaccaccacgccccgctaatttttatatttttagtagagatgggatttcaccatgttggccatgctggttgcgaactcctgacctcaagtgatctgcccacctcagcctcccaaagttctggaattacaggagtaagccactgcacccagccccaacacatattcttataatgggatagggaggaggctatgttatgtggatgcattaatttaatcattatatccactaccaaatatcaagtcttttttttagtttattttcataggtttttatatgtagacatgctttcttctttgtggtttttcccctgtaatgaaaccattcattcattcaacaatttatttcctaagtgcctactctatgactagctctgtgctaaatcctaggaatgaaatgatgaacagactagaatttccatgaatgtagtaattaagttgatctggtggtgtgcacttctaatagaaaatgcttctctcatattacctctttctctgaactgatgcaagaattggaatataaacaaaccagctggcaaacttagatgatttagatgtccttttcattaaaggtcagtaagaaatgctaacgttttatgttagcatttattaaactctgaagaggcagaattagtttggggtttaatttctagtattcatagcataaaattaggtataatagcagtgaatctatgtatgcttctatataattattattattctttatactggcctagcccttcacagagttaaattcaactacatttaatgagagaatttcttgtttttttgttagaatttctagcaaaccatttctgcatgtcattgcacctgtggcttaattcttacattttctgttctctgaatttccaagatagaaaagcataaatttcttagagtgaatacagggttagaaacacatcttgttataacaaactatctagtttcagcatcccattaactgttccaacaccaatttgaattcccaaaggatacttctgttgaagcatttttgctttggtttggaattgcaaaagtagattgagtaattcccgattccacgttaatgagactttctgtcttaatcctcctgtttaagggcacaaagaatagtatggccactgcaattactgagtgggctagaattggaatattctatacccccaagggattgttttcttcttttaaagcataagtttccaatctatcatttcttctgtggttgagtttctgaacatgcttgggttttgctgattttatggtttgtttttagctgctgatttttagtcagactgtataggaggggtaacaaaaacccttaattttgcaatgtgaaaattctttatgcatttgctcccgaaagcttatttttgagtaacttgagacttttgcagcagccacagtatccaacttggaaaacctgcattctcagcagctttcctactttaaataatattcttacattagctcttttaggaagcaaagagacagcttccctaacagtaacaagatgtgcaaaccacagatggtcttcttgctggaaattactggaaaggactacgagtgttcggcctttggggcacagtcattcacatgcattcatacacctcacacacacatacacacacactctctctcatacacacacacacacacttgtgtgaatatacaaatgaataaggcaaagtgagaatgtgtatagctactactagtatatagatttctgtggaattttatacactgctttaatagaaatgaacatattttatgtttacaatagctttcttaggtagagcaggcagatatagcatgaataccattattgtagataagacttagatagtccaggtccttgcccaagtgtaagagctgaagtttatctatttctcctaattccagaatgtggcctttggttcaaaatgccctggttgtatttcagcttttctactttctagttccattactttcttaaagcctcagttgatacctctaccaataggacatatgctacctacctcataagcttgttgtgatcagtaaatgaaatattgcgtgtataacatgtggccttttacctgatacattataaatgctcaatgaatgttcatgtttgctttttcaaagcaaacatttatacgatacttatgccaaatctaagtactttttcaaatattagtctaatcttcatgtcaattttatgacagatattgttaatattcccattttacagatgagaaaatggaggcaaggaaaggttaagaaaattgcccaattgcccaaggtcacacagctggtaaatgccacattatggattcaattccagataatccagtccccatgtccatagtcttaaatgctattctgttattctcaatgtacacagtgggatatatggaaatgtgagttgtatatgctaattttatactgctttaaattcctaaggcctagggaatattcccatatgctatagtgggttttctcaactgttgctactattaccaccaatatcttaggactataataagtggatagaagaagatctgtttttttttccagacaactacagaactcaggaacatatccaactagttataatccaggcacaatttgaattccacttgatgggagaggtgattccagtgaagaactcaattaaataaaaacacttttttatgcgtttcagtcatatcatgatgtagtttaggctcaaggtagagttgtatcatgtagtatttagaccagattacaaaactattaagagatgcagagcatgatagacgaggaaagatgaaaagcattgcttggttatgacgtgaggggatgatgatagaagggtggagatagtaggaaagagaaaaccccacagatgtgagaggaaaagggaagataagacaaaaaaagtaagacaagtgataaataatggtttataagggctaaaagtgaagaagcttgaagaaagatttgctacaaagaaagctattgaaataaagaattgacccagatgttgggagaaaccctccacagtgagcagtataaagccacattcagtcactgttggcgtttgccctgggctttgggatgtacgttcattcatttaagccaaaaagtgcatttatcctactcaaaaagtgatttagaaaatgagtgtaagatttcctatgcttctagtaaaatagaaataaattatgcaagagtaaaattagctaattactgtaagaatcattctgttaaaattagtgagttttggatattttctgccagttctttttttcactagtttctgtgacttcagatttcattatcaacctaccaggcctttcctgctccttggagagctggttgaaatgggattgaaccctattttcacagagtaggaaagtcaagatccctcctcaaattgcattaccacttcttgtccttactttttcatggttctctggtttccatctatgctcctgagtttgctgtctcaggtcaaacctgcgtggatttatacacacacacacacacacacactcaggtgatctatctgatgggtttagttgttttctgaaagatttggggattgtcgtgaaagaaataccacattgcataccacataagggacttgtattcagttagttctcttgttatccttcactcctccctcaaaacccacactccagaatgagtcaagcctccttcaaaatgcagtgcagtccctgcaggttcagtgtttatcgaaagtggtacaggaggaaagaagcctgagaagcggatataatttcctcagcatccctgggaattgtgcagaacacaattatagcatcttacatactcttacaaaatgattggaacttgcatttatagagagcttcctgtgtagatgctgtgctaggcactttcacatatggtgtttattgattcttagaacctttctgggtatattttatacccgttttatagatgaggagagtgagtctcagaaaagcacccagcattgttaccatgctgaaggaaggcattggaatacatgtgcagaggaataagattgttcttttcttctcaaaagcagaaggacaagaaaaagcaaaaattaagacaaaccagtctgcttataggagccatgccaagagagatgtcttcttttccttatttcctagtctctgtctaaggcttcagcacccattttcctttgggaatgcaaagcacattcaacaaagaacctcgcagtgcctattaagagcttatttttgtcttcatttttaatgtttcatttattatcaaatagggtactttatctcgtgcacacctatatgttccattatgccatatttacatttgtttaacgcatttaattaagaacattgttaaaaatttaaaaagacttcccctttcacgaaatttggaaattgaaggtagcatttaacgggtttccttgtcaaccacaatactcatttttagaattgttagccagtaattcaattacccacacagttctgctttctaagaatgtgcaaatggaagtcttgtcttatgcaagccagaaaacctactagcagtattctaaacttagaacaaaaacgtgatgcccttcgagtcttggttgggaagagtgtttggtgaggagggggagaaagaagaaggggaataatagtgtcattttctgtttgtctttggccatctggagctcagtgccacgtcctttgctcattctacggagaatataaaaagggcaatgagatgcttatatattttgtagtgctggcagagcatcatttgttataatatctatccctttatcaaatataagccatcatataagccaatatgagactttagatcaattctaaaatgggccaatgtaaaatacaaacagtttctggtgataaaataatctgctatgtgaattgaaggtaaaacatttataaaatgtaaataattgttaataatgataattattgctgagaacaaaagagcagctggctttttgtataatttcacacctttcctttaaatatttactcctctgaaactgccttcccccaaaataacttactttatattgaaacttaaatttaattttgaaataaaatttataggatcaactatagaatattgacattttgtatgtcaaaaatggttgaatattagggatttcatcaggttcaacataatactgttagtgcagtctaagtcttggcgtgtgtaagtgtgctctcctggaaagccatgctggtccaaataaactttgttgccttggtgatctatagcttatttatcttcttttttattagttgaaaaataaaaattatatatatttatagggtacaaaatgatgttttgaaatatgtatatgctgtgcaatggcttaatctaattaacatatgcattacctcacatatttattttttgtggtgacaacgctgaaaacctactctcagcagttttcgaaatacactacattggtatttaccatagtcacccatgttgtatagcagatctcttgaacttatttctcctgataaaattttatatcctttgatcaacattatacccatctaaattccttatatccttcattctactctgcttctacaagttaaactattttagattccatataagtcacattgtgtggtatttgtctttctgtgcctggcttatttcatttaatgtgttccaggttcattcatgttgtaaatgacaagatatttttttcaagttcagtagtattccgttgtgtatacatgcaagttgtttcttaaactgctttttttattattaatcttaatgccttcttaggtgcgtatagtacttctgtagcttttagctctagtctgaaaacacctaagataagaatggtgttattgggaggaacaaggcattaggaaaaagtagataaagctatacagtgtaaatccatgtttcctcaagtatatgacaacataggtgatttttggttactactccttgaaggactccattcagcttgcttaactgtgagatacagctttcaccctaatttccacaaagcagctcagagtgattcttttaccatgtgatgactgctttgctcaaatcctctcttggcctcatttaagaaccttgaagctctatatgatttggcctcactcccctgccctcaggaccatcttgtttaacttcatctccagcttctcactccctctttttctctgttccagccattgtgccctccctgctccactaacatcacatacaagtctatttctgaaatgctgctccctcataactgctccctcagttatgatcatagctcattccttcagtctcttctcaaaagtccaatggtctatgagccctacttggctgtcccatatatagcagtacaaatgcataccttcattccctatctcttttactgtgcttgattttaatccactgcactttttgccacctaatttgttatatattggcttgtttacttatcacctgtctccctccataagaataagggctctaggactacagttgttttgcctgtgttgttcactgtgtatccctggtgcccagaacagtgtagggtggagagtagccattccaggaatgaatgaacagttcatttcagctcatgagaagtagggcgctggatagggagaacagccattcccagtggaaaaaaagggttgttcattaaatgtcactctactctgtcagtttctaggagtctggaatgaaaagagcttcactctatttatttttattaccacctttttgtggcaagtagtcattggcaccatatataatcttcattgtaaatgaatacagtagtaccaccttatccacagtttggttttctgcagtttcagttaactgcaatatagtacaatatgatattttaagagagagaaagagagagacctcattcatgtaacttttattacagtatattgttatagttgttctgtgttattattgttaatctcttactgtgcctaatttataaattaaactttatcatatttatgcatgcattgaaaaaaacatggtatgtactgtatagggcttgttactatctgtggtttcaagcatccactggaagttttgaaatatatcccctgcagataagaagtgattactgtatggtaaaagtcaatttctcatgaaaatgttttattgaaagtataacatatacccagaaaaatccaaaaatcgtagatggttaaatgttcacaaagtaaatacatcctggtacccagtgcccagatcaggaaacaaaacattaccagaatcccataaaccccttcatgttgttgtcaatgtaataactccccaatgtttagcctaccattttactatcatagatagtactgcttgtgtttggacttaatatacgtagaatcatagggcatgccctcttttatatctggattctttgctcaaaactatttttatgaaaatcattcatgttgctgctaatagtcatagttcatgcatttccattgctgtataaaattccattctaccattgatagacatttgaggtttttttcaatttttgtgtattacaaatcctgctgagattaacatccttgaatgcatcttttggttaacacataaaaatacatgccttgaacttcattcaaaaatatattgccagacatttttccaaagtaatgttaccagtgtgcaccaccaccagcagggcagaattccaatcgcttctcatcactgcactttgtatcatgtcttttacattttagccactgtggtgggtgtggtgtgagtgcaatgtagttataatttgtattcctcaggactactgctgttgaacacttaaaaatgtacttgttgccaatctgagttacgtgaatctattttcatggatattaagataatataggtcgtatatggataaggtagaaatcatataggtcataatttaatgactaaaatttagtagacattgctttcattaatgactcttttagtacttgatagattgtattatcttcacaaagcttttgctgtggaaaattcagttcaatagaagctaattgtgggttaattatgaataaccctccatgctgaatggtgtgaggctaccaaggtccacgtcatgggaagcttcccagatgtcacgttgaagctatgtctaacaagcatgaacagggtctgcaagcaaggcagaaaagggaagccaacgtactagaaaagcctaaatcatatttgaaggtatgaagaagtatgaaacttttaggaaattgcaagtgttcagaaaataaagaaaattgccaccatcttgtttatagggaatgaaagacttgaaaaatgacacttaacatcagcctgcagaagtaccaagggccaatagtaaattggacttagggtttaattacattagttgtgtagcttgaaatgtttgaagttaactcaccatcatttacaatgatttgtatgccaaaggaaatatgcatgagcagggaaatatttcctggatagctttttgctttccatgttaggccttatgtcagctatctaaaatgtagaagtgagcaacacatttattgttactgagaatgcatagtaaaataacatgaattctatcatttttacagctaagatgctgtatagattaagcagaaaaacactggcagcctctgattaaaaaataatgattttattattctttttggagttaacatttatttttaactaatgtttcactgtattaaaaaattcctttcagaactaaatactatagtcaaatacattatctttgacactatattttaattggttattgaaaaaataaaagctctttatcaccttatattttaatgcaatctttcaaaatgattaggcagaagatatttttccttctagtttcaaaaatatttgtagaatttttcttaaaatactgtagggaatgtctatcatttctgaatagatgtggttctatctcaaggttaaatataactcaattgttgaaaaaaaattataaacatggaacaaatgtgtctctagaatcaggattcatagcatgtggtcttctttacttgtaggctgaagaaaaagtcccagtcggtggatattaatgctccagggttcaaccctttggctggtgcaggaaagcaaacaccacaagccagtaagcccccggcacccaagacccccatcattgaagaagagcagaacaatgcagcaaatactcagaaacatccttccagaaggagcgaactgaagaggttctacacaattggtgagcaccagatgttttatgcaagtgaatagatgaaatctacctaaatggcattgagaatttctgggtctgtttagttaagtggctccttgttataaaacatgtaaatctttctgatggtttatttggacattttcttatgtggtctgaacataaagatggaaaactactgaaaaactttcagcaaagttaaataaaagcaggcttgaggaccttctatatcctaacctaggggaagtaaatatacatatacgtacatatacgtacacatatactatctctctctctcttaggtttttcaatttttaactttgtgtgctattttcattttagccattgttcagccagcacctttcttgttttttgtttttgttattttcattttcccttcaggctcccaggtctctgaacctgttccgtcaggttgttaagactgtggttgacgttagcctgtaactaacaaagccagtaagaaagtaacgttattacattctgagagaggacagattacattgtgggtctattttgaccttgcaccttgctttactttggaaaaattgaatgacatccaggcccttcatagggaagagtaataggatatggcttgggttgtgcaggcattacattatttcccccagatataatgatatcctgtaatttttgtattttaacatttaatcagacagttgtaggcaatcagtccaaaccaatcaaattaccaactttagtgtaccatattagcccagcatgtctttggccttgctttttaatgaacaatagcagcttttagtgtcttcagtctatctgagacaaaagttactaaacatctagtatatgggaaagaatggtgtgtaggggagacaaatccacccaaaaagagtgtggctgctttggccttgcttgttacttcaatttggagagatttggtcacatccaaaagctgtaatagtagagactgtggcttaatgggttaaccagtgttacatcaaagagggcctgttttctttaaaatttaccatcctcaccactccagtatgagactgtttgctttaagatgattgaaatctttttctttgattttttagtagccattcctagaaatgatcatcaggagaccagatttctagttctattgaaatctttttctttgattttttagtagccattcctagaaatgatcatcaggagaccagatttctagttctaattcctacaacaatttcctgtgtgactctgtcaagtcattttccaatgtctttgggttaaattccttccttcaagctgaagaaatgcctccatgtaggtttagccttatttcagaatttggctgctaaaaccatgctttctctttccaccattttatgtcctcttcttatatattcattctcaggcttcctttttccagatggtcaagtcttattttctaaaaggcaacaagtatggtgtcaatgagactgtccatagtcaggtaatgagaattaataaaagtgtagacaggcacatatttccatttttaaaacctatgctagcacagttcctcaaatcaattgactagaaaatctcacaaagtctacataactctctccaattaccactatccttctctcctctgcaacatgtctgtcgccttctattgcttttctaattagcgaaaaagacacaattagtattttttccttcagcaaataaagcttatcctacaaactcaatgttccttaaaaattagaaaaaaagggagagatactgaccaacttggccaccatgactaatgggctaagcctagaaaatagaagtctcaaaaggggtggattgcaaaaagatgaacgatgagttattttaaataataccaccactcatgaattcttcactattgaattggtaacaatttgattcataatcaatgggagtggcatgtctattgtgttaaaagagacatctgaactgttaaatatactctatctatataacccttttagtaatttggacctggaaacattattttcaaggctaacatattagcaaccgtataatcaccggtattgaaagttccctttacaaaacaaatgtacttctatgtctcttagtaaaagtattagtaataaacaataaaaattttcatttattgataatttcatatgccaggggcaatttaagctcctgggttttatcctcaattcaccctcacaacagcttggacaggtaagtgttacaccctatttttatagatgaggatagagccatagatcatttaaagatggggtcatgagctgtagagagcaggctctgcaaattaaatctatgttctcttgtgacccgtcagaatcaggctttctctgactctcaaaggttgccatccctgcgctataataagctggaggagtgttgttgtttgagacggagtcttgctctgttgcccaggctggagttcagtggtgcgatctcggctcactgcaacctccacctccagggttcaagcgattctcctgcctcagcctcccgagtagctgggactacaggcacatgccactatgccctgctaattttttgtatttttggtagaaacggggtttcactgcgttagccaggatggtctcgatctcctgacctcaagatctgcccacctcagcctcccaaagtgctggggttacaggcatgagccactactcccggccagctggaagagattttatggataatatagtggagtgatatttttaccacaagtcccagagaatctcagtgaaggaagccttgccaacgaacgaacccgtctacaagccaatatgctcattcattgaaagatatttttcaatatctcagtttagagtttatactcctggaaaactctaggagccctcttgtggccaagtaagtgcatttaaatttagcaatgaagtttcatactatagttactatatacattcaagcaataattttagggcttaaaggattttcaaataaaaaataataactagaaaaatgttacagccattgaagtgtcttttagtggctgcagtggcttttctagaattattttcctagaagtacagttattctttagtattcagggagtagaggggattggttccagaaccctcacagataccaaaaatctgcaaagcccaagttcctgatataaaatggcataatatatgcatataacctatgcacatgctcctgtatactggaaatcatctctaggttacttataatatctaatacaatgtaaaagttatagaaatagttgttatactgtatttttagtcagtattgttttatattgttgcattgttactgtttattgtttttactctggaatattttcaatcagtggttagttgagtccatagatgcagagcctacagatatggagggatggctgtataataaaattccattgatttagaataagtaggggaaagctagtcactattgatgtgaaataaatgaatcttcagataaaaggaaagtaatcaccatgtcaggctgtggttcaggaaagagcattttctgccctgcttccatcactaactgtgtaatctggcacaagttatttaccatcattttaccttaatacttacatgtgtacaatgaaagagagaaaccaaatcttgtctttcagagttgtttttcttcttactctctttttatgatcacaactgaccatagaaagtactgtataagttttctattgctgtgaaacaaaataccacaacgttagcagtttaaaataacaccgatttatgaactcactgctctgtagttcagtccacacggtatgactggattctctgctcagggtgtctcaaggctaaagacagggggctagctgggctgtgttttcatctggagtttcaaccaggggaaaaattgcttctaagctcattcttattgttggcagaattcagtcccttgcaattgtagggctgagctacccgttccttgcttgctgtcaaccagggaccactctcagctcctaggggccacttgcttttcttgtcatgtggtcccctccaccttcaagtaaagaacttcacatcaaatctatttcatttggatcctctgcctcaaccaaccaagaatactctctgctcttaaagaattcatgttattgagtcaggatcacccaggtaatttttctgtcttaaggtccacacaacctaatcacaggaataaagtccatcataaattccagaccctggagttatgcaggtatgtacaccagaggggtgggagatcttggtgaccattttagaattctgcctatcacattttacagcaccacctgatatatacacatgcaaataccaatatatctcagatgaaatttcttaaaagcacttccattactattttgactacttatagaatggaatattctatagaatatgaaatagaatacaatattctatttcatttttttaaaatacagtctcaactcactaagtttatttcatagtccattaatgggctatgacctgaagtttgaaaaatcactggacttgatatttgaaatccttcagatacttaaacttctattattctttgaaaaatagaatggttaattagagctagaataaaaaacattaacttagtggagtagcactaataggtaaatagaagaaaatggagtggaaatttttttttttttttgagacggagtctcgctctgttgcccaggctggagtgcagtggcacgatctcggctcactgcaagctctacctcctgggttcatgccattctcctgcctcagcctcccgagtagctgggactacaggcgcccaccaccatgcctggctaagtttttgtatttttttagtagagacggggtttcaccaggttagccaggatgatctcgatctcctgacctcgtgatccatctgcctcgacctcccaaagtgctgggattacaggcatgaaccaccatccctggcctggagtggaattttttaccactccaattattgtttgtgttacataaaaccatttgaatttgacagtgagcataagaaacatatccttcaaaaccacagcccctacttaaagatagataatgaagccaaatagtagactcagatatttgtgataatcagcttatttcactacccttcattcaaagaactacatataaggacttctgaaaaatattgtaaattaagcatggaggtagtaaagaaaactgtgcacacaggaaccaagcatgtacgattgctccctaaggtatacctgtacagttctatgtgatattgattcctcacttcagggaactggagctggaattcatatatcacggtccagcttctgcaactattagtaaaagctcctgatgtttttctatatggaggacttttgctggacagttaggaaataggaccactcttgaatgaatatccacacgatcagaatcactcagtgacacaccaaacagtgattagtccctgatcaatccctgctgtgtgaaggcctcatagaagatgctgctcagaatagaatgaaaaatgaaacagagagagccctgctttcaaggcagccatcgtatgcgttgggaaagagcgtgcctggttgaaatgagcacaccggtaagcaaaatagacaacagagaatgtcctaaatgccatagagatgggagagagggtggtgtgtaatgaatgagggagggggcagcaggagccaagggatattcagagtaccctggaatccacaaaatggagaaatctcagattgtatagatgctcagagggcctttatgggctccatagagcaagacaccctcaccatcctcctctgtttttgcttatgagctcccctggcatctgcacttctctgtgcctcctgttttcttgtgttggcatgtctgtctccatactggttctcagttcttaggaggagggaatggtgcctgcaatcttattaatcccagcacttagtgcagtgtgaggcacacagttaagtgccaaataactatggagggcagagaggatagttagaaagggttatgaatcttgtcctttgaagtggaagaggagaggagggagtctgctcagaattcagttggaggacgagcttaacatttactgtgtgccaggatctttaagcaatttattcacattatctcactatccaaagctcagtgacacagggtaatggcctcactttcatgaaaatcagaagtccagagaggttaggagatttgtctaaggtcacagcttccccaaatagcctagataggatccagacccagtttaatgtaattgcagagcaaaggctcttaaacaccacaacgtgctatctgtttacccctcaccataagtatacagctaaaagattcttctgtctgtagtccattagagaaggattggaatacctggtgtagcaaacaataagtaagataattacaacctttatgtttattttttaaaagtcctcttttattacttatgccacctaaatgctctctgcaacttcgtagaaaagccagaaaagctttcagtttagcctttcctcggcagggctcctgaataggtccaaaaggggggctcctcggctaacaggtgtttgaataatacctctggaactttccttcagttgaaatctctccctctcagtttctcaccttgtcaagggaattgacagtctatttgtcccttttaatcttgtttgtcttcaggatcaacctctcccttttatcctatctaaactaatctcactgtaacaccttcttgtaagacacagtctacgattaatcatccaatgttctttacacagccatttatagtcatttagtttcagataaatgaattaaataaatatgtattgaatgcctactatgttccaggctgtgttcaaagtcctgtgaataaaagattaaactaaggccagccctcaggtgcttatattctagttgggaaggcaggcaataaatatacaatcaggtatttaacacactgtcaagtaatgataagtttttaaagaagaataaaatagattaagtgagagaggtgatatgttattcacgtaaaatatgtttaaatcttatacaatttttatggacattctagatgatgaattgtctcagctctaactgggaactcaattggctggattcgattacaggacattagacgcattaataatagatttttcagagttgtttttcaccttccttggaatcagattagcttatgaaaagactaatggaattgatatttgcagcatgaaggagaaaatgattgaggggaaatttaatgaccctcatgcttccccacattgttttcaagaggaggtatccagatgtccatttctaccaacaatgaataaggagtgtggattaagctataatttagagtattgaaattaaatatcagggaaaatgtaacaagtattagtatatacagggaagttggttttttgtttgttttttgagacggagtctcgctctgtcgcccaggctggagtgcagtggcgcaatctcggctcgctgcaagctccgcctcccgggttcacgccattctcctgcctcagcctcccgagtagctgggactacaggcgtccgccaccacgcccggctaatttttttgtatttttagtagagacaggttttcactgtgttagccaggatggtctctatctcctgacttcgtgatgcgcccccctctgcctcccaaagtcctgggattataggcgtgagccaccgcgccatgtatagctattgtctcttcagagtggtttaggtgtcagcttgccagagggaaggagaaaattagctctcaaagatcctaatttttttgatcaaggccatgaaagctgtgtagtcattcagtgggtgtttattgagctccttcttttgctcaggaaggcaggtgaatcaatggtgaggaacttggccttgagaatctaaagtccaagttggacctttatattcctcctgctagttatgagaccataaacaaagtagttagaatctcaaatcccagtatgcctctttataaaaggaaataaaactgttgcttactgaaagggctgtggtgaggtgtaagtgaggtaatgtatttaaagtacttatattagtgcctaggacttgcaagttctcagtaaatattagtgagcttgttgttgttgtgaattaaggatagagtatgaatgaagcaccatggtacctgctctcatggagcttatatgaaacaagcctcttgtcttgacctttgtggatctgatcaagtcatcccctgtttaaaacccggcagtggttccccacttccacaaaataaggttgttactctatagatctttcatactgcgcttacctttcatcagcttcattgcagacctcagccctacactccagccaagctaaaaactctttgtggtttctcgaagttgtaattctgtatgatgtatcttgggcttttcctcctgcctagaatagtgatacctccgcctcttttagccttctgattaactattcatttgccaggattcaatccaaacgtcctttacacctggccacaacttctctaaatctgattaatatgaatacatttcaagcattttaatatacagattgtcagtcttttaggtgactaacatattgaatttactaaatttaataaatgcttataacatttttatagagtgagtggaattaagtctctggaagttaaatgacttattcatggtcctactgtaaatagtttcaaagccaagggaacaatctaagtaaaatggccagtggtaaagagctcatcctctacattgattttcagatcaaattctcttttcaaaaacaaaaatgaaattagatcattgatggagatctcattgagtggttccccaagtgctagtctataccattgatggtgaaaacgatgcaataataaaagaacagtagtttttcataagacgatacttagttgaagtgactgtcctttccattttttctttcttttttcctcttttgtcccctccctctttcctttctttctcccttctgctctttcttccaccctgtttcctctctttttccttctttccttccctccttgtgttaaaatgaatggtcttttgtgaaatgactgcttagttatggtatcagtttaggatatttgtttaagtctgttcttttaaaattattttacttgtcaaaatattaagttgggaaatggtccctaaaatattctcttaaaattgtgatggtctgtgaaattgcaaattctaaaatccaatgcaatgatcctgtcttttgccctgcttgcaggatagaataccttcaacattccaaacttaacgatgcacagttaaatacaaatttgtatcttactaaccccaggctgcttacatattgaaaagagagcctatggaattaggggttccctgggaattcttctcagtagtaggcaaaattaaaacagtaataactagtttggaagctctgaagagaaaagcaagacacatatttaactgctttttaattgcagtacaccagacactttaaaatatcatcacataacttgtacgcctctcatttaataaaaaagataaccctaaagtaacaatactataacaggaggttaaaaaataaaaggaaaaaactaatcttgctagaggtggcacattctgcagtgtgaaactaggtcaccactgacctggaacgttctctccaagttagaagattcttcatggaaaagcaggaagtctctgtgatttaatcaacagaactatcttggcatgcaggtcactgtctataagcacagaaactaaaacacatagctgctctgaggattccaattaaattaaattcttgagaactatgactttgtttgaattgaaatttgttttgacagtttgatggctttttacattttctggatcacaaaaatttttagggaaaattatttcatttgctgaggtttcttgttacacatggaagctaaaagtccctaagtggacctgggcatttcacagcttttgaagagtggttcaaagtttgtgtaagtagccaatatggaatttttttttatcaagatagtggaatttgaggatatcaagatttcaagtttagttttttggttcatttgtggattaataagaccatgggattcaatatatgtttctgacagtctacatctccatgtgcatgtttgttgggggcgatatttgattgggattttattttacaacatttttcatttatttcatttaatatctactttaaaacatgagattaaggaaatcccacaagctgaaactactttcaactctaaaattaatatgaaagctttatttctttcaagataaattagattttttttaaccaatcatttatgtaattttaactaaaatttaccaaggaaccggaggtattctcagaatgagaaaaaatatgtttgcttgatattcctataaatttgtagtgcctataatttgttaaataagcttgccaactctagttttatagcattagtaccttattttatagatttgctttattcttttttgccctgattctgtgattgttctctgtcagaagtaatcaacccagaatcaagaaacacagcttaatcatggccatgataaacagattaagaaatgtcagtaaccctgaggtctccttgagcaaatggttttggtattatgtctgagctacagcctaatagtcttataacttattcaaaaacaaattatatctgtcaatttatttaatgatttctaaactgcccaattaaacctatactggtttaatttatggaataattaaaatggacattgttcatggttgagaaataagcatgatcctgtttgaaatttcctaaatcactattaaaattagtctttcactgctgttagcaaacaaaacttgcccttttaacctgctaacacgtctatgaacatcccatttcactgaataatggtgaggggaagaaaatgacaaattattaagcaagacctactctattttaaacatttatagatagaactaatggcgatttgaacagtgaagtaatatgtctacatttcccaatgttttcatttttttaggagtatgaatttaaagagcttctaggatcttgctcacattcagaaatgaaactattggtatctcctgattttttttaatttgcttttcttcccacgttgtacctaaggatatatattttcttatttgttttttcttcttttatgagatgaagtctcagtgtcatccaggttggagagcagtggtacgatcatagctcactacagccttgaattcctgggcgcaagtcagccttctgcctccagggtagctgggattacaggtgtgcataaccgtaccgagtcaagatatttctttacatgtaaaaatactacaggatttatgctggtcaatgaaattttgaccatgttaacagttatgactgaaagaatattacttatgagaatggaaaaataggtaaaaaccagacacaactggggggagaatcttctattgctgtttctaccaaagttttgaaactacttttactatagttaaaaactgtgaattcaactgaagattataaatgttacagtgaccattcatgatacattccctatatattatgtgtacatctacatagaagcaagctattagtaaacagctttaaaattcactaactgaaattttgtgatcatctgaacaaactgagataaaaagtctttgtgttagtacaatatgaaaaaaaaatctatgtgggtttataactgaaacatgatttcaggacacagaagatattaggttcagcaatttagcttagaaaactgctttttggtagggaaaaatatgtactaagagaaattaataagttggttttaaagtaaggttatttgttagtttattttatgttaccatatatgtttgaaaataataaagtgaaattcctccaaaatattacatgaaaaagtttagttaatttagattggtatcttttgagggagaaagcccataatgtgtccttaattatgaccaacaaatcttagcattctgtttgatcattaatttgataagcctctttcataaatctgaaccttctgtcttacagaaaaagactaatatgctttgtagaaaaaactaatatgcgttggatttaaatgaactcttttaactaatgtaacataaactcttaatgaatgaattattatatttataaaccctcttagtatgagaaacactatggattaggcatatagaggcagctcaacccagtatacaaatcagtaagacttttaacagtatttgcctccctgctgcatttcaatgttctctatttgctaggatttgtactcaaagattcttggaggttattgtgttgcttaaattttcatacatgttgatagaaagggcattgatatcctctcttagttttctgagctagagggggcaaaaattatctttgataacatattgtagataaaatatcataggtgcccacagagagttgaaccttgtgactctgatttattgagtgtcttacaggccaattcaatagaatttcttttccagttagatagattccgttttgaagtctttttcaagtactatttcaagggaggcaagatgtggcaaaatcagcacaataatatttactctaagtaaagaaaaaaggtacgtggtgtgctgtttggggtacaaagtttttacttcctgctttaaataattctctcaagttgcagatcttttgtgatatgaaaaacactcgtgtaaataaacgtatagtgagtgggatggaatggggatagccaaaaagatgcacttaaggaaaaggggaatataaataataactctgtctctccatgctttcttctttctttttcacctccacccctatataagcctgggtaaacctcaattcagtggacaattttaagaatgcttactcattcatttaaaaatatgattgaatgcctacattatcaactaccaatagttggaaacaaggcttgagagagaggagagggagtcttgtgtgctacaccatggaatttgggcttactcttggcgtcttaggaacttgtgaagggctttgcctaaggcagtgtcttgatgagattgctttatagagagatatttctagcatcacatggagaatggttgggaatttatgtgcctacaaagagaagaatcttttagccatatagtgtaagagctaaaaagatagcatattatgttatttaagagccttggctctggaattacatacaattggatttggatcctacctctgctattctgggcagctctgtaaccttggacaagtcacttaatctctctggacttctgattttcatgaaattaaggatattacctggtattactcagatttgtaatataagataatgtatataaattgcttaaatgatcctggcacacagtaagcacacaataaatgttaattaaaaagcaaattatcagaagaaaaataaagaggagtaacaagaaccaaaactaagaggcagcaggacaagcaaaagattccagacagatgcagtatataaatctagatgaattcatgaccagctagaaataagtaagaggaagattttccagtcaatgctgtgatttcaggctttaaatacttgaagccatagaagctaaccttttcatttaaaaagatatatcctctttcatgaacaaaataaatatctctatgggccagaaaaaggataaaatgcataacaataaatgagtgttgaagctatatgccttttgaattaatatacattgaatttaaaataaccttatcataaatatcagaaacatcatgcattgagcatatggaggacagcctgttaggcacagtgttgatacattgctattaattaaatccattcttcattcatatttccttactttttacctgacatcgtttttcttttccaggatcctatccagggtactacattatatttagttgtcacatctggggtttttctcagctgtgacagtttatggtgtccttttcctagttacaatgctagagttgagctcttggctgcccctgactatttctggaccagagccctaaagggataggaagagccaaataggaaaggacgttgagaaccaatgatcagagacatagaaggcaatctttgttgtttcttcctgctctataatccaataaatttgttaattcttagcctctgctagtaattaggaaaacaaatgaaactatgtcattcatatgatgaaaagtacaaaagaagacgattaggatgggaccttgacatcctggaattagagaataaaggtgtttatgaaagctatgttgggaatggtagcaggagaagactctttattcaaagagagagaggaagcagcacattggtttggtatctattagtttttgcacttagtgtaaatcacacttaggattcattctgtttaaacaccctatgtattgcagagtcataccacatcacacggcctgagacctttctcctatattattttgggacttatagaagtcttaaaggcaaggcagcagagaataaatggctcaggacttgaaggcagttttatgatatgctacctgaacagggcagcagttgagtttacttttttttttttttttttggagatggattttctctcttgttgcccaggctggagtacaatggcacaatcttggctcaccacaaacctctgccctctgggttcaagcaattctcctgcctcagcctcctgagtagctaaaattacatgtgccaccacgcctgactaattttgaatttttttagtagagacagggcttttccatattgatcagtctggtcttgaactcccaacgtcaggtgatccacctgcctcagcctcccaaagtgataggattacaggcgtgaaccaccacgcgcagccaggtttaccttttatcagagggactcagagaggaaagctttaaagcctgaaatctattccaaagaattgcattccaaattttaatgtgcacgggggatcttacaaaaatacagatgctgactcaacagatctggggcggggcctacaattttttctgcatttgtaacgagattcaagatgatgctgatgctgatgctgccaatcctgggtagcaagactaatttaaagagcctgaaggctttcatcatcgaacagcacacataaaatacttttcactatttgatcccaagttatcatcctgaatcaagaatctatttatcttaacacgtgtgttcctttcccagaacaaactacccagttcccagtccttaacacctgtaagaaacctttagagtaagaaaaagaatatggatattattacagagacatccctgtagtttttatactataaaagaaatgaccacaaagtagtaatggataaaattgttttactaaaattagagcatttgagacacattagcagttagctgtgacagtatagtgtagtgtagagcagtgaaaataacacaggttcagatgtacagacacaaaaacattagaattagcaattcactggctattttagctctatcagtcattggctgtgttggtcaagtttgttggtcagtttttcaactgttaaatgggaataaaagcactttcttcataggatttgtgtgattattaaataagatagtgcatgtaaatctcttagtactgaatctgactagtaagtacttaacaaatacttgcaatttcattaaagaagcagaaagaaaatggaaagaggttaatagggggaagtaatagctaatcaatagtaagtggttttagcttgggaaaatacattattgataagtttttaatacctatattcatttatcctgaaagctagcacgaggttttttttgttttgttttgttttttttgagacggagtctcgctctgtcgcccaggctggagtgcagtggcgccttctcagctcactgcaagctccgcctcccgggttcacaccattctcctgcctcagccccccaagtagctgagactacaggcacccgccaccacacccggctaatttttttgtatttttagtagagacggggtttcactgtttttgccaggatggtctcgatctcctgacctcgtagcacgaggttcttggacgagaactatgatctgcagaaataacagcaggctggctcccccttccccagtctccaaggcgatgcaatgaaggtagatgtcagctgtacctacagggctttctactgcaaaaccgctgaaattatgaatctggacatctgtagaggagctggacagctgccctactccccctctggaaagaaggagagaaacttttgtccctaatgtaaaagagtcttctctgggaaagatccctaagtttttacagtcctttggaatataagaaaaatagctcagggatttagcctcctttgaaatgtaaacacaaagccccaaggagataaatctctgtttctctcctgagctatctattctatcaccatttcacccagttgccaattttctttgctcagaaagcctgaccctgtagcaacatgaaatttacatcatttcctgataattataaccctattataaagttacattaatggagaaaaaaattattaactacctcatataatagaaaaaaagtaaaaccatccctagcaaatcctcccctactcaaccttcatttctgataattataataataagaaaaacccaggctttctataaatttccttcaaatttttcattattagtgtgtgtcattcattccatacctcctaaataattcctaatgtgtgaactattttccttgtcattggatgagtagttataaagatagaaaacaaattttcaggctggctgcagtggctcacgcctgtaatcccaacactttgggaggccgaggtgggcggatcacgaggtcaggaaatcgagaccatcctggctaacacgatgaaaccccatctctactaaaaatacaaaaaattagccgggcgtggtggcgggcgcctgtagtcccagctactcgggaggctgaggcaggagaatggcatgaacctgggagacggagcttgcagtgagcagagatcgcgccactgcactccagccagggcgacagagcaagactctgtctcaaaaaaaaaagaaagaaagaaagaaagaaagaaagaaaacaaattttcaaaaatgtaggaagcagttctctagtttgaccacaaggcagataacacctgaccaaatgatgtggctgtgctctgtatggttcccaccaatgtacaaaccagaatggctttgagtagcaaggctatgaatttgcagtctccctaacatcagcatcaccgagaacacatggtcattgccaagcacagaaatgactgaagactaatacccaagcaattgctaaaggatagttgccaaagggaaattgctaaaggacatgtgtctccatgaacatagtcagatgtaacttgactaagctaagggctactaggaaatagcatttacatagcaatctcgccagccattttattttttaaattttttttttaatttttgtgggtacattgtaggtgtatatatttattgggttagccagccatttttaaataggtggtgctgggtcactcaaagcaaataatctgcaaacatgataggggaaaaagcagagacaaaagcctaacaaatgctttaagattctgagactgtctctgttgctcagatttgtcagccatttgttttttgattgtattttttctaaccaaactcacaaaggaccctgacaccagtggaaacattcaatcctcatgagaattcaaatccacaacattatctgttatctgaaaagcagttatcttggccagtttgaattgttatgacaaattaccctagaatgggtggtttaaacaatgaatgttgatttttcagttctggaggctggaaagtccaaaaatagatgctggcagacccagtgtctggtgagaacccacatgctggtttgcagatggccatcttctccttgtatcctcatgtctttatagggcattaattccattcatgagggcttcaccctcataatataactacctcccaaaggcctcattacttaatatcatcacattggggattcagcttcaatatatgaatttcaaagggacacaatattcaatccatagcagcaatgcattagatgatgcaaaagctagtaagacaaggcccctttctttaggagctgactgctagtacagtggagcaaagagagtgagggtgcagtgattctaataacacacaggatgtaaatgtcccaaggcaagtgcaaaatgccgtaagagtttaaaaacggaggagctcatatgtaatttaggaagaataaagcatggctccagaacaaaggaaagtctgaggtgggtcttcacctatggaaaggatttcagtaatagttaagaatcctagggttgggggctgggggagggatagcactgggagaaatacctaatgctaatgacaagttgatgggtgcagcaaacgaacatggcacatgtatacctatgtaagaaacctgcacattgtgcatatgtaccctagaacttaaagtattttaaaaagaagaagaagaagaattctagaggccactattgacagccagtcacagatttctacagtgaagataatgaaggagttccaaatggagacttgacgtagataggttcagggttcagagaggggggaatatactctccatcccaaaaaagaagaatggatcttgaagtagaaacctgaataaagagaggaaggagagaggaaaaagaggggagggtgaaattatgagaatgctgagccttacaccaccttcccacctcctctatctgtgactcctgaaattttagcaaagtttatacaagtcatgaaattctggctgtgattggattttctgtggaaactgatgacaggattaagttatttgtcctggctgaattaggcataaatagtgagaaatggttactcctagccaaatgtgtggtcctggacctgggtcacaaatattcagtccatagtggccatgtaggtattctcctgggattctaaatctcacatctggcaaattatgtgatttaatatcctgtgatcccaaagacccctttaggcctcaaattcttgaattttaatatttttaactgagattcattttattagtgctgtattcaaatgaaattattactttttaattttaatttttggatacaagtaaaaatgaaattatcttcagcattgatttgattttttagcacaacgcctctctaaataaagctcaaaataacatttgtttatgaaaacatgttcgatttcttgtatcatctcttttctactattttttttcccctcccattaagttttgttgttccaaatctaggcttaactcattttccaaaatgtaccaatttaaggttggacttgtttattgctcattcataattctaaccattcatcacattttgttgttttgcagtttcataaacttctttatttagcacaactctattgctggattaaaatgagcaacctttgtaataattaaatatctgtatagaaagggatcttttctcaacatgtatgctctttgttttggtttcatgcccccagatagttctgacaaactcaacaattgtgaatagcataaaaacaggctttttgcatgcagtaaaacaaagttaaagtttgctcaaaaatgcatgcagagtgaaattcttcaacgtggggaaaaggaaaaagtatggaactgcatatgctggatgctatgcattattatctcatttaataatcttaaaaaccttatgccgtaggttttttacatcttcattttacatgtaaatttcagtgatattctatggcttgcccaaggttgcctacctgtaaaggggtagagtaaggctttaaatccacatttgacttcaaagcctgtcttccttccattaaattttactttctctgggtacatgtcatactatcttgtggccacttatttatcagatgagataatgactgtatcaactctgtataaaccataaagtgctacataactatcacttatgttgctgtagttgataaaagtgaataagccatttaaacttcctaagtaacaaaaataagtaattgataagcccaattatgcacttagtcttactgccgtaattttacttctcatgtgtatatctaaacagtattttgtaatcaatacattactgccactgaagcattgaacatgcccgttccatattgtcaaggtttgaaaattcattgtatgatttagttgtgctggggaattgtgtgtgtctgtgttcttcagtaaaaactaaatacgacttctataatttgcatattttactccttagtaaattatgaactgataaaattacagtggtttttttgatgaaaatcaaaattaagctcggtaaacatattgctaaggaaatggtaaattagaaaaaccaaaagaaaaggttaggatctgcagtgggatgtagtatgaattctttaagagtgaatcatgtccaacaacttttcttaggaatatgaaaatgccatagagaagtatgttgattttagcagatccttttacaaacttatggctgtcatttagaaagaaagagaaatgcacatgagataatactcctagttttgaagagtaataataaggggtcagatgggacagtggtccctagcgctgagccaaagggcctgagtttcgggctgtgtctcatctagaattcattcatatctttgactcatagagaaaagaatgaacacaatgctgagtgagatcaacatatgacaagataagttcactttcaatgatagctgtaaatagaaaaaataatatttatataattgattcaaactttataaaattgactcaaatggaaaagttaatatttaagaaatttaaatatttatttcttttctgtctttgaaaaagtcaagtatacatatacagatttcagaacacttggactagcagcaatttgggtaaaaaagatccagtgagttcatttggaagcttgttctttgggagtgaactgtcaataaagtgacatagcaagccaaaaaaggaaaataaagttaaggaatcaggagcacagagatacatgttaacagtggaacacccgaggagcaaagatcaaccattgtttgtatgggttccataggtaaatctaaagcccgtgggtaaaagttccagaaagatcactatttagcttaatgttaaaaaggactatatgaaaataataaatatatataagggattctagacaactctgtcctagagtgaatctattttattcttttaaaataacatttttcatttttgcacaaaaccatgcttatatctgcaccattccagtttttagaatacacaacgttacaatcaacttgtttgcattttgatacacttctgttttcttttccctctagtacttctgcatttctgccctcaattagcattataaaagaggctaaaagccatggctgttgtattagtctgttttcatgttgctaataaagacatactggagactgggcaatttacaaaggaaagaagtttaatggagaactcagagttccacgtggctggggaagcctcacaatcatggtggaaggcaaggaggagcaagtcacagcttacatggatggtggcaggcaaaaagagagagctcgtgcaggcaaactcctgttttgtgaaaaccatcagatctcgtgagactcattcactatcacgagaacagtgcaggaaaaaccatcccccataattcaatcacctcccaccaagttctttccatgacacagtgggaattgtgggaattacaattcaagatgagatttgggtggggacacagagccaaaccatatcaggtgcacagccagatatatcctgatttaaatccaggcttaccatgtactatgtgatgttggaaaggtcacttaatttctctgaccctcattttctacatcagtaaaaagatattctctatatcactatgttgtttcaggacagtggactatgtgctttttaaattaggatatcctttaaaatatgttaaatatttaacaaataatacccacaagtaacagtttataaaagtatgataattcatgttttaaaacatttagtagtgtgtcagacacatagtaagtggtaaataaataaaagtgaataactattatgttaatgtgaaacaaattcgtataatgttgctccttaaacagtgtttcaaatttgtgaggacctgacacaaatcatttattttcacttcatgtgcctctaccaacaagcataaactcatgctatatgttcttcttagaagcactgtattgtttacattaacctctaccaagagaaatacaatggtgaagaaatgaaagaacgattcatttaaaacattggtgctagcatgtactgcatgtttcaagtagtatcataaaaccatatctaccctgcaaatatttcctcttttagtttgatcccaaaccaaaccttttattcttgcttaccagtacctcgccaaaactgagtttagtaaattggtggctgatacctgagaagcaaggaagcagttccccagggtgtgattagctatggaaacagttgatttcagtgagggttggagaagcagggagaggatttaacactgagtggttaaaaatagttcccaaggggaatctagggaggaagcagagatcttcaaaagtgctagagaagaaacacataaaatgaagtagggataagataccaacattttacccaggcccagtgtttactgtatgtatttggtcctggctacctgtatcattttgtttaatctcaagtatctaacttatgtgtttttcactttcatttagcaaatggacaaaattaaggctcagacatgttaaggagcttgccttgagagcccagttagtaacctagagtaaggacttgagtctagcttctgtacaaaagctgtgctccatgtcactgccttcagtggataaagtgaccctttcttttacaaagagggcacaattatttcacaattttaataggtaggcagattttttcccaagacctttagagataattttttagatgtaggcaaagtgttcagcagctaagtttatacttggagattactatgaatatcaaaatcctaaaatgaatcaagtttacaagaaagcaaaacaaagcaacaagtagcctaaaactagtgtttattaaactggtgttgcacttgactggggaaaacactcccccctacacctagatggatttttgttcatcttcaaagggcaactctaggaaaatttggaggcagagcttcctaaacatgaaattcttattaagaacttaaaaagttcttaagaaaagatgtgttttacttcccaatccatatttccaccaacgtttgttaagaaaattatatatatgcatatatcacatatatgcaatcataaaattattctgtcttagtaaatttccagtacgggttaggcacctatttttttttcttttttaatttccattcccttcagtaaaactgtggtagcattattgcataaaaatagattcagtttaaatgtttcaaatatatcatgctgttagcaataaccacgaagtagtatcgctgcaagaaagtaaatttctcattatttagcttgatgcctagggtcatgagaagaaaaaaaattaatataattatgtgtcagttctggcatctcagaagaatcttactttaatatttttagcaaactctcaccattctctggtttgttctgcttttcataaatagatagtttgtgtcaacgattgcccccaaagagttgagggtatgctatattattttttgcccttaactgatttcaaatttaggttgtaagtccattagcttttgacttaagacacaattctgagctcctatttttatgagtcctattttattttctgtgataaaaggggctgcacctattgtagcttgctctgaatttgtatattggaggagtctacagagcagaattgaggaaggagaaagagacttcctaatgagcactgcactcatcattcacagaattccatgaatgttttattgattaagtactgtgctttgaattaatttaactagtttaatttatgtgtgttcatgtcattgttttttcatcctttttttaattccccacctgagatgcagtgtattcatctttgtttttcttccatgtttatttcatttttgtgggggttagaggttaatgattctgaacactgcattcacatcaaacaaaagataagaccaacaaaaaatcctgtagaaattgtgtcattcttaaccacaactggtatggtatctttaaaattttatgaaaagctactgccttccttccttagagaggagagttgatttcttcagatacaagtaaggtgaatatccccagatgaatattcattgatgagctgatactgtgtgtcagctaaggtttgcttaggaaaactgaaactgctctagatatttgaccaagaaataacttcttaatacagggaattatatgcctacaaagctatggaaagggctgagggtcaagttcagaggaattattgctgatttttagacaaacccagaaatgtcaatatggcaggaagctatagccaggctttcagctgcctgcagtgctaaagtgaataatttgttgagacctaaccaagaagcctttgaaaacctcccattgccatccagccctaagtctaccatgtcacaaatggaggaaaggaatgacttctccatatcatctcctttccaaatcttttatgaataactctccttgatggaatttaaatggagcccttactattaggagaatttggaaaatgtggttttcaagcttctaactctttgggtcattgtgcttaataggtcagggatgacactgcattgacatatatataataaaaagcacactagtcagctcctataagtcttatgcagaattttatttttttcccaaagcactggcctgagtaatgttgaataaattaacactctgaatgtttatgtacccactcttatcctgtctcttaattgtagaaaggataagctttttctttttctttttttttttttttcatttataagatggtgttcttgtcaaggcataaatccaaagggaggcagatgtgcaacacacaggtaataagggagttccttagcaatcaatgagatttgaaatgtccagcttttctttgcctgtatgagcatttttgttagaaagtttgatcacattaaaaggtgaagcatgcagaaacctatttcagtgttttcactttatcttgctttagaagctaaaaggttatacctcatcatggaaatgttctttacagtatatctgatttgttgtctattggaaagcgattatgtctataacatcagtgaaaagagctgtagggaaaagagcaatgctcttcttgtgatgtttcattctttttgactgacatagcactacgaaaaagtattctgttttcctctgcaaataaaaataatggaaaaaaatatataatgctgaatctcgtcatcacaagagacggattttccctgaaagtttgtattaaagattatatggttgtgttggaacaatttgtaaagtttggaacaagacaatagtctcaattagctccaaagtatctcctattatttaattaattttttttgtgactatcctattataagaaccttcacaatggccagcacacttacatagactggaatttcgccatccggatttggattagcttattagagtttattactgcaaaagtgattatccagaaacaatattgcccatcttttaccattgttatttaacatcttctggaagtttgacattagacttttttaaacttggcactaacgtcattttgggccatagaattatttgctgtgaaagcggtcccgtgcactacaggctgtttaacagtatccctggcctatacccactagatgccaacagcactgctcccagttgtggcaaccaaaaatgtccccaggaattgccacatgtaccctgggggcaaagtcacccctggttgaaagctactcttctagacactgccgtataatacaaaacagaagtttgaaacaaaggtactgaaagggagataaaaatgattattttagataatgtgattgattgtctgaaaacaagacattcagctggaacgttatttgatctaatgacttaaataaagtagccaaaacaacataaatgtacaaaaatcaataactatcaataacaagttagcaaaggtaatttagaagtccgttttatactgggtagcaaaaacaaaagaaaaaactataaagaacacaagcaaagtgtgtgtggatattataaaggagaaaggaatgaaaatcatttcactcttccagacacacaagcatactgtaaacctataataattaaaacggtggtacacagatgaagtaactaaccattagaccttcatgaaatcttctttaaagtatatctgactagacaagtagaacagaattgcctcaaaactgactttgatttacataacaaagttagttttgaaaggaagccccacagatcaaaaggtaaaggaaggaaaataggcttataactgtaatcccagcactttgggagactgaggtgagtggatcacttaagcccaagagtttgagattagcctggtgagcatgcaaaacctgtctctattaaaaatacaacaattagccagttgtggtggtgcacagctgtagtccctgctactccggaggctaaggcaggagaattgcttgaacccgggaggcagaggttgcagtgagctgagatcgcaccactgtactccagccttggtgacagagtgagattctgtcaaaaaaaaaaaaaaattgaatgatgcaggtataattggttaatcatttggaataaaaatgttaaacacttcacacattacatttcaacaaaataaatgttgactgtcacgtgtcattcggtagggtctcattctacccgagagtctgtcttgtctttttcaccaggctacaggacattcaccccaaggcgtagctgagtcatttcgtgctttacccaccacagtttttgttagatacctctggcatgtaattccacatggggatatgcttagctttcatcgtgaatgtcccttagctgttgtccctgctaaactgtgctcactttggggagacttctgtcattgcattcccaggatctaacacagtggacttgttatttgttaagtacatttataaaaaggatcattcatttttaaaattgtggtaaacatatatgtaaaccaacatgtgtctgagacaggtctcaatcaatttagaagtttattttgccaaggtaaaggatgtgcctggaagagaggtctgtacttttctccaaagatgattttgagaccttcggtatttaaaggggaaaagcgagctggaaggaaaagaggaagggtatggtcacattactgaatcaaaatgttgcaagaaaaaaggagcagttaggggaacagtcaatgatgtattcccctcatggtcagtaaatcagtgctctacataaggtaaggtgaacatagagaagctacctgtgcagacagttaactttcatctgcagctatttgcttaggcataaaaggaaaagcagttgcttgcgtgactcagctttcaacttaattttctccttttggcatagtgaattggggttccaagtttttattttcctttcacatacataacatgaaatttactattttaacctgtttgtttttattttttagacggagtctcactatgtcgccaggctggagtgcagtgatgcaatctcggctcactgcaacctccgcctttggttttaagcaattctcctgcctcagcctaccaagtagctgggattacaagtgtgcaccaccacgcctagctaatttttgtatttttagtagagaccgggtttcaccatgttggccaggatggtcttgacctcctgacctcatgatccacccgcctcagcctcccaaagtgctgggattacaggcgtgagccaccatacccagcccattttaaccatttttaagtgaacagttcagtggcatgaagtacacatcgccaccattcatctccagaacattttcatcttgcaaaattgaaactttgtgcccattaaactccccattcccgctccctccagacactggcaaccatcattctattttctgtccttgaatttcactattctaggtacctcatagaagtggactcacccagcatttgttcatttgtaactggcttattcagttagtataatatcttcaaggttcatccattttgtacaatgtgttagaatttcctttctttctttctttttttttttttttttttgagacagagtgaaactctgttgcccaggctggaatgcaatggcgcaatctcagctgactgtaacctctgcctcccgagtccaagcgattcttctgcccagcctcccaaacagctgggataacaggtgcacatgaccatgcccagctaatttttgtacatttagtagagacaaggtttcaccatgttggccaggctggtctcgaactactgacctcatcacctgcctcgtggatcacctgccttgtcctcccaaagtgctgggattacggttgtgagccactgcacctggccagatttcctttctttttaggaatgaatattattccatcctgtgtcacattttgcttactccattcatttgtcaatggacacatgggttactttcatcttttggctatgtgactgatactactataaacatggacgtacaaatacctgtttgtgtccctgctttcagttcatttgggtatatacccagaagtggctttcctggatcctatggaaattctatttttaattttttgaggagccaacatattgtttctcatggtgggaattttaattctcaccaccaatgcacaacagtccaatttttcgtatctttgccaatatttcttattttctgtttgttgtatttgtttttaataatagtcatcctaatgagtgggaaatgctatgaatctttcatttttatacctagaatgtatctcagcagttgtctcatttgacttactcattacaccttaagcaaacctagactcagattcatgggatttactctaggttaaacgactacttaacatctttcctgacccctggtccagtgctcctcccaacaagccaaaatgtccctatggtcatacaagtagacacaaagaggaacaggccagaaactttctattttaactttatctttgcctccctcttgctttatagctaaacattttctaatatctcactataaaaaagagagaagaaaattataaggctatagaggcaacaactataaaaatgttataatatataaaaagctcaaaaagaaacatgagcaaatattatttcctccacaaactaataagtaaggatgaattaaagagtagtttacactctcttgctcaacaataaattataagcagccaaagtagttttaatttattagtatactgtatgtttaggaactcgatgaagtagtttggagggaatggctacatataaaggagtgctcagcatattagtgggatgtgtattgactattgctttgtcattttctattaatatgaagagatttggatttgatttttagagttctcaaaatatttgggaattcagaggtaatgtagtctgtgaatattataaaatgtgccatttctggcagcctaaaaccagctgcagaaaaagaattgcttgtctaaacatccaatcacagaatctttccctttcactgaaattgatcacaacacaaaaataacttccgcacatccatgaatatattaaagtggcataaagaagaaattctgttgcctgcaaagattacacctgcctcaaagtcatgatcaccggaaaaaaaaacaaaaccagtgaaataaatctaagatatggctatttcctccagagaattgaaacagcctaaatagaagcaatgctccttgaagcaaaggaaattcttatgtcacaaatcctactgcaaaacccccaggcccccttgtattttcccatcacaaacatatcaaacatttttttttttttttgcagttagctacatccttatctagaccataagctccaggaaggcaggatttatggctacttcgtttattactatctccccagcactttacttgagactagacatataggaaatagtcagtaaacacttgttgaatttgtgaataaatattgaatattagcaaatatgtatgaacacaatttagaaacttctaatttttaaaagctttgaagttttatttctgcacaggacacaaagggttttttcttactaatttcctcatatctatttttaaaatgatcactatcttaatccgttcagactgctataacagaatactatagactggatggcttataaacaacagaaatgtatttttcatggttctagatgctggagagttcaagatcaacgcacctgcagatttgatgtctggtgagggctgcttcctgattcatagatgactgtcttttcacaatgtattcacatatgcaagggatgaggaagctctctggggtccctttataagggtgctaattccattcatcatggctctgctctcaggacctaatcacttctcagtggtgttaccttcatataccatcactttttgtgttaagtgtcaacatatgacttttggacaacacaaacaatcctattttatctcctgctttggagaagagcattgtttagcagaggtcaccttgaataaaaacaactgatacttctcaactcttagtgtctgcctggcattgtgctaataaacatttcctggatatctaatttaatccttatagcaatcctgtgaggcagatgctattgtaattcctatgccacatatgagaaaaacgtggcttgaagagcttaaatatctacccaaagtcattatgccactaagaagtggaattcagtcacctgtggtgttaattttggttcctactggtaatggactcatcagatgttcaccagcagatagtcccagagtgctgtctctgaggattccaatggagaaaaatgttatagccactactctgaaaacacggagtgtacactagacaaagaagagcaagggcagaaatcacagtgtgttcacacaacagcattccatgcaattgactcatagttttgcatggcaggggaggcctcatgaaacttacaatcatggtggaagggggtaagacctccagaagcctcactcatttggatttcacctatggtagaaacaaatcccctgtgatatggtttgactctgagtccccacctgaatctcgtcttgaattgttattgtcataatccccacacgttgagggagggatgaggtgggaggtgattggatcatgggggctttttctcccatgctgttctcatgatagtgagtgagttctcatgagatctgatggttttataaggcagttttccctgctcttgatcattctctctcacctgttgccatgtaagacatgcctcttccccttccaccatgattccatgattgtaagtttcattaggtctcccctgccacatggaactgtgagtcaattaaacttcttttctttataaattacccagtcttgggtatgtctttatagcagtgtgaaaatgaactaatacaccctgtctagaacaattaacagtccaaactaagtgatgaccaagcaatgcagaaaagaactgttaaaatgtttaagtactcaattgtttattctagaatggccctttcttttatccttcagctatctagacctgagagcttattaatgttctaaaacttaatttaaatgctacctgtcctctgaaacgtactcccagtcccaaataaatctttccttcctcagtgcatccattctgttatacctttgtctatttaggcgtttaattggagtaatgtaattcaaagagtttaacatcaagagcagttacattttaaaataagtaggtaaattatctggaaaattcactcattccagaacactatatctattttaggaaatagtcaattaaacatcgtattcaaccaacaaccagccatatagggctcaataattgctgtgattagggaatatttcttgttgaaatgagcaaaatttggttgaaacataatgattaagaaactaaatgagccacagaaaatccacttgaaagttctattcacttaaggtataaatacaaaaatatataaacttttaattagctatttactttagtatatggttcacttttttgcttatataggctaaaataaagtagccttttacttgaatactggcttttggttgtgataacaattcagtttcaaatgctgaaggcaagtcttagtttaatatcttagagaaagaggagagaggatgagagggacttcctggggatgtttctttgtttctctgctaactaaatttttaagaagatttgacttagaaggagtgggtatgtctgggcacaatggctcccacctgtaatcccagcactttcggaggctgaggcgggaggatcacttgagcccatgagtttgaaaccagcctaggcaacaaagtgagaccctgtctccactatacatatatatatatatatatatatatacacacacacacacatatatatatgtgtacatatatgtgtatatatatgtgtgtgtgtgtgtgtgtgtgtgtgtgtgtgtgtgtgtgtatttatatatatatagcggccatggtggtgcgcactgtggtcccagctacatgggaggctgaggcaggaggattgcctgagcccaggaggtcctggctgcagtaagctatgtttgcaacactgcactccaacctgggtgacagagcgagacctggtctcaaaaaataaaagtaaaaataaaaggaaggcagggttcaataaataatcatttgtaccgaatcagctagggtgatcattcatactaggggaatacttgtataaagagaacagggaggatttattcatagtttgagatactaagttttacctctggtaaaagctgccatcaccctttctgcttgcctgtagatcaagtacatggcagaaatccatgttgttggaagacttgcagctgagatgagaaaccagatgatgctttctattatgagtctattctaagtagtcccatttctatgtatcaaatgaataaattttgttcttgccccccacctctatatgaatattctgtgtgggcagctagctatgctttctattcttaggcagaaatatgtggctctcgggcctaaactattataacatttaaaaaccaaatttgaattcagtacattcaagcctcttagatccatagggactttagagacattaaaccttaaggcctcctgatagagattattttgtaaatttagctcttaattggccatatatattgatggaaagccacaaagcaaaagtgcatgatgatttcatttattctctgtgtcttcctgagagaggattcagtaactcttgcatttgcaaaagataaaatagatagcttttctgatggatggaggtggctgaagactatatttatccttagattttcagatatgaaattcatttgaaatgcagttaagttcatttgtatgaatatttcatttctcttaacaatagtgacattggtgggttctcagtttacttaaatccacatgttttctctcagcccaagtgtggtcatagtggtcgatgatttcaacttgtctctccaaataaataatatcatcctggataacaaagactgttttattctccttctcttttattcccctcacactgatcagagtgctgggtgtgcagtaggattttataagtatttgccagcatcttaggaaagaaaatttttctaaaccaaagagagaaaaaaaattgtaggcataaatgctaaatgatgagttaatgggtgcagcacaccagcatggcacatgtatacatatgtaactaacctgcacattgtgcacatgtaccctaaaacttaaagtacagtaataataaaataaaataaaataaaataaatatattcatactgtggaaaaaaataagcctaaagtcttgtactttaaaaatcaaaactcaaagtaaacttttcatgcaattttcttctttttttttttttttccagacagggttttgttctgtcatccaggctggaatgcagtggtgcaatctcagcttactgcagcctcaacttccctggctcaagcaatcctcacacctcagcctcccccataggtgggactacaggtgtgtgccaccacacctggctaaatttttatatgatttctagagaccaggttttgccatgttgcccaggttggtcttgagctcctgagctcaagcgatccacctgcctcggtctccaaaagtgctgagattacgggtgtgagccaccatgtccagctgcaattttattcttatataatttgtattccagtattagattttaaaaatcaccaaaacattatataatactaagagcaaaatgtgtataatctatacatccacctccaccacccctaccataaacttcacttcttgcctccagttttcttaagattcggctcaagtagcatcgcttccaggaggccttcatagtgcctccgcattggatatcttatgctaaaaatactttcttacccattaccttaagctccctgatggccaagtgaatatcccatttatcattgtttccaaaaacctagcaaaatgcctagcatgtagtaaacattcaatttaaaatgttaaacctaaatgccagtcatttatatatgagttttcattatcctggaattttttttctctttttcatcatctctgtaacatccaagtcccaggatttgagttaccatgggttgctggagaccctcaccataacatcctctatgcctgtggttctcaaacttaacattagagtcacctggagaatttgaaaatagatggatgcttgtaataagacatatcaacatcatgtgccccggatgtgatatacagagaggggccacaacgtggcttctgcagtatccttctcaaaagtgcataacccagtttaatcctgagaaaacatcagacagatgtaattcaaggacacttacaaaatagccagcactcctccaaatggttattgtttttttccgcaagggatttttcaagggtgaaatgattcattttatgttatataaatttcacctccattttcaggatctaatgcaggatcctggattggaccctgaactagaaaatggacattactatgaaaactggtaatattcaaataagaccggtagattagttaaaatattctgtcacatgtcctaatttcgataattgcactatggttaggtaacacaattttagaggaatctgggtgaagtgtatatggtgactcttaatgccattattgcaactttactgtaatctacaattatttttaaatagaaacttaagcatttttacaaagtgacttatgtcacccccagatgtgaaacctgggcattgggacctttaaaaatccccacaaattatatgagaaccagtgctctaagccaatgttagttgaccttggttgtccattagaatcagcagggaagattttttaatatcttaatgctcattcttaaccccagattaaagcagaatgtccaagagtaggaccaaggaattgatatttttatttattttaaactttgtgaaaaaatgttattgtatatatttaaagtatacaacaggatatctatatagtaaaatggttattataataaaacaaattaatgtattaatcatctcacagttaccagttttagtccctgtggcattagcagttgtaatgtactcatttagcaaaaatcctgaatacaatacattaactatagtcctcatgttgtacgttagatccttcgatgtctccattctacatatgctattttgtgttatttgatctacatctccccatttctccctctgcccttacccttggaaaccactgttttatattttttaaaagctcttcaggtaattccatgcaagtcatgggtgagaactgctgctgcaagctaaggttcccaaatgtgcatgataataagtatattgtggaatggtccaggatcatgagcattttaatgtagaggctcccactaaaaatctactgaatcaatattcagggaggatagtattttaacattcactcaagatgagttttattatcagaaaagtttgggaagtattatatgctgtctagaaattctaggtgtggtccagcttctgatagtgaagtttaaggccctactaagagatctttcacacagctggtagtagcaggaaaatgaagagtctatagatgagaaatccccaattccaatggaatataagtaattgtggccattatttattcactaatgattttctaagcgctttctgtgctcattactaaagacagagtagtagacaattaagtccctgacctatagaacttgcattccagtggtagagggatagaatgataaataagtataaatgaatatgataaataatttataaatgaatatgatagtttcagataaattactattaaaaaataattttaaaacggcccaaatatccataaacagatgaacagacaaattatagtgtgtgtgtatatgtatatgtgtatgtgtgtgtgtatatatatatgtgtgtgtctgtgtatatgtgtgtaggcatacgtatatatatgtacatatatatatatatatacacaatggaatattaaactataaaaagaaatgaagtactgatagatgctatgatgtaaataaaacttgaaaaaacttagttaaatgaagtaagacagaaacaggtcacatattgtatgaatcaatttatatgaaatattcagaaaagatcaatctgtggagacagaatgcatattgatggttgccagggcctggggtagccaaaatgaggagcaactgcttaatggatatgatacttcctttttggtgatgaaaatattttggaactggatagaggtggtggttgcacaatgttacaaatgcactaaattccactgaagtgtccactttacaataattttatgttatgcacattttgccttactaataataatttttaaaagttccttatgatgtcatcagagagagatgtgggacagtaagtgggtacttgagattgggccatcaaggaaagcatctccaaggaaattgcttttaatttaagacctaaatgataagaagccagtcatgtaaacatcaagaagtagagaatcccaaatgaatcctgcctctgcctttattgtgtgtgtgtgagctgggtggaatacttaatatctctcagcctcatttgcttcatctgggaaacaggattatagaaagatctaattcacaaattgttctaattaaatgagatcatgcacagaaagatgagcttagtaggaagtcatatgtccttaagaatcaaaaggcaaaaaaggaattgaaaactcactccagcaaaagctgatcagaagccccttgttatgcaagatgaccagctaatgccaagtctgttttacataatctttcctcactgattatgtaatgattctgctggtgttgcttcacagtcacttttctgtgtatatgtttcaccactaaatgttctttctaactcactgtgtttcctaacagctagtctgagctttcctcccatagctttgagccgtggcttcttgctctcatcatccaagactgagcaattcccttccctcattaattttgtaaccttgaagatatttacgcagtttgaacaaatactcacctgcagttttcttttttccccaaactcttatatgaatctaattctttctttttcttctcacacataatatacaaactcaaattcctttctccctttgtgtttgctctaattgtggttaataaaacatttcctacattgagcccttccaattaattaagattattttcctgttctaattgaggaaatatacctgaaaagctgatcaacaggatttaaagacatctttccactttattggtacttaaaaccattttcatttcttgctattctttttaaggtaagctgaagcataggaaataattccatacatagctgtaaggtaatgttcaggttaaaatgaaattttaattatgtaaatcatatagtttggggttatgttattcatagagttctagactaaagtttttcctcaataatgttggtgattgacaggcaactcaggtgagtagcatttcctaagcttgtatatctgagctacaaaattctatacccataaattagcagaaagcatggtaaaactactgttttttagaattctacttttttttttttaaattaggaataactttactgcaaggcaactcaatttttttttcctagattccacatgttgaattcatcacataggatactctggcaacaaaaaggaatattgggacttagcatttattcgctctctctgcaggcacctaatgatgaatttagctaaaatgctgcaagaacaagcccttacagttgtacataaaatctgctgtcctatgcagggttaaaggccacacatgttggtaacagaatttttctctcagaagtgggttctttgttgagacttgccttgttccttttgtttttatttttaagaagagacttccatctcaataaagaaggaaaaatcaataagtgataatttaaacataactcagaaactgaattgaaaactgaagatatatgagcaaagcaaagtatattacattttactgtgattgttaatctctatgatttgaagtcagactggctttgaacttccgctttaccactgagtagatttttttaacttggaagaagtcattttatctctctaaacttccatttcaccatgtacagagtgggcgtaacaatcatggcttcacagagttactgtgagaatcacatgagtaatgaactcctaattctaggacatatgcataggaaaagcttccctcttgaagaggctactctggggagtaaaagcacatagccttttcgtattgctatgtaccaaagcagcccaaaagccagcagcttaaaacaacaaccatttatcaaactcagaattctatgagctggcaattccaaagccactgccctggtacagaatcaccaccctggattccccctgccaggtgattgacagtcctctagttcctagataatcaggtggcctggtaggccaaatggaggatccgggacagcaagggagagggccattggaaggctaaggcagcagctatatattagccagtacaaagtattctgatacacaatggttaaatgttggctatgttagccctgtcccattcatattacaatccttttcctgtccaggttgccccaagcatcttgatatcttattaatatacccataaaatagcagaaatcacagtaaaactactgttttgtggaattctactttttttattaggaacaaccttattgcaagacaaccgaaaatcttttccaaaatcataagatgatgaattcaacaagtgagatgaatcacataggatgtgagggcccaattagcattggtattccctatatcttcacaacaagtatactgcttatatccatgtgtctgtccatccctcctaccctaaatgccaataaacccacatcaagaacaagcacacattatatacatacttcttggaaatagggcaacaattcttaggagaaaaggtggtagtgatggtgtcttttcctgagaattttccaaatctttaagttggcttcccttttgattataaatttcacctttaattcatttttattttcttgcatttttctataatcagtgaagagaaaccatgccacgctctcaacactttacttagatatttattctctgaaataccccatttaatcactcagaagttctatcctccacaaaacactgggacacgaacacaattcagccaggttctttgtcactttataacaaggatggactttcctccagcttccagtagcatgttcctcatttccatctgagatttcatcagaatggcatgtactgtccatatttctaacaacattctgatcacagtcacacaggtaatctctaagaagattgaggctttctctacagctctcctcttcttctaagccctcaacaaaatcatccttacaactattttcctggtaatgtacataaaaatctcttccagcctttatccattagtcagttccaaagttgcttccatatttttaggtatttgttacagtatctccccacttcttggtaccaatttctgtcttaatccacttggactgctacaacataatatcatagaaaataaaaaacaatactgtaaaaccatagactataagacaaatttatttcttacagtactagaggctgagaagtccaagatcatagcaccagcagacttgatatctggtgagggttttgacccatagatggtgtgggtcctttttgctgtatcctcacatggcaaaaaggctagctggctccctcacctcttttatgagggtcttaatcccatttatggggcggaacctcatgacctagtcaactcccaaatgttctacctcttagcaccaacacactgcagattcgatttcaacataggaattttgatggggcacagagagatgggtagcttgaaaaaacatattcagcatttcaatgatatagcaattatatttgtcaagtgggacaaaaacctccattttttcagataacagaaaataagctagtggagatttgcacagacatgcagttcttgaagtagcaaaagagacacaccccatttcaaaagacatcatgggttaaaaccgagaaacatgaaactagagataatatggagaaagctagaggaaatatagtaatatgaagaaatctctggggtacagcccaggagcctatattttaaataaatgattcctagtggtactaaagttggaaaaccattggctacaaactattcactgtactgaggaaatgcagttgtaaaagggcactaacctggataataaagagaggtactgcagcttgctaaggcaagttcaagatatccactggttacagatttctgccctgtaagctgggtagggtttttcttctgtgctttttttgcataaatccacccttaagcccatcttgatagcaccaacactccctacttactcattttacttctatgggagttgtgtaaaactggctaggattgctcgaagcagacatccagatgtagttcccatcctgaaccttgacagataactggttcagattcttctgaagcatctgtaagacctggaagtcccatctgctgagcaggggtgctgacctgagtgactttggctccaaatagcactgaagtcacagaacactctccaggggccacaacaagtagatcccactctctgatgaaaccactctacttcagccatctcatttttacacaatatgctacaacaagcttgactttagaatgtgtcgaataggaacacgtctggtctgcagctcccagcaagaccaatgcagaaggtgggtgatttctgcatttccaatggaggtaccgagttcatctcattgagactagttagacaatgggtgcagcccacggaggatgagcaaaagcaggatggggcatcaccttacccgggaagtgcaagtggttggggaactctctcccctagccaagggaagctgtgagggactgtgccgtgaggaacggtgcattccggcccagatactatgcttttcccatggtcttctcaacccacagaccaggagattaccttgggtgtatacaccacaagggccctgggtttcaagcacaaaactgggtggccatttgggcaaacaccaagctagctgcaggagtttttttttcatacctcagaggcgcctagaacacctcaagcaagggagccaagtggtcttgctcagcggatcccacccccgccagagcccagaaagctaagatccactggcttgaaattcttgctgccagcaaaacagtctgaagtcaacctgggatgctggagcttggtggggggaggggcatccaccattactgaagcttgagtaggctgttttcccctcacagtataaacaaagccaccagaaatttcatactgggcagaccccaccacggtgctgcaaaactgctatagccagacttcctctctagattccttctctctgggcaggtcatctctgaaagaaaggcagcagcacagtcaggggcttatagataaaactcccatctccctgggacagagcacctgcaggaaggggcggctgtgggcgcagcttcagctgacttaaacgttcctgtctgctggctctgaagagaacagcagatcccccagcagagcgatcgagctctgctaagggacagactacctcctcaagtaggtccctgacccccgtgcctcctgaatgggagacacctcccagcaatggtcgacagacacctcatccaggagagctctagctggcatttggtgggtgcccctctgggacgaagcttccagaggaaggaacaggcagcaatctttgctgttctgcagcctctgctggtgatacccaggcaaacagggtctggagtggacatccagcaaactccagtagacctgcagcagaggggcctgttagaagggaaactaacaaacaaaaaggaatagcatcaacatcaacaaaaaggacatccacacaaaaacaccatctaaaagttaccaacataaaagaccaaaggtagataaacccacaaagatgaggaaaaaccagtgcaaaaaggctaaaaattccaaatccagaatgcctcttcttctccaaaggatcacaactcctcaccagcaggggaacaaaactggacaagaatgagtttgacaaattgacagaagtaggcttcagaagatgagtaataacaaaaatccaccaggctaaaggagcatgttctaacccatagcaaggaagctaagaaccttgaaaaaaggtgagcggaatggctatctataatacccgtttagagaagaatataaatgacctgatagagctgaaaaacagcacaagaacttcatgaagcatacacagtatcaatagccaaattgatcaagctgaagaaaggatatcagagattgaagatcaacttaatgaaataaagtgtgaagacaagattaaagaaaaaggaatgaaagtgaatgaacaaagcctcctagaaatataggactatgtgaaaagaccaaacctatgttagactgctgtacctgaaagtgacagggagaatggaaccaagttggaaaacagacttcaggatattatccaggagaacttgcccaacctagcaagataggccaatattcaaattcaggaaataaagagaacaccacaaagacactcttcgagacagcaaccccaagacaaataattgtcagattcaccaaggttgaaatgaaggaaaaaatgttaagggcagccagagagaaaggtcgggttacccacaaagagaagcccatcagactaacagcggatctctttgcagaaaccctacaaaccagaagagagtgggggccaatattcaacattcttaaagaaaagaattttcaacccagaatttcatatcccgccaaactaagcttcataagtgaaggagaaataaaatcctttacagacaagcaaatgctgagagattttgccaccaccaggcctgccttacaagagctcctgaaggaagcactaaatatggagaggaaaaaccagttatcagccactgcaaaaagaagccaaaatgtaaagaccattgacacgacaaagaaactgcagcaactaatgggcaaaataaccagctagccacataatgacaggatcaaattctcacataacaatattaaccttaaatgttaacgggccaaatgtctcagttaaaaggcacagactggcaaattggatagaatcaagacccattggtgtgctgtatttaggagacccatctcacgtgcaaaggcacacataggctcaaaataaagggatggaggaagatttaccaagcaaatggaaagcaaaaaaaaaaaaaaaaaagaaaaaaaaagcaggggttgctatcctagtctctggtaaaacagagtttaaaccaacagagatccaagaagacaaagaaggacactacataatgataaaggtatcaatgcaacaagaagtgctaactatcttaaatatatatgcacccaatacaagagcacccagattcataaagcaagttcttagagacgtaaaaagagactaagactcccacacaataatgtgggagactttaacactccactgtcaatattagacagaacaataagacagaaaattagcaaggatgttcaggacttcaactcagctctagaccaagcagacctaataaacatctacagagctctccacttcaaatcaacagaatatacattcttctcagcaccacatagcacttattctaaaattgactacgtaattggaagtgaaacactcctcagcaaatgcaaaagaacagaaatcataacaaacagtctctcagaccacagtgcaatcaaattagaactcagattaggaaactcattcaaaaccacacaactacatggaaactgagcagcctactcctgaatgactactgggtaaataacaaaattaaggaagaaataaataagttctttgaaaccaatgagaacaaagacacaatgtaccagaatctgtgggacacagctaaagcagtgtttagagggaaatttatagtactacatgcccacaggagaaagcaggaaagacattgaatcgacatcctaagatcacaattaaaaaactagagaagcaagagcaaacaaattcaaaagctagcagaaggtaagaaataactaagagcagaactgaaggagataaagacacgaaaagcccttcaaaaaatcaatgaatccaggagccagttttttgaaaagattaacaaaattgatagaccgctagccatactaataaagaagaaaagagagaataatcaaatagacacaataaaaaaatgataaaggggagatcaccactgatcccacagaaatacaaactaccatcagagaatactataaacacctctacgcaaataaactagaaaatctagaagaaattgataaattcctggacacatacacacacacacccccgccccaccacgactaaaatccctgaatagaccaataacaagttctgaaattgaggcagtaattaatagcctaccaaccaaaaaaaacctgggaccagacagattcacaagtgaattctaccagaggtacaaagaggagctggtaccattccttctgaaactattccaaacaatagaaaaagagggactcctccctaactcgttttatgaggtcagcatcattctgataccaaaacctggcagagaaaaaacataaaaagaaaattacaggccaatatccctgatgaacattgatgtgaaaatcctcaataaaatcctggcaaactgaatccagcagccattaaaagtttatccaccacgatcaagttggcttcatccctgggatgcaaggctggttcaacataagcaaatcaataaatgtaatccatcacataaacagaaccaatgacaaaatcacatgatttcctcaatagatgcagaaaaggccttcgataaaattcaacacaccttcatgctaaaaacactcaataaactaggtatcattggaacatatctcaaaataataagagctatttatgacaagcccgcagccaatatcatactgaatgggcagaagctggaagcattccctttgaaaactagcacaagacaagaatgccctccctcaccactcctgtacaacatagtattggaaattctggccagggcaatcaggcaagagaaagaaagggtatacaaataggaacagaggaagtcaaattatctgtgtttgcagatgacatgattgtatatttagaaaaccctattgtctcatccctaaaactccttaagctaataagcaacttcagtgaggtctcgggatataaaatcaaagtgcaaaaatcacaagtgttccaatacaccaataatagacaaacagatggctaaatcatgagcaaactcccattcacaattgctacaaagagaataaaatacctaggaatacaacttaaaagggatgtgaagaacctcttcaaggagaactacaaaccactgctcaaggaaataagagaggacaaaaataaatggaaaaacgttccatgctcatggataggaagaataaatatcatgaaaatggccatactccccaaagtgatttatagattccatgctattcccatcaagctaccattgactttcttcacagaattagaaaaaaactactttaaattctatatggaaccaaaaaagagcctgtatagccaagacaatcctaagcaaaaagaacaaagctgcaggcatcatgctacctgacttaaaactatactacaaggttacagtaaccaaaacagcatggtactgctaccaaaacaggtatgtagaccaatggaacagaacagaggcctcagaaataacacaactacaaccatctgatctttgaaaaacctgacaaaaacaagcaatagggaaaggattccctatgtaataaataatgttgggaaaactgactaaccttatgcagaaaactgaaactggtccccttccttacaccttatacaaaaattaactcaagatggattaaagatttaaatgtcagactcaaaaccataaaaaccctagaagaaatcctaggcaatatcattcaggacataggcatgggcaaagacttcatgactaaaacaccaaaaacaatggcaacaaaagccaaaactgacaaatgggatctaattaaactaaagagcttctgctcagcaaaagaaactatcatcagagtgaacaggcagccttcagaatgggagaaaatttttgccatctatccatctgacaaagggcgaagatccagattctacaaggaacttaaagaaagttacaagaaaaaaacaaccccatcaaaaagtgggtgaaggatatgaacagacacttttcaaaagaaaacatttatgtggccaactaacatgaaaaaaaagctcatcaccactggtcattaaagaaatgcaaatcaaaaccacaatgagataccatctcatgcctgttagaatggtgatcattaaaaagtcaggaaacaagaaatgctggagaaaatgtggagaaataggaatgcttttacactgctcgtgggagtgtaaattagttcgaccattgtggaagacagtgtggtgattcctcaagtatctagaactagaaataccatttgacccagcaatcccattactgggtatatactcaaaggattataaatcattccactataaagacacatgcacacgcatgtttattatagcactattcacaatagcaaacacttggaaccaacccaaatgcccatcaatgttagactggataaagaaaacgtggcacatatacaccataaaatactacgcatccataaaaaacaatgagttcatgtcctttgcagggcttgaaactggaaaccatcattctcagcaaactaacacaggaacagaaaatcaaacagcgcatgttctcactcataagtgtgagttgaacaatgaaaacatatgggcacagggagaggaacattacacattggggcctgtcgggggttggagggcaaggggagggacagcattaggagaagtacctaatgtagatgatggtttaataggtgccgcaaaccaccatgccgcttgtatacctatgtaaaaaacctgcacattctgcacatgtatcccataatttaaagtataataaaaaaagaataataaaagaaagtgttcatgttacctctcatggaattattttgttttcaaacttggtgcatttggtgcagtgaggagagagaagagaagaactttttcttttatacatgcttgctgtgtacatagagatttccaagatattgaatctatttagattcaggaaaggtggaccaaacacttcaggtaaattcctcaggttttaaaatgattactcatcgcttcaccagattctctgaaattttatcagcagtgtgtgctttatacagatgcttcctgaaaagggggagatacttagtttaatgccatggcttttgttttgtgcttacttcagtgaggaatgagttaaaattcattttttagcctcatctgtttacatttttttctatgagcagatggccagataattacctaaataaggagttacttttctggagttggcctgccaagatttactgtaataccaaatacaaatgctattacaatgaggaacatttggaagcttacatttgtgtgtcaaaatagtaaataatttgaaagctgtatcttttatgcatccttttaggacatgaagttttcaggaagagttgataagggtaatgcaaaccaaataaaggtaatgaaaactaaataatttttaaataattttctgcagctctccattccagtttgttaatacagaatatcttcaattaaaatgtaaatggaattcattgcatgaagcgatctatctggatgatatgtcatcattgaataatttactaacagccactgaacaatgtctaaaataaagtagaatcattgcttcatgattcaaattatgacatgttataatcattcctctttagtactagatgaatgtgagcctgaaaaagtttcttagccttccagagtctttgtgttcccatctacaaaatgaggaaatggaaacacatttcctcaggaatacaagattctttcctgatctaaaattctgtgactttgttatatcttgttttcttctgcactactgatcaagtaacagaaggaagactcatttcagactcagatatgaatttaaatcttgctttctcacttcctagctgtatgtacatgaacaagacacctttgcctgagctacttcatttggaaaaaaatggagaacacgtacctcatgggattacgataaataaacaaggaagtatttaaagttccaatactgattcttcacttatcaagtcctcaataagctgtatttcttttcttatattccatcattttagaattctcaaatctgccttttctatgaaaccttccatcctctcctcccaatagaaaagactacaattctggagaatgtactagacggatgataaaatatagatgagaattatagcagataaaacataaaagacaattttcccctcctcctgagttgtcttagtaaaaagaatgatggcagctcttgaagagagttgtccctcctgctgttcccttttccttttgtcactgaggtctcacatccagtttgcttttgtaaatgaaatacatccaaatcacgagaaagtggcatgcttcctgtatgatagaatacctttcctcattgctcctttccaacaatttttaaattatttttgctattgtatatcccaatttttaaaattaataccaacatgattatttgttcattatacaaaatactagaaaataaataaatgtaagacattaagcataaacacaccgtccagggagagctactttatataacttcctatattttctaactacatgtaaacattatgtaaaacgtgtacaaaacaagagttaatactatatatttctaatgtaagcatcagaataagtgttctataaaggctggggtgtgctttgctttgatatctgtttttcagtaacatgctggacacagggtacgtactggatacccttttaaacttagtatattccatatatctttttgtgtcaataaatacaattctgcagcatcacttttaatgatcacatagtattctacaatatagataaaatcaaaacttaatttatttcctactttgacttgtcaggctttctgtgttttgttcccccataacagtgttttaatcaacacccatgcaaacaaacctatgccccccttcttctttcttctcaatgattttgtttggataaattcttaaaaggagagttgccaagttcaagtaatctactcacaatttagggaatcattacatattgccaattgttctctaaaagattatatcaatttacaatccagtcaactgagattgagcatttttctgcaattgcacgtataggtattatgttgaaaaataaaaataaaaaacacatttaaaaagcaaatcatcgcatcctaagtgttgaacggcaagaacatccattcttcatgctatgttaccagcccacgacaactttccaaacccttttccagatatacaagatcctataacccagcgaagatgcagtctcactaaatcggtataaagagagttctgtcttgtcttactaatttgattaatttaggagaaatgacaggaaagttcatataaattgtccattgacattcacatgaattctctcactttgacattttaccattctacgtcagtatcactttcagtaaataatgttttacatgcagatagttttacaatgcccatttaaattaattctaaactgttatgaaatccataaaaacccttgtggaacatttgtagcttgtacagtagtctcccattatggaatcaaatgtgaaatgtctgtgtgggagctgttttcctaaggtaaatagattattatttatatctctaggtgcaaatgcttttaaataaccagaacatacagcatctgaatatgcccttacataattttcacagctgctgcattcttgtcagtgcactgtcatggtgaagctttgatgctttgatctgagtttgacccctggccatgattcttgcttgtgtttttatcatccactcttaatgtgaacaataaatctgataatatccagtagtgcttccttatgttctctgactttgacattcagaaaaatcattaatgctgcttccactgtgtctacatctccatacttgtgattttcttcccctttgaagatattttagaatacatagtcctggaagtccaggaccaatgactttgtattttctgtattgcatagtgctccgctttgtacttgccgtattgcatagagctcaatttgatatgatcaaatgatgattaccaagagctttagatatgatttcactttttatgaagtaaccaacatgaacgattaggaaggagcctgagtgatagggtgaaattggaggggagaaaatggagaatttagaaagattaagtaacagaaactctatctcaaattgatataaataataagagaagttcacaggcacatgtgcctgaagtacagaggtcagctgacttgagactgttctctcttctgaaatggtgcaagaagaacccttttccatcctgtgagaaggaccctttttcatgctgtcttcatttcctgactctgcttccttcatgctgactccattttgtgcaggcttcctacctcattgtccccagatgcctgtcttgttgacattcaggtttcttcctgattaagctgtccaatctaaatagccaacattctactgtgaacagttgggaacttgaatctcatacctgctatcttattcacattcagcaaacaagagcacaggtttttcactctcaaacaaaattactgagttttgacctaaacaaatcaccctagagcacttgcccattctataccagtaatgcagcttggtatggggtcatgccaattagcttagacttgagtcaaagattctaattcagaggtcaagccagctacccttgaagcacacgggacacattgttccaaagagttggaaccagtaaacaaatggaagtgctaccaccaagagcaagaggaatatatgctaggtggccaaaaaggcagatatccaccaaggtagctacaactaaatggaaacattgggttttacattagttagttcgggctgctgtaacaaaatatcatagactggtggtttaaaccagagaaatgtattttctcacaatctgaagtctggaaatcagagatcagggtgccagtgtggttgggttcttgtgaaggctctcttcctggcttgtagacagctgctttttcactgtgttcttacatgagaaagagagacagagagagagaaagctctgtggtacctctctggtgcccatcatgaaggcctgaccctcatgacctcaactaaacctaattatatttcaaagattccttccttaaataccattgccctgggagctagggcttcaacatatgaactgggtggcggccaggggtgtggcataattcactccacagcattcctcccctgaccttccaaaattcatgtccttcttgcatgcaaaatatatttattccatcccaacagcccccaaattattaactcattccaagatcaactctaatgtccaaagtcttatctaactctcatgtaaatcataggggtgagatacgggtgagactagaagtcgaattcatcctgaagcaaaattgctttccagctataaacctgtgacaccagacaagttatgcacttctaaaacacaagagtgggcaggcatagaatagacattcccattccaaaagaggaaaaaaaacaggaaagaaggaaggcatgatgggtcccaagcaagtccaaaatgtagcaaggcaaatatcatcagatcttaaggctcaaaaatagtcctttttggtttgatgctctgccctccaggtagagatggcaatgtcactcccatgacttgatggggtagccctgcccatttggcctgggattgctgcccctgtggctctctgcagggtccccactctttcaaatggaataagaaacaactcttccccctctgcctgtgatgggagtggcagccctggtgatttcggaatcaccttcaatatcatccttctcttttcttgaagaatagtgcattttcacaaccaaataactcaatggttccatcctatagattccaaaaagtctgacagccttccttcattttacctagcttccatcccttcagttcaaactggtaatgacccctatggtataatctgatctatatttctggcttccgctgggatggctgattaaatccattgttttcaccatctctttatcaagttgtttttaggccacatgtttagtgttctcttcagaaaaagctttctcaatttttcacaatataggtagcctgaaaatcttccaaatatccaagctcttgcatctatgcttaaaaattgcttctacaatttatttctctcttcttgcattttactgttagcagtaaggaggacccaagccctacctttgatattttgcttggaaatctcgtctgctgaacactgaatttcatcacatgcaagttctaactttcacaaaaccctagaacaaaattcagccaagattttttttgcttctacatgacaaaaactgctctttctctagtatccaataacgttttcttcatgtctgtctaagacatcactagaatcaccctttacatctacattcctgctatgcatctcaaaattcttccagcctctacccattgctcagttccaaaaccacttccacgtgtttaagtatttgttacagcagccccttcttattagtacagaatctattataaggaattggctaatggaattatgaaggctgagaactcccaagatctgtagtcaagcaagccaatggagacccaggagagctgatgtgtagttccagtctgagatcaaaggcatgggaaccatgatggtgtaagttctagtccacagttattacactggagacttaagaaaactgggtgtttcagtcagagtctgaaagccagaaaagattattatcccagctcaagcagtcaggcaagaggggttcccttttactaaatctttttgttgtattcaagtcctcaaatgataggatgacgtccatccacgttagcaagggcaatatggtttactcagcctatcaatttaaatgtgaaattcatcaagaaccaccccacccctgccccaccacagacatacacagaataatgtttggccaaatgtctgggcaccccatggctcagtcaagttgacacctacaattaaccatcacatacacacacacacacacacacacacacacacacacacggaaagcttgaagtgtgtgttatactttcaggaattaaattcaaggaagagtttattgagtgaaatgccaaaagcagagatgctgtattcagtaatgattctgctaaaaaagctcagaaacactggtcaaatactgactttttgtatacatatttgttttaatttaatgaaagacatgatttgaagaatctagactagattgctaatatatccattagttcttcaaataaagccattgtaaatgcttgagcagtattatattgctgtgacttcatgtttaagttctctaagaagggactgtagtgcagcattttaagataagtaaagcaagatgtctttatgcttaagatgtctgatctgaagtacccagatttctactgtgaagacttgagaatctaatttttatttggacactagaatgggaaaccatgtaacctaaaagtattcacaacattttctcaataaataaattccttgaatgttctccatcagttgattctgggccatgtggcatttaatgggtaatttttaattcaaaaaaaaaaagaaagcattcattcttagaagaaatttagatggcttctgagacatctggtttcaagtagcatggcactctgcactcgcaaactgctatattaattggcctacagaatgggctatttaagattagctatttaaatgttgggaaatggctactaaatatagtgattttagtttgggggtaattaatggtaacttaatattctaagaataataacaaaatccagctgcttctgccagatagaagcagtaacagttaggatactaatttgctcctataaaaaagccccaaaatgtttatttttgtctcacacaacagtctgaagataagtaacctcctgggcagattttttggtatcaagggtagattctcctaattcctctggcttccttaatattcaactcccatctctaggtctaaaaagcctttgctggtaacttctctcccactccaacatctgccagtggaaaaaaaggggggaaatgaaggatggacacagaaccctccttgtagaaacatgacccaaatgttgccacatcacttctgtttatctctcattggccacaaacatggccacacctagcactaagtaagtctaggagataagatcctttactggacagcattgggcacagttaaaccctgtatcttcatagaaaaaggtgagtatagacagtagggagaaagcaagaaggctttggcacagaccctctgaaggacaggggctatgccccatccaccaaagctaagtaaggggcatctgtccagatctcccagtaagtgtgccaggttgtccaaatagaaataaccatggaaagaacataagattcttatacacttatgaaaatagtgcttctaatgcagcttaccatgacttctagattccagcatgtaaaaaattataacatgtactctttacttctgatgtttttgaatgcccatttttaaaaagtttgggaaatactaaaaataaataaagaagatgacaatcaactacaattccgttagccagagataaccattaagttatctttagttggttttttatggcttttctccatgtgacttttcatttacataattggactcagttttgcattatttatcctgatattaataatatacatttttctcacaccattaaaatgtgattctcaatatcattttacatttgcgttaatttaacctgtagaagttccagaattttttcaacatattactgatgttagatgcttagagtttccagtctttattagtattaataatgctactatcatcatctttatgcataaattttatctgattttgtatttattaatatagaatcttaaaggtgaaataagctcaaatggtagggaaattttaaaggctcttaatctatattgctaaatcactttccaaaaagtgttgtgaaaatttcttcttaaactaattctactagtttttttcatatcaccctcactagcattattacaattaaataaatttgactcagttaattaaatgaaaatggacattcacagccccttgatgactgatgagacctcctatggtttcacatgtaccagcaatgttaccatgattaaattctcatattttgatcatgtattcatttcttgttttaatgcaaatatgaacagtcctgcctgtgttaagcatgaaggcaggtacaaagtaaatgaagatatctcatttaatgacccctacatttaatgatatacaattaatttaatgatagcaatcaacttgatccatccaagaaccttgaagaatatattaaaaaaaaaaaaaaagagaaaggggcttgaattactgattactgaaataaatgacacctcacttatgtgccaaagctcatgcagttttctcagaaggaaagactttaaattcttatttcaaagcacattaattcttaacctagataaaatcctaacacatttgattatatgattttcaaatacgtggcagattaaaaacagcaaagtagaaaggagcagcagacacattaacaacaaataatggtcactgagaaaatgacaaagagaagagatagaaatgtttataacacacacacacacacacacacacacacacacacacaaaaccctgaaattatgttttttaaaatggtgatgtttttaataataacagagtttaagtaaattatagctcatctattcaaagattattaagaagtccttatattatttttacaagaacttttaatgtcacagaaaaaaatcacttttatactaagagggaaagctggatataactttgcagatagaatttaattacaaatatggttttaaatagttgaagagatatcctggaagtactgttcttaggaacagtaagattattttctgtatctcgtaaattttctaaaatgtatatgatgtattaccttaataaagaaaattaactttatgttatttttagaataacattctggaaattttaggagtagaaattattcttttgtatattactaacaaatagaattatacagttatttgtgcttataatggtagcacagttattcaaaaaaaaaaaaaaaaaaagaaaacatcaaatagagccacaggctttattgcagaagacctgggaaagttatctgttgttgaagatttttatccaaagtaaaaataaatgtacagtctatgtaacatgtaaaggtaaacaacagaaattcaaaactcatagttaggggtgattttaaaaatcattatttaggcattggtcttttgaggatgtctcttgagtaatatttaaattatttgttttataaaataatgatcatagtgactatgatggcattagaaagaaaattctcaaattcagtaagtcaaacatcatcacatatttagtgtgctcatgctgtgtaaatactgaaaacactatagaaagtaaaattacatttcaagctggtagaatcccaacaattttaatcaaaatatttttaaattttatatacactcatcttgcatatgagagtggcatgtttatgtaaattgtttttgtagtatctcttaattcgaacttttttgtttctattttgtaggagtaactttcaactacctttacttcgaagaatttatagtattttccagaaaattattaaatgtatgagctttaataatagtcatcggcagactttctaaactaacatgaacaattaaactacagtatttgctccatgaaattataaattacaatggatatatatgtcagtttttacattattgtctcacagacccaaagctatccgttttttttgttttgttttgttttttgttttttttttgagatggagtctctgtctgtcgcccagactggaatgcagtggtgcaatcttggttcactgcaacctccacctcccaggttcaagtgattctcctgcctcagcctcccgagtagctgggattacaggcgcccgccactatgcccagctaacttttttttttttttttttttttttttttgagacagagtctctcttctgtcagccaggctggagtgcagtggcatcatctcggctcactgcaaactccgcctcccgggttcacaccattctcctgcctcaacctcccgagtagctgggactacaggtgcccgccaccacgcccggctaattttttgtatttttagtagagacaaggtttaccaggtcggccaggctggtctcgaactcctgacctgaggtgatccaccttcctcggcttcccaaagtgctgggatttcaggcgtgagctactgcgcccggccaaagctacccttttctgttcagcctcaggatgctggggctgagttcctgcaacccaagtttctgctttgccagcagccacctgctaggccctgccagtagggggctccagaaggaagctgcaaggccggaactgggaggaggaattcacttcaggtacgcttgtagttcctgtatctcctctccagctacccttccttgctgtggcaacaagggttcattccagcagcaactactgaattcagtttgcagtttttctaacatttgcagaaccagctccattgtaccctgctcttcagagacgccagcattagttggccggtgcccctttgtagaaatctgggttgtggcttcacagggctaggggtgtcacatttaacataaaattatgggaaacccaatttcaatctcaggtaaacaatgaataaacatttagtataagtatgtttcccgatattgcatatttaactgtgcttactgtattttatcagcagccatgtgcagggttccttctctaagcttctgtattttaataattccaactatttccctttgctgcctagcccctgagtcagtagctgttttctgctattgctttctttgtgataacttagtgtcatcaacttgatacctccattattctttatattctgtcctgtctcctgactacattgattgatacagtagagttttttaaagcagatactgggatttgacaagataattttcctaccagttaatattcctgtgtataagttaacagggatactcatatggtaactccgatagaagctatccaaactttaacttgcgagtaaatgagttcatatacataatatttgtagttctatgtggttcagagacataagtcatagtaaattcttgtgcatagcatatctcctttatcaacattttaaggaattaaggacttactatgtatactgtgtgtgtcattgtaaaattgtgacaggaggacaagaagaaaaacaatttacagatttaatgtggttgtaaaatacaattattaatttgtaaaatagattaatttctagtccacttgcatctgagttctagactctgggcactaaattcattacttggcaaaatagtcagcacacctggttatatattcatcagctcagtggtatttacatggtgtttgcattgctcttatcaagtttatccaggcttcccatttactctttaccctattcccaccctgttcccagcctgttccaaccactgctatagtggcatctttgactttagtgaccacctaggtaacctcactttttctttctttttttttttttttgcctagtatgaaaatatacccaataccaccttctttattgctgactgggaatgtcctctcaaagctcctaaaattcttgactgtctccttttttgcctttctctagctggactattttgattatacccttctgaactgactctgggtttctggcttgccttgggccacatttctggcttacagtttgggtttcattgtaattccctatttatggctgtagttggttgtacagtgttcacttcaaacccgtcacttcctgcctgaaatcctgtaattgctagtgtttgacattcgaaactcctgatccctgatttgcctcaaacttctggctctcctgtgtgtcctttcatcttacctgaggccctggattagctctggccttgctgctttccaggcctgctgaaataaatgagcaagctatttctagctaaataaaatgagctagaaagaataggctgaactgagagaattaggtgactttatgcatgtctgattatctacgagagtgcagggaaggatgttgcaaagccttgggactgagcttgctggctctggagcacttccttgcctcatctcatgcactgctcatgagaaccccatagggtaggcatcaccctttcaccatccagacttaagaaagaaagattaaagcttagaaaggttacataacttgtccaaaagcacatagtagctaaggaggggagccaggaattaaattcaagctgtttctggtcccactttttttttttaatcactatgctatatatgcttgatttcatataattgagccctcacaatctgtctagttcttcaattcagtgagttttggggtagtaatgattggtttcaagtccaaaaagtttcactggtctcatggcagcagagcaaatgcttttatcatcctaggctcacagcagaagcatgtgcattctgattgaccacacacttcccgccagctgcataaaatcactattcatgatttagattggaaagcatactgatggccagcattttcttcctgtgtatgattgactggcagctgtgactctaaatgcacagaactataggcatgagaataatttcaacaagtatcctttaaagcattatgtcttttttaaaccatcttagccatctttaagtgtatggttcagtagtgtgaagaatattcacataatagtaaaagccatctccagaactgttttggttttgtgaatctgaaactctatacccattaaatcacaactctccttttcccctccctcaattcttttgtttctatgaatttgaccactttctatacctaagaaaagtagaatcttacatagttatcttcttgtgactagcttatttcactttgcctaatatcctcaaggttcatccatgttgtagtacatgacagggttttctttctatgactgaataatatttcattgtacatatataccacatttgtatatctattcattcattggtggacaagtagtttgatgccacttcttggcaatagtgaatagtgctgctgtgaacataaatatgcagatatcttatagaaaccttgctttcaattgtttggaattcataccaagaactgagattatcggatcctatggtatttatttatttttttaattttttgaggaaactccatactgtttcctattgtggtagcattattttacatcctaccaatagtacatggcagttccaatttctccacattctcaccaacacttgctattgtctgtaaaacattatatctttttctttttttaatgatgcaatataatttttatttcaagaaatatgtgacttaagctaatattttgtgagcaaaaatgcagggccaatatatttaaatattatccagcctttcaagtgtgttcactttcagaagctaaatattttcctgaacattccttaagtaaatgaatgacttgctcttttgaacctaaaacacatgcttgtttcctcattcttgtggctaccactgtcttacccagcactaaaagcttcttaaaattagtcagaggaagacaagtgggaaggtgtagacttctcacttcaatagtctgctaaagatggaggaaaaatatggtgctattcaaagacagtctagacttaaagatttagaattttggatggaaataatccggtgaaatagcaagaacatttgaaagagaacttgacaaaccactgctgcagaaagctgaattccaaggaaatatgcccaatatccatgaagctgagaagtaagtttctgaaatcatgcctttctatttttttttaatttttcatttgcctaaaaaatgtcaaccacttgttgaggcaagcggagtcttgctactggaatgtataaattaaccaaatagagtattatgcaaataatagtagattcggatatttgtttagtggcccttttatggagtattagaaattgccaacttttgactttgagaaaagaatatgtgtgttgtcagtaatattttgattctgtgttttttttttaaaaaaaaccttttaaacatttgtcttatttctattaatgtcacttgatttttctggtttccaattcctgtttcattcatagaagcttctagaagtaaatgtcttttttcattttaaacatgaacgcagatgaataaaatgaacttctaatacatttaatgtcacacttgagacaaccatattgagattcttaaaaaattgcttgtatggagaaaagaagattatcattttcagggccaggcacaatggctcacacctataatcccaactctttggaaggccaaggcagacagatcatctgaggtcaggagttcaagaccagcctgaccaacatggagaaaccctgtctctattaaaaatacaaaaattagctgagtgtggtggcaggtgcttgtaatcccagctactagggaggctgagacaggagaatcgcttgaacgtgggaggtggaggttgcagtaaactgaggtcgcaccactgcaccacagcctgggcaacagaatgagactctgtctcaaaaaaaaaaaaaaaaaaaaacctaaaaaacaacaacaacaaaaagaaaattatcattttctagccagtgactagtaaattttctaaacctatcagataatttataacaataatggatttaaaaaacaagcaagacagatttttttctattgacatatatatatatatatatatatatatgaaggaacatatatatatatatgaaggtaaatactgatcaaaattcaaaatccagggcagctcacttggagagaaataaaaataacaaagacctattaggtaaaacaagattatttggaactataggagtaagagttaagaataaactaaaaacaaagcacttgttctttgtggcagctgaaaatagcaaacctggggacaacaaggtttttcttcccatattctctatgctggttagctggcatgatgactaaaacagaattgtgcctgccattgtagagcttacaattatttcttcttggtggtagtattccacaatggagagcgttaaataaaagtaggcagtcttttacaacattttaatttagtctttgttaatgttaaagagacaaattccttattgagtttctgagcaaagcttaataataatgaagttagaggaaaaacacccaccacattttataaagtagtgaaaaaagcttattaagccacagaagtgttgtttttcctctttttagaaaataaccactaaagcttatcacttgacaagcaggcttattttacaaagaacttactaatttataaaataataagactttggagaagcatcttccttatcaattgtcttatacgtttcagggacatgatggaccaaaccaatgtcacagtctcttggcaccacttttaggatatgaatatatttggcaccctccccacagtgttcagccttggggttctcagccaaaactaaaacaaagttccatttccattgcttctctacttctatgacataatgtggttatgctattttaaacttattcctattgattaagtttttagttgttaggagggagttttttttgaaaaagactaaaattatttgtgtctaaatatataactttcataaacagagtatgaattagaaagtatagtttttccttaagctttaagggcaattcataaggctaagtatttttcatataaaatatagtcacttgattccactgactcgtgactctaatgggttaagttccccaaaatttactctcatttacaagcctattaaacttctttaaatacttcaagctaaattacaaatttatatgatttttaacaaacactttaaatgcctgataggacaaacttaaagtgtaataagccaatgcttgctaaacacttaacctctgtaaaactaataaatcaaacctataaatgtagtaaattagattctcctaagcatttcaaacatcttaaaatcaggactggaagcaagagttccagtaaaagatggcggattaaatgcaaccattaaggtctgttccatttttatcctcaactaaaatgacagtaaaaggattttctaagaagacatatgccaaaaggaccaaaaccagaagaggaggtaacagtgataaaatttcgtagtttgaaggcaatttagcagacccaagaaagctaatgctaacagtgggaataactgagaagcacccaatttacagtgtggaactcctgaaagtagttggtgatgttgagtattttaaaaagtaggagtaaagataaagctaaagtatcttttcgaaaagcagattgacctaggagagaagacttaacgttactgacattaagaattctcttaggaccagctcaatcagagcatgctacagtcaagaccacagttactgcctcacttccaatctgcttttttagtgtcttgttcttaaatgggaaatttattgaggttcaactcctaatatgagaacactgactaaaccaaggacacagaaaagaaaaattggaaggaaaagaaaatacttgggaagaaagaaaaccatctaaagagattcttagcattctcaaaaggataaaatagattgtatccaggaaaccaaaatagggtgatacaaaaagggatattcaggaaacaaatttctaggaagttaaaggtataattgcataaatgaaaaacccagtaaaagctttgaaggaaatgtttctgaaagtagaaaagagatgaaaataatagagaaaaagtagagaaacctgagggccagtcatggaactccatcatccaaacaggatctccagaaagagataccagacttaaaaaaagagaggggtgttcgggggaggggggagaaaagtcaaagaaataatgtgagaaaatttcccagaactgaaggacatgagtttccaaattgaaagggcccagtagcaagaacaatgaaaaaaaggctcacactcaggcatattatcatgaaacttcagaaaacttgtttcaaagaaaagattcttaaatcatgagggagacatattcattcaatggatcaagaatcagaatgacataggacttctctatagcaatactagaagctacgaagtaagagtatgcctttaaaatttgaatggtaaatggtaaattatttcctatcaatagttttactatcattataaatcaactatgagtagaataaagccattttcatatatgcacattttaaaaatttccctcccattacagtttctcaagtgctccagcaatatgagaaagaaaaaaaatggaatccaagaaataggagatatccataaggaagaagtgaagggaatcctgcacagggtgattctaagacagctataccacataaaaacagtctaggctggtgcaggtctgagaaaataattcagagtggttggttctggagagtaggaaaaagggtgggattggggggattgctttattttacaagtcaattagaactagctatttgcttctttagtttatgtggaactttgataaaaatttaaacttataaagagacaaaacataatttaaatgccatgtcaattagaaaatccactgttcctctataaactcaacttgaataatggttattccttcatcatctctgcacttttatggtatactttcctggggtgaaaagttgcttatttgactaaggagaattttatcatcatctccagtctacaacagcaactatgaccataggtttgtgttgtggatggcaattctagaatagggcttctcagagatatttctaggaaaattctatctaaaaacaagatagcaatccaagtcccttctttcagtgggacttctaaagcccactccttttcttacaccctagtgcatcccaggttattttattcactattttcctgttatctcaggcaactttagtctaaaccaacttgctaggttgtatatccattacccagattagaatttctcttttctacctgattgaattcagtactcttttaaaattttacattatttcattatccaccattctacatgctatagtaatttaattcagttcctcatggaacttatgttacatatcagcagaaggcaaaaactatataaatgaacatgaatgtagggcatgagtaaattgtagagtaagttaggtaacagatgctatggagtaaagaaaatgccaagccaggtaaaggaagtcagaagtgccaaagaggggatgtgtcacaatctttaatggtagtaagagtaagcctcattgagaagatgacttaagtaagtaaaaaattgaaggaggtaagggagttagtaatgtagatacattgggaaatggcattccaagaagcaggaaagtaaggccttgagatgggagcttgctttgcatatttcagaaatatccaggtacatgttactagagtgaacaacaggagaatatatgggagatgcctttggagagataatgggggctaaattatatgacatcttagaagcttttactcccaattagactttttactctaattctgggctagagtttttactcccagtgaaatgataagtgattagtgattttgagcaatgatttggcaaatctgacttacattttgagagacttgttctaactagaacgtggaaaacaaattgttggaacatcaagattggaagcagaccagttaggaagttatagccatgattcaggtgagaaacatggtagttgagaccaagatggtagtgctagaggtggtgagaagtggtcacattctgtatatactttaaagatagagcggacacattttcctggtgaatacgatggggtgagtgtgaaggagtagaaagaaagaaaaaaaaagagagaagaaaaacaaacaaagcagtcatgtattcctcccccaagttttgacctgagaatataatggatttgacctcacatacagtgggaacagtgaaggtggcacaggtttgcagagaattcaggagtttacttctgagcatagtcaagtttcaggtgttagctaaatctctaaattgagaaatggaataaactagctggctatttgaatgtggagtttgggggagaaactgtactagaaatattgatttaggagtcttcaatacatgggtgatagcaaaaaccatggaagagctcagcaaaggagaaagcatagatagatgatctgtgctaaggcctagtatttccagtgttgggtaggaagaagtagacctggaaaagagactgagaaggagcagcagtggaggaggaaaatcaggagattgtgatgtcctgggggcgagtgaggaaagcaggtgggaagaagatagagataaatgtgttgaatgagaactgagatgactgtttatcaaggaggaggtcattggtgacttcagcaagagcagttcagtgcagtggtgggtctctaggcccacttagaatggattttaaaaagagcatggaaagagacgatttagaaatggtaattagggaaaatttctaggatttttgctgtaaagagaagcagtagaaaggagtgttcatccatagtgtaaattgggtcaggagagggttttattaagatgagaaagtaacagagtatttttatgtggattaatccagtagaggtggaaaatttgatgatatagaggagagtaaagagtttcaagattgtctctgaataggtgagagaggatggggatacattagcttaaagtagaagcatctgagaaggttgagtcggtgggcacagatactggtaggtgggtcgatgtggtattgagtctgtggaagttctctaatttttttttttcagtaaagtagggaccaagattatcagtggagattaaggatgttggaagagtttcttgggtttgcagggaaagaacaaatggcgtgaaattatcctctaggagagtaggagagtgaatgaactatgaaaatatactacaaagatcaggcagcactaaagtttcacttgaagctcacactcataaatatcttagcaaagcttgcttatcattatgacagagttatatttgaaaatacaaagacatcttagttatggttgttattttaaggtggactttaaataaagaatgttctcaaatgatgggctgcagcacttctcagagaagtcccagtagataggtttgtaatcatcattggggttctggttgaggcgtgctcacacctgtggccattgctgtgcctgaataaactatgtagcatggtttttccttccctcctcttcatgaaacctccctctcttcttgcatgttttctttttcttaagggtatagactggaacattaatatttgaatcactgagtataatcattatttgagctgtggaagaggaaaagaaaatggtactaggatgcctagtacagagaaggaaaagatagatatttaggtaaagaattacttagaataatagatccgtgaaggtaagaccagttgaaccatcttctaaatataaacaattttttttttttttgagacagagtctcgctctgtcacccaggctggagtgcagtggcacaatctcggctcactgcaagctccgcctgtggggttcacgccattctcctgcctcagcctcccaagtagctgggactacaggcacccgccaccacgcccggctaattatttttgtttttgtatttttaatagagatggggtttcaccatgttagccaggatggtctcgatctcctgacctcgtgatccgcccacctcggcctcccaaagtgctggaattacaggcatgagccaccgcatccggccaacaatttttttttttttaaatagaagaagaaactgcagtgatgggttggaaattcaatatatctcaaaggactcctaacctattttgagttatctttgataggactgccagatattgggttaactgagcactgaagctcttctttaatgatctaatgtgccaagcaaggaggaaaatgttcattggttcttggtcttcatttatgtgcaagaaattcatataatttctcatttactttttttttttttgagacagtcttgctctgtcacccaggctagagtgcagtggcgcgatcttggctcactgcaacctctgcctcccgggttcaagcaattctcctgcctcagcctcccgagtagctgggaacaggcatccactgtgcctggctaatttttgtatttgtagtagacagggtttcaccatcttggccaggctggtctcaaactcctgacttcatgatccgccctcctcggcctcccaaagtgctgggattacaggtatgagccaccgcgcccagcctctcatttaattttaaaccaagcaatttcttttaatatggtataatagttaaaagcttcctatcagggcttgtatatctcagctgcacaatactaggcagattacttaatctttcactgtctgatgttttaatatctaactcataactttgtaaccaaaatgcagattccatcacacactgtgtgcaaagtccaactaacaagagcgatgtctggtataaagaaagtggctttattccaaagcttagcttagggaaagaggtgcaggctccttcctgcctttagtggactgcttcacttttggggcagaaagccgaagctttaaagggggacttggtgtgaacagcatgcaggggagagagcgagcaggtgctgatcattttggtgccttatctactgggtggtgagctggcaccatcacaggcagatgtgggttgtaaaatggccattgtctcaagacaccctccaggtgggagagagttccatcgcagggcacaccttaggttgtaaattggctgttgtctctaggcagcttggtgagacagagttctggccctggagccttttttttttttttttccacagcagagacaagtgaacatttatttttatgcctttcttcctatgtgtatttcaagtctttttcaaaacaaggccccaggactctccagattcaattatgtccttgggcttggttgactgctgcaggagtcttagggagccttgtacaaatgctagagtgactcatttaccaacagtaaaccctaggatagatccaacaaagcaggaatgtgccgatttcagacgacgcagcacccaatgtagaaaacgctggaatttttccttggaactagactgtgatgagaggtgcttgacatgaacataagctactgtcttttctgctttttgagatggagtttcgcttgttgcccaggctggagtgcaatggcatgaactcggctcactgcaactcccgcctcccaggttcaaacgattctcctgcctcagcctcctgagtagctgggattacagacatatgccaccatgcccgactaatttttctatttttagtagagtcggcatttctccatgttggtcaggctggtcttaaactcccaacctcaggtgacccgcccacctcagcctcccaaagtgttgggattacaggtatgaaccaccatgcccggccagctactgtcttttctttgacccttcctttccagtttttgaagataaagcaggaaataatcttctctgaagatacttgataaaaattcccaaaacgacaaaacacatgcttccacttcattgataaaaaatttaatgcagtttggcacctaagagtatgacaacagcaatagaaagtaatttcaaagagttacgatttcttcagcaaaatagatgattcatatcttcaagtcctttttgaaatcagttattaatattattctttccccatttccatctaaatgactgcggcaatacaggtttttggtttttgttgttgttgttgttgttgttgttgtttgagacggagtctcgctctgtcgcccaggctggaatgcactggcacgatcttggctcactgcaatctctgcctcctgggttcaagcgattttcctgccttagcctctcaagtacctgggactacaggcatgcgccaccacacccagctcatttttgtatttttagtagagacagggtttcaccatgttggccaggatggtctcaatctcctgacctcatggtctgcccgccttggcttcccaaagtgctgggattacaggcatgagccaccgtgcccggccagcaatacggtttttagttactcgacatctttaagcctataactcttaggctatgcatagccccatgtcctaatcaggcattcactgatcccagcaggtctccatctatttgtaccagcctcttctttcctcccaatctcaaggttactcttaaatactagtaaatgcaaaaagaacttgtaaagtggcaaggcatggcctatcaaaagtcagcccaagggcagttttcagccctgcctcacctgggtctagctcagctggcgggtgagctgattgatgtgttcaccccgatagccaggtgtgcccatctccttgaggaagcccactctatttttggtagcatgagtggacctggagcttttgagataagtacacattttgagataagtacatagttagataagcttgccctgtggggagcatctggtgaagggaaggtaaagggtatcattgcgtttctaaagaactaagtctggattaagaaaatgtggcacatttacaccacggaatactatgcagccataaaaaaggatgagttcttgtcctttgtagggacatggataaaactggaaaccatcattctcagcaaactatcgcaaggacaaaaaaccaaacaccacatgttctcactcataggtgggaattgaacaatgagaacacatggacacaggaaggggaacatcacacactggggactgttgtggggtggggggaggggggaggggggagggatagcattaggaggtatacctaatgctaaatgacgagttaatgggtgcagcacaccaacatggcacatgtatacatatgtaacaaacgtgcacgttgtgcacatgtaccctaaaacttaaagtataattaaaaaaaaaaagaactaagtaggaggtaggaaacaaggggaaaggaggaaagaaaaattattaaaaaataactcttactcttagaaaaatgggagtacttggttacaagtctagtccataaattaaatgtataattatagataagttaccttttaccacttatttccaacattccaaaggtcacacagctggtaaacataacacagctgggaatcataaatattgctaccaccaccactacccacccaattattgggggagtggggagggtcccatgactgtttcccagttggatgaaataagaaaccaaaaatgagtttttcttgatccttgaattgaaaactccatttttacagaaagaaaagacattttacaatccatttctctgaaaacatccgttctttatctcacaggatgtaataacttgatgggaaatttaaacgcaaggttattcataaaatggtaaatgaggggacacctggcgtgagagctgcagcggcatttccgacacactgctgccccctgctgcctgatacatcgttttccttcttcacgtgtactcaaaattaacactgtctgtcacccagattataaaatcatactgaggagaaaactgaggccctgaaagtgatctggatgacatggatagtagaagatttagattatggaaaagtcacttcttcctgctttaccatattgccttttccctattaaattaaaagtcaacaaactactgtgtgcctacgtagaagtactcaaaatggagaagtgaaaatcaagatctttgcacttacataactcatattcttgtgtgagtaaacagccaataaataagaaaaaatcaataaataatttaagagaataatagatgtattaaatagtaacaatgataaagatttctggagtactaggagaacatggaattcaaggcactgttcccagtgctttccatgatttctttcatttgattctcactgcaacctgcaaatagctacttcactttacagatgaagatattgaggcagggctagaatgatcctaagtgatggaaccaagattcgaaaccaagccacttctgactccagaagtgtctagggtagtctgctctgagaaggcaacagtgaaatgaagagaagaagccaggcttttgaagatctaagggaagagcaagcacaaaggcctggaagtggaagtgagtttggtatagcaaggtatagggaaaaacaaacaagcaaacaaaaaccatcccatatgattgtactaaaggagcatgcagaagactagcagaggccaggtcatggtagggagcttggattttattctaaattgcaagaggaagccattgaaggatttcaatcagagcaccaacctgatttatggtataaggagctcactctggatgttgaaaggaaaacagatggtaggataagagtttcctgtttctaccatttatatagacattgcataaacgctagcaatactgaactccatgttttctaaatgtgacccctacagtctcctgttcctttttcaggtgttttcctctgtttagaatcccttccttgagtcctctcctttccattgcagcctgccttttaagatttcttttgtgaagctttcccggattcttcaattatataatttccatcctttgaactctgtatatttcaagtatagcttttctgtgttaacctctgtcctaggatatctgttatttgactgcctacctcacggactgttagatcccaatcttgagatcaagggctaggactttcaggccatcctgtataagtatgcacgttgactccttcacaagggcacccgacccgccggaactctgctaaccaaactgagctccctgacacaggctgcacccatgaaggggagagtccttttttgtctaatttgtatagagatatcatataaaatagtggatccagaattgatttctttcatctttgcatccgaaacagcacatcacatctagcaatagaagtatacacatagtagatattttatcaaacctttttattaataattgattctgatttggccaggcacgatggctcatgcctgtaatcccagcactttgggaggccaaggcgggcggatcatgaggtcaggagatcgagaccatcctggctaacacggtgaaaccccgtctctgctaaaatacaaaaaattagccgggtgtggtggcaggcgcctgtggtcccagctactcgggaggctgaggcaggagaatggcgtgaaccaggaggcagatcttgcagtgtgcagaaatcgcgccacggcactccagcctgggcgacagagcgagactccatctctaataataataataatagattctgatttaactaagtccagttgtggaaagtaagatgaaaaactcaaggtttatggtatgctttactcatttaccaaggctatatgcagaaaggaatgggattggacatcctgccaagcccccctgcacagccaccatatctcaattgcttgataggctgtggtttgtgtaaaaagagggaaacaaagcgtagatgacagatttaaggtacgtcaaactggaacaggccgttatgttgaagtgttaggacactgcagtgcaccacagtctatgataccatggtttagaaaccttgaggacttttgttaagattgctgatgacatattttcagcaaaggtcacaatatccaggggaagtaaaatataagggtgtattcaattgctgaggctttattttttttttctccagctagcagtgtaaaggacatgtgtctctattttgggagctgatttcttcttagtccccattaaagtgaaactctaataagggtatgtcagcaccaatgtttctatgtaagaggacctccttgtcatctttgaaattaatttgaaattaaatgattaattcatcgtctgtttccactggaagtttgtataagtggtcctaaaaccagcaaagctggggatagtcctctttgttacatgcaagactggaagaatcatgtcagacccccacggaagccttgggaacccacccttaactgctgcttttgttttcagaaccttattagttgagagttgtacctcctgttttcagacctcctagtgttctcatctgcctttctgccttcagtgtgagtacataatctcttctcagagcaagtttagttgaaaataaagttttggcacctaaaaaaataagaggaggcgaccagcaagactgtgaggcatggaatctggagcacagggatactgataagaatgaactgattcatattgctgctaagactcagaactgacctatgaaacatagcagagtgggcacaaatgaaccagagccgggctctcctcccttggaaggtgctcagtatttacacaatgccccttgtctgtaagggcaagtactacatcagagggaaattggcaggggaattgttggaactggaaagtatcagagtgatgaaagaggcagctcttgtttagctctgttaagctgttgctctgcagatgcctgcccattgctgctagatttttcagtggaagttgatgttctgcatttttatgaaacactttctattctttaaatgttgtcaatcaattcaaaaaagcttttgaaacatataggcaaaaccacagtcttctttgtgtggacgaccagtttgcaacccttgccttaaaattataaccaacttctgttctctagactctgagaaagaagcatgcacagaactatcattttgctttgttaaaaagcagtctgatcattaccttctctgtttaaagaagtatcatttctccttaagagtgtagaactggccgggtgcgctggctcacgcctgtaatcccagcattttgggaggccaaggagggaggatcacgaggtcaggagttcgagacaagcctggccaacatagcgaaaccccgtctctactaaaaatacaaaaattagccaggcatggtcgtgggcgcttgtaatcccagctacccatgaggctgaggcaggagaatcactcgaacccgagaggcagaggttgcagtgagctgagactgcaccactgcactccagcctgggcgacaagagtgaaactccgtctcaaaaaaaaaaaaaaaaaaaagaaaagaaaaagaaaacgaaagagtgctagaactgtaactcatggggggaaaataggaagaaaggcagcatttatcttgtttgtttgttttctggtcacttttaccagcatggaataatgctggaaatagcctttcttccttgcttgtaaataatcccacatgcctcatagagatgcagcatatcccataaacatttgtgccaggtaaaactcctagagcagtattcaaattctcaaaacttgctgaaattagaattcagtacacatttgagtatttttggaaatggaatctgtagcatgtctagctacaggtgcaggtcaggggagactggtgaatatgaacccttgaaaaagaaagtgttgaataaggatttagatttttgaaaaatgaattctaaatatttcttccttctcctaattttgtaatttcaagttatcatttatttttaaatataaattttagcaaaactttctactgacgcttcttttcttttattcattccgtttgttcaataaatatttattgagcacctactaataccaaagatcagtctaggcacacaagatcaacaggttatcaaaacagatgaaagggctggatgcagtggctcacatctacaatccccacactttgggaggccaaggtgggcagatcacttgagatcaggagtttgggaccagcctggccaacatggggaaactctgtctctactaaaaaatacaaaattaactgggcatggtggtgtgtgtctgtaatccctgctacttgggaggctgaggcatgagaatcacttgaacccaggaggcatagtttgcagtgagttgagatcacaccactgcactccagcctggggacacagagtctcactctgtctcaaaaaaacaaacaaacttatgaagagccctgccatcaaggagcttacaatccagtactaataaataataaatttatcagcaaattagaagcaaatgagtgcaatggaagaagtaaaattgaagcaggttaagagggatcaaaaatagagggtgtacacattgtatttttagagaggtcagagtgggccttggtgacttttcagcaatgactcatagagaggaggttggtgtttttttaattgactttcccactccatagagtcaatggttctctccatttatccaagtagtatacgttaaatggtaaagaactagtacgtggatggggccgggtgcggtggctcacgcctgtaatcccagcactttgggaggctgagacgggtggatcatgaggtcaggaaatcaagaccattgtggccagcatggtgaaaccccgtctctactaacaatacaaaaattatctgggcatggtggtgtgcacctgtagtcctagatactcaggaggctgaggcaggagtatggcttgaacctgggaggcggaggctgcagtgagctgagatcgcaccactgcactccagcctggggacagagcgagactgcacctcaaaaacaaacaaacaaaaaaaagaactagtacgtggtatgtacacctcatagaacacatctttaaaacaaagagggaaagtgctatggtctgaatgtttatgtctccccaaaattcatatgctgaaaccctaaaccccaagacgatgctgttcaaaggtgagcctttgggggggtgattaagtcatgggggcagaggcctcataaatgggattagtgtctttacaaaataggctcaggagagaccccgtcactcctgtgaagttagagtgagatgatgtctgcctgtgagaaagcaggctccttccagaacctgcaggcaccttgatcttggaattctcagcctccagaatcatgagaaatagatttctgttctttgtaagccacaatcattttatgatatttttgttatagcaggctgaatggactaagaaaggaagacaaatttaacacaaacagttctacaaaataaactgcttaaagaatatctgttttgggtattttatatttgtacaataagggaaaggactatttaaaaaatagttttctctcaagcttttagcttgcaaagttcttctcacacatttttatttgatgttcgttataactcattgagacaggtggaattatttccatattctaggtgaaaagatgaagcttacaggtttgcttaagtcactcccccttaagcgatcccacattgcccctcggattccccattccccagatctctgatcactattcacaaggcccttcacgatctggcttctgcttcatttccacagcatctcttgctaatttcctctttactgcccacactgccccaatatctagctacttcctttcactatttgctaagctctccctttcttgcctttggacttttgcacatactattttttgtcacctcctctggccaccctctaaagattatcccagtctccacttgggcatcatttatttcccagtgctagaacctctcatacaaaatcatctgagtccagggccttccccctgttccacaggcacctcctggccactatagtttctcttaatatttctcctttagagtcctacatgatggtccccacccctcatccaaaccttttaaacttgtggaggagcttgaagcttagatagggtgaaatccgtaatctaggtcagccttttctcccctttttgaatttttttcttgacctttcaagatgagagattagtggcttaacacatggcttctctgaaagtttaatgtcttataaggtatctccttcagactcacttctgctaacttcagtttttcctgccaggtgcttcctgtccttatcacagctctatcactacaggaggaaaggtaactcctgcctctctttctgtgggcctctctaaaactcctccagttttgataataacttaccaatcaatgtctggcaatttcacagttctgcgattgtcctccctgcttcctctgtggaagcaagcccagtgtgctcactgtggtttgattcctgctttcaggaaccgacatgtccaaaattcaaaagacaactgtttttaagctacatattatataagctgtatagtaattctaactaatgccttttaatatttttggaaagtttacaaatatccatagaaaacagaagtcatgagctgaacaattgctaattttgaagtgattaatattcatatttacatagtccagttggaatacattcaggatgaaattttagtgtaaacttcaccattgaacaatatcttcaaaaacttaatctcacaagtgagggatattttgcctcagaaaaaaaataaaataaaacaagaggaggcccctgatattttaagcaaatataattacctgaaatagaagctgaatttgtaaagaattatttctcgtgtccttaattttaaaaagtattaccttcaggtttcatttgataaaacttgggaaattattttaaaaattagcttttattttggagaaaattataaacacatgagaaagaggggacattgtagacaagttcagtggcttcatttagtaggcctcatttcatttaaggagcctagctgaaaggcaaatgtgaggatgacattgcctccttctcatgcacaatgagtagttttctttctccccagttgctatttattactgaaagatgaaaatgtcagtatttcttttaacagaagctaatgcagcacctcagatggtgaaaactggtggcaggacacaaagttactcaaccagagtagtttaaaagtgtgcacttttaaaatcaaatgtaattgtaactcagtggtcaaaaatgaaaaaggatgctgagcctgaattcaatatttcatgattagagagacttcttactatatatattttttccttctaatgtctgacctggatcatatttattcctcaaccaggaacaaaaggagattctttaattttcttttgatccacatgtgtattggattgttgtcaaatttcttactggaaaaggttaggttaatattttgataacagataaaatcttcaaagtaagccagaagcttaagtaatgcaagttagatttcatgtgctagaatgtcaaggataaagcgtagaggaaggatttgcaagtcatccataaaatgattatccttagtgtaaagtttatattcctccatgccaacaactcttttaacgtattaccttgtcctttatattcaggtgccagaagaaaccttagagcagcagtccccaaccttttcggtatcagggaccagagagacaatttttccagggacctggggtaggggtgttgggggttggggagatggtttctggatgaaactgttccaccacagatgatcaggcattagattcttataagaagtgtgcaacctggatccctcacatgtgcagtttatatagggttgatgcttctatgaagatctaatgctgccggtgatctgacaggaggcagagatcaggcagtaatgctcacttgcccactgctcatcttctgctttgcagactggttcctaacaggccaagggccagtaccagtctgtggccctagggttgaggactcctgccttagagagtccaagagtagcaaacccatatacttatttggggccaagcagttacaatggatgagcatatctgtcacttgtaagtaataggagtaatggaaaccatgggaatttgagagcatatgtcctatttaaagatattcaaatcaacttaaaaataaatgttgtgccttccatacaaagtccatccacaaacccaatgtggcctgtggctctccagttttctccccttacagtttagcccggcctagactacagtttcttccaacctctcatccaaggcctaggttctttcttgagcactcctaccagtggccattcagcttctgtttgagcaattccagttgcaagaattttgggggactgtcaagtcctttgccaatcatattagtggtggtagtgatggtagtatcttttgtgctttaggataaaatcagaacagattagtgagttttaacagtagattgctctgaccaacaaggatccaatggacctctttttgttttgtgattgttccttgagactctgtccctgttgaggattataatgctttgtttcatggaagatatagtcagtttcagaactgtacaatgtgatcttactttttcttatattattccaggtttacttctatggctcatgtcatataggctgatctcagaagggcctgcttgccattagcattggttcaccccatcacatgcttactgactgatttcttcatgctaggcactgtctaattactgggatacaggagacaaaaggtcataaagagctatcctttcctggggcttacattttagttagggaaataaatacaatcaagaaaacaaaaacatggtaattaaatgttctaataaattctctgaaggaaatagaggctggaggagggaggcaggaggtagccagatcatgcagcctagtagacttccaggctattaggagtttggagtattgtaagaaaatagtgagaagccactgaaggattttaagcagaataactgatcttagggcactgtttgcaaagtgagaacactaacatatattcagtgtagaaatttgagaaaatacccaaaaaagttaaaaagaatatccattatgcaagagaccattacccagagacaagtctggtgtaggatgggaggtatggtagccagaattctaaaatggctcctgtctttatctgttccggctgctaaaacagaataccacagactgagtagcttaaacaacaaacatttatttctcacagtttggaagctggaaagcccaagactgaggcgcaagcagatctgggtctggtgaagcactccagctggcttgtagaagccatcttttccttgtatcctcacatggagagagcccgggcccttccatctaatatactagaaggacactaattccctcatgggttccacccccatttcctaatataaccatgattttaccttctaaaggctccgtctcctaatattatcctattggatttgggtttgggtttccatatatgaattctggggagtcacaaacaggcagttcatcacagttcccaagattcccatcctctggtgtgcattccctgggtactcttttcctcctgcctatgggaatgtgaacatgaataagatttatcattattttgattaggttacattatgtagcaaaggtgaaaggattttttagaaatgtaattaaagtgtttgatcagttatattaagttttttaaggagattatcctgtgtgggcctgacctagtcaagggagccctttaaaagaggctctagaggtcagagacagaagtcagagagattcagagcagtagatgcgctttactgttggcttaaagaaaattgctgtgtagagaaacccaagtggcaagaagtgatgggtgacccttcattgctgagggcctcactcctacaaccgaaaggaaatgtgttatgacgcccagtgatcttgaagaggctcagatctgagattgcaacccaagccaacacctggatttcagcctagagagaacccaggaaagccatgccaggattcctagcccacaaaaccgtgggtagtaaattgtgagagaataaataattgttttttctaagccactagatttatagtaattgttgcacagcaatagcaaactcatacaaagggaatgacatgattttctctgtaaccaaactgactggagagggacaagagtagaggccattgagaaagtcaccgtcgtggtctaggcaaaagataagcatggcctggagtggcttggaaagaagtagacagactttgaattatgttttggaagtgaaacagggctagctagctgataaatacagtttggagggtgaaagaaatgaaatcgtcaagaatgattcttacaactttggtataagcaaatgagtggatggtggtgctgtctagtaaatattgaaagaatagggaaggaatattttgttctgtggagttaacaagagtggtggaagatggtgttcagttttattaatattctattttaccaaattagaagttaggtgaacttcatatacatatgtatgtgtatatatacatgtatatatgtatgcatgttgtattacatatgattatgtgtttattttataaaaattatgatagtacatttcttcatgttactttttctccacttaacagtaaaaacataaatattaataattataaaatattctaccctgtgcagtcccttattcctctattgtttgttttttgttttattttgttttgtttgttttttgcttttatgttgtcctagtgaatattcttatcctttcaggtttattcaaatgtattagattacccttcagaaagatgatttatatttacattcctcataatggtatataagaaagctagttgaccccattttcaccactgggtattattattttaaaagcatctttgccattttaaaggtaaaaaaactcacttctctattaatgtttcatagcctgtatatcttgaaggtatgcttcagtgttttgtactatttcttcttgcctggcctaacatctctcactgtatttgacatgcgtatgactggagtcaggtcctgttgttagtaagaatgatgccattaagtcacacatcctctgtgataacatgggtattacctctgacatttcttgagattgtatctagaatcagaaagccttgatgctgtccttatatacaaatcagcttttttctaaaaacatacagtgtatagttatttttacaccttgcctatataaaataaaaagcaaaaaaaaagtcagtaacatttttcatctggcttttctgtattttttaaatggtatatggtagataatactaccatctttttcagctaaaactgtcaagtaaaacctccacaacgtatttcaagaatcagttatgagaggtgtattaagtgaatgagagtgtgtattatttaataatagctccctttgggtgatgggtttatgatgggtgattgttattttgtttttgttgcttttctatattgccaaaacttttaatatggaacgtgtaattctcccttaaaaagaaaggtttgaatagagctttaaattttaataaagagtactttaagatgtcttagaaagcaagtctgtaaaattgctttaaaaatcaagaacagggccgggcacagtggctcacacctataatcccagtaatttgggaggctgaggcgggtggatcacttgaggtcagcagttcaagaccagcctagccaacatggtgaaaccccctctctactaaaaatataaaaattagctgggcgtggtggtgcatgcctgtagtcccagctactcgggaggctgaggcaggagactcgcttaaacccaggaggcggttgttgcagtgagccgagatagtgccactgcactccagcctgggcaacagagtgagactccatctcaaaaaacaaacaaacaaacaaacaaaaaacagaagaaacctgaacacttgcagggattaaatgggaaaactttttaaaaagcaggtgtataccgtctattaactgtgtgccatagcacttggccacaaaccaagtatacttttgaaacccctaactaatctttaaatatattttcaaacaccttttaaaaatgtgtcaggggcaaaaatgtcaaaagcattatgactcctatgggtgaagggataagccacgatgcttgaagtcaggggtcttggctttcacagggaaagacaggatttcaccatgttgtccaagctggtctcaaactcctgacctcaagtaatccacccgcctcggcctcccaaagtgctgggattacaagtgtgagccacccgtatacagtattattgatatcctccaaaccagataggatatttagctttttgtaaaattctataggtattaaagcttgcagcattaaaaagcactgcttttgaactctgacagatgcagacaatatatccagtaacaaaactgagtttctttactaacatattttgatagcgtgaccttaaacttgagacaaaaaggagagaggaagagttttattgaataaacgtttctaggaaacagatgcttaacaaatggttgtacagctgtttgcaataacatggaagaagcctatctttcgataattgtgacataagtttttcttgtttgttctcctagagttgtctgcaaaaagtttatgtaatatgcctgaaggttatactaagaaggaagcatttcagaaatgattgaagctgtttatctgtgtgcaaaagcctgtaagtgtgtttgtgtgggcctgggcacgtgtatatgcctgtgattcacacatttcttttcacaaaagatttgaggtcactcaggatgtcattcatcctgggtaaaagccacctcagattacaagcagttaataggtcagatgctacataatgctctcttcaacttagatttcttaaaatcttacaagttgaaggaggtgagagcctgggacttttaatttgcactggggcaaaatcgttcctttgtgctgaaaacatgtggctgacaagatgccactgggaaagccaagcttttttagaagagtttgctgtataattcataaagataaaatctgtaatattttatacttgaaagctaaaattttttaaaaagacattatccaaatcaaaactctagcaattaaaacacacagatagggtatggttgactttctgcaatgctaatctggtttctgtcttaggtctatttgtacaggacagatattctactttattctccaacaagactcagcctggagttgcctggtgacctgctttaattgagccaaccacattctgtaggggaaaagccagaccagaaatagctaggatttaatggtgagaacaaaggcattcctaaaatcctcaaatctgggcctagcatggtggctcacacctgtaattccagcacttttggaggctgaggcaggtggatcacctgaggtcgggagttccagactagcttgaccaatatggtgaaaccccgtctctactaaaaaaaaaaaaaaaaaaaattaggcgggcatggtgggcgcctgtaatcccagctactcaggaggctgaggtgggagaatcacatgaacccgggaggtggaggttgcagtgagccgagatggtgccactgcacttcagcctgggtgacagagggagaccctgtctccaaaaaaagaaaaagaaaaaataaaataaaggaaacacaaaaaacacctcaaatctgatatctcccacttcctacttaggttgaaacaacatatgacttctctaagtctctatttttattttcaataaaatgtggatgataataataaaatgtggatgataatcccacctcactatgggatgcaaagtgtttaccagatgtattatgtttcctattgcagttgtgacaagtcatgcaaaagttagtggcttaaaacaaatttattatattaagtcccagcattctgaagtccaaaatgcatctcactggggctaaagtcgaggtgtcagtaggtctgtgctcctttctagaggccctgtgggagaatccattttcttgccttttctagcttctagaggccccctactttccctggctcttggccacctaccatcgtcaaagccagcaatgtcccagcaagtcttccttagagcatatcactatgatactctttatttatttatttatttatttatttattgagacagagtcccactctgttgcccaggctggagtgcagtggtgtaatctcggatcactgcaaccaccacctcccaagtccaagtgattttccttcctcagcctcattagtagctgagattacaggcatgtgccatcatgcctggctaattttttttttttttttgtatttttactagaaacagggtttcaccattttggtcaggctggtaccaaactcctgatctcaaatgatccgcccgcttcagcctctcaaagtgctaggattataggcatgagccactgcacctggccactatgatactcttgatatcatatgatagctcttgcttccctcttccacttggacctttttgattacaatgggcccacctggataattcagtataatttcccatctcacagtcagctgcaaccttaattccatctgcgtccttaatttctctttgccaagtaaggtagcattcacagattccagggatcaatataagaatattttttagggggtcatcattctgcctaccttgttggagtacctgctactaaataaaaacaccaggaatggtagtttttgctgttcttaacccaaaggaagaaagagcccttctctgaatggtttttgttgtttagttaagaaaatgccaactgaccaatgtcccagaaaccaaatgggtgtagagccctagcatgcttcatttcaacacctttcacaaacagtagttttggcactttgcctaccaagctgaaaaacaaagagcagggttgttatgtctgacctaaatacacatggtctgtaactttcctcttctctctccatacctcttcccttcttgaagatattttactgctggggtatcaacttatttacatgtagctgactcctcagaagcggaacttgaatgccagccattctgtcgagcttaaagcaccacaatccagctgtgagctaggcaactttccccttatattttgtgtgcctctgaaaacatctccagaattcaaatgaccatttttgacataagttatcccttcctcccctctgattgcaagggcagcatcactctttctgccatgcataagtcaacatttggagtcaatagccctcttgtactaacactttcacagtcctctcaagtagccttcctcactgtattatccaagttcaaggattgcttacacttacctggactacaggcaaagcctcagaaccatctcctgccttccttcactgatttgtgtcatcactccctggaggtctcaggtccctccttctcatctcttcttccttaaatcgatccttctgccttaaatcagcccttctgcttagcattaaataagtctttgtcagcatgccaaagggtgcagggaactatttttaagcagccaccatatgccagacattgtgcttagacattttgcatacattatctcatttaatcccaacttaatgacctagcaggtcgatgttatttcctctttctttttctttttctttttcttttttttttttactagtgaggtaactgggacatagagaactttatgtaattcagccaaacctacacagtatgtagcaaagagttcagactcggctgtgtctttctttaaagcctctagttttaccactacattagacccgtcatttgactttattttgaaggtatctattttattagggtgggcactgggcactgtggctcattgctgtaatctcagcactttgggaggccaaggcaggagtatagcttgaggctaggaatttgaggccaacctgaccaatgcagtgagaccctcatctctaaaaaaacattattttttttaaactggtcaggcacggtggtatgtgcctgtaatcccagctattcaggaggctgatgcagaaggatcatttgagcccaggaggtcaaggctgcagtgagctatgattgcatcactagactccagcctgggttacagagcgagaccctgtcctctgtctctaaaaaagcaaaaaacaaacaaacaaaaacgatgaaaaaaaaatccattttatcaaggcttacctgtgctcatgtactttatgggcaaatctttcaatggcctaatgacaaacatattatggttgggtcatcttggtggtggtttctgtgggaggctaaagactgctatgtgtactattttttatcagagatctagtactgtcagacatctgcctttgaagtggcttgtggattaatccaggtacatttctcatattttttgaaaaggatgggttctgagggaaggaaataatttttctatatgcgagaggctttgagtcacagtaagttagagctcttgtggaggtaaataatcttgataaatctgttctttgtcattagagatcaactctcagtacccagtgacaggcccaaacatgcttttattctttgaccaaaacacccacaaaggaaacagaaaccagtttagcaactttgcaagtgggtgcagaagtattcctataaataaagctgctcattgtgcttctctggtcatgttaggtttggaatgctgatgggtttatatcgtcctactctgaattcttagtgacaacattgtgaatttagttctagctgatgcttgctacattgcattttttagtatttgaattctgctactccttaaaggtgactgaaatcataaagcccattttgtagaatgaactttgttccccacttatcactccaccatatgctttcctgattgctttctgtttttactttcttgaagagagaaaaacataacataactcaatcttagttgatcttagtaaaaggaagaatgtgtgggcagtgggacgtggtgggtcatgcctgtaatcccagcactttgagaggctgaggggagaggatcgcttgagcccaggagtttaagaccagcttggacaaaaaagagcccatctcaaaaaagtaataataataataacaacaacaataataataaaaggaagagcacttcctgggccttgagaagtcttcttgctcacaaagaagcatcaaagcaagtgctatatacacaggaggtcagtttgggcaactcttttttaatcacatagtagctttgccctcatggattctaagtagatagataatagaaaagttgtaagaaatggtcttcagtaatataaggaaatactctttcaaacctattacttttttatcggaaggaaaatttaaacagaatcaactattctacataggtcttaggtttttgtgtaattgtgaaaacaacatagcagaagaattaagactttaacctgaaaattaaaagtgctctctggagtcattattgggttaattgtcaaagttagaatgcagatgacagattacagaaaagtattccattcatgtgaaattttccaaagttgaaagttacactatggttatataaaagactacccatatttataggaaatatacatttcctatttagaggtaaagggctatgatgcatgtaatttacactcaaatggttcaataagtatatatgtgtgtgtggtatgtatataacacacacacacacacatttatgagagaaagagaacacaaacagaaagcaaatgggataaagtatgaacaatagttgaatataggtaaagagtatatgtttttcctaaacgatatcagttcacatctgtgggaagatgatgctcaaatttaaatttctagcccagaagattatcataaactctagacccataaatccaattgttcactagtaatatacagtaaaatatttcacaggtgttttaaaatcaaccttttgattttttttttttttttataatttacccctttaagccagttgccttcagtgttctttggcaccaaactagattctttcctctccctcccaagtccccaccaacactgctacaatccaaaaattctgtctattcaaccctgcaaattctcatcagttgatccacttctgtcaatcactgctgctattattcagcttcatatatcacacagtttataatcatcatcttctaagtagtcccctgcattcaggatgtgcctcctccaatccatcttctcatttgcagctaatttcagatgttcaaatctgatcttgttcatgctctgcttaaaagctgaagtatctctctgttaccctcagatcaaaatccaaatcctcaatacaattacaatgcatgtgaagacactggttcttgcttatttttctaacctcatctctctcctctcatcctaccatcgtttatcctatcctgtctcgtaccatgccacagtctcattcgactcctttcagtggaagttcctctggctgccaggcctctgcccatgctagtctctctgacttgagcactttccttttcccctgctcccaactacctgttcaatacataatcctacttgcctgacttactctttcctcctttaaatcccaacttagatgacattattcgaagaaacaatcatgacatcccaagtctgatccaaccaataattagatgcaaatttaaaataaagtaataagattctgcctgtttttaaactagcataaagcatgtacacagtccttccgtcaataaggttttccttaaacatttattaaatatctgttctatgcccagcaacttctgattgggtcattgaacagatatttatttattgatctcctacagtgttccagacactattttgggtgcagtgaacattcttagaacttagattctaatagaggtgactaatcacaaacaatgagatgggtagtatcagttagtgataagtggtacgaagaagaaacttgtacagggtgctgacctagatacagtagtcagagaacacccctctaaagaggaggtatgtaagttgggacctaaatagaatggcagagcaagggctggccaatgtctggggaagagcattctaagaaaagagaaactgcaagtgcaaaggctttaagataggagcatgcttggtgcattcaaggaccagaaaagaggcctgtctgtgttcaactcagtgagcaagatgtgttggtggaaaggagtcctgaaggccagaacctggagtgttgagcagtgaatgtgctttgtcaggttcagtttaactctgtacgcatttcatttgtccaaataactttgtgagtgaatggagaacacaaactgggctgcattttgtatggaggtcaagggtgatcgaaagagagcatccctagtaaaaagttatttccctaagggttaaagattgagaattggatagaccctggagaaccagaagggtgatgtcagaaaggtagaagtaagtagatcaaagtgtttgtcccacgcaaattggcagcgcttgtcagagtgtcttggcatctaatctctcccctctgccctttcccacccccattcattcctaactgttccaaaattaacttagaacatctttattctttgccagcattaggtggggatggagagtcctgttgcctgtaaacagcagtgacttttgtaaggaagtataacatattgtttaaaaaaataaaataatgaattcagtttttacatcagttttcggcacagtggcctaaatagaccaaatgtagcatacttttaatttctatacctttgtatggtaaaaacacataaaaacaaaaaaaaaataggtcattctgtttttcgtgagaactgccttatttccaggattaattctgtatgactgagagagcttgaattatttccaaaaggatagctttgcattttcttttcttgttaatcagtctctactcatttcataattttctccttcagtttttttttgtatttgagctttgctttttcccttttctcatgttcataccttaaagattgtctaccttttgtagaaaaaaatattattctgataggaatactttttaaaatttgtgtgaaagaaatgtaaatacatatataagatagaaaggaaactggagaagaaaataatatggaaatgaaatagtatatataaggcatataggttaagtccagtgaaactgtataaggtaaacatatacactgttaagcagtctccaaagcatgattgatgtaagtacctaaacaataactttatataattttgggggggtataataaccttcatatataacttgttacatatgtatcattcattttcttcagatgactttttatagaagcttgaaattcaagctcaaaactcatttcttattatgatctgagaattttttctttaattcatttcctttctgcatctcttatgacaattttgtattttctaagtcagatagttaagaaaatctttgttttcaggagttcatcataatgcatttctatatgtttaggactgtattaacattgtttattttgacagagcaggcaaaatgtgaagtacctacatacacttttatggctctcacttcttgaaaattttaaagcatttattgagtatttattacattccaagtactattctaagtatcttacatgtattaaatactttaattctcacacagccctacgaatactaagattctagttttacaggtgatgaaactgagaggcaggtgggttaagtaattggccctacacctcaaggctagaaagtgaaggaactgagatttgaaccctggtcaactatcttcagaatcataactgctcatcactctgcaacacgtgctttcaggcaagcgttagtcagtgcagctcagggaaaacaggaggcaagttgactacttatgcagattgctgagaaatataacaggagggaagaacagaatggaaaacatgcttcttacctaatatgagacatttttccctagggaaaacagaactttggctatttcccttcaagcagaagaaaatatgttcacacagagggaaagaggaggaaatgaaaagggctgtttggatcagatggctgaatcgccagtaacccgagtgcttagcgtaggctgctctcaaacgtatagttgctcattaaactttaattttcattgcatgctacctgatctggtttagtgaaggctcttttatgcaacctaaacttatgggaattttgtgatgtatttaatttccacaaaacctaacatacttgatatgtccttctttttgagtcagagtttcgctcttgttgcccagcctggagtgcaatggcacgatctcggctcactggaacctctgcctcccaggctcaagcaagtctcctacctcattctcccaagtagctggaaatacaggcatgtgccacaatacccagctaatttttgtatttttagtagagacagagtttcaccatgttggacaggctggtctcgaactcctgacctcaggtgatctgcccaccttggcctcccaaagttctgggattacaggcgtgagccactgagcccagcctgttatgtcctatacatatcagccaaccataactgtcagtgtaagtagttcaaaatttctcctaagaattactcttaaacacctactctcttcccctgaaaatgagttaactacttagtaagtaacctttctcacagaaaaactagatgttttctctggaattctttcccttgcagccatcccctggaaagccttgttttagaactgacaccatttatatggcttggcatctcgactgcatttgtttccccatctggcacttctcggggtgaaagtgttcattttggtgttctgcagagtgcattttgagaaatgtgtacacactacaagtgaaattcacatctcaggctaagactataccctcagcattgcaatgtgatattagcaaaagtgcttttataatcctacctgccaacaattcacatctataattaggaaaactacatgatttcaaaattacccaagtcttggaaaggcttgtttttaccatatgtttttcttttgtaaaaggtctattattttcaccgtcttaaaaaaggttcagtttgatcaagttctaattatattctcaagcacatttttcaatcccataaaaataaatcaataaacctagacatttaagtcactttatcacaacttggtcaatctacatggtgtgacaacagatataaggaaagtagataagtccgctaggatataaagaaccaacttacagtaaaataaataactaaactagaaaaagaatctagaataaaaactagagatgtagaagcaagagcatttttgactgccgtaaatcagagcttcttagcagcccacatcccaaaagtggtagatagccaatatttgtcagaaatgatgattgtatacctagtggacagctctaagcacaattataagattgatttcgttttacaaaaccttgaaagaagtaaacttaactgaccagtgacttgagtctagctcctatcagattcccaatgagagcaaagaataaagaacaaatggccaaatattgggaaataggtatcttatagatatgacatatagataaatagatatatttacttatatacatactgtcatatgaccaattcataggtgtgtttgatatggcagtgtgtgtgtgtatggttttataactctctcattcatattcagacacaatgcaaatgtagatagtattactataccatctatttgagatgtaaatattgtaaaagccctcctttgcatattccgcagatgctaaaaaccacatgtatttatgttttgtttggggtgctgcttctgtgtgtatgagttttattgttacatgaagtcttgctttaaaaatttggctgggcatgatggcttatgcctgtcatcctagcactttgggaggccaaggctggtggatcacttgagctcaagagtttgagactagcctgggcaacatggagaaaaataggccaggcgcggtggctcgtgcctgtaatcccaacactttgggaggccgaggcaggtagatcacttgaggtcaggactttgaaaccagcctgaccgacatggtgaaaccctgtctctactaaaaatacaaaaaattcagccaggcctggtggcacatgcctgtagtcccagctactcaggaggctgaggcaggagaatcacatgaactcaggaggtagatgttgcagtgagccaagattgcgccactgcactccagcctgggcaacagagtaagactccgtctcaaaaaaaaaaagaaaaaaagatggccgggatggtggcaagcacttaaagccccacagctccagtaagtccggaggctgaggtgggaggatggcttgagcccaggaggcagaagttgcagtaagccgagatcagactgctgcactccactcttggcaacagagacagaatctgtctcaaaaaaaaaaaaaaaaaggaaaaaaatgccaattcattcttgctttctacctgctgctgttgttttccagaagtctgcagctatgctgaatgatttgaacaggaacatcaaggcatcttcaaaacatttctgttctctccttatgctcaccttataaagctgcaaggaaacattgtgtcattaattttctatacatagcgtgcttggcaaatcttggagaataagcaacatctcccagggtggttgtgtgcataacatgagaatattcgttgaagcactttgtaaacgataaaacattacacatagtaagtcattgttatcattggcattactttaatgtagtagaatggaatccaggactggaataagccattcatgtcactaaggaagagaatggaaattaatatccaatgaaacaccttctttttttttttttttttttttttgagacggagtcttgctctgtctcccaggctggagggcagtggcaatggtgcgatctcagctcactgcaagctccgcctcccaggttcacgccattctcctgactcagcctcctgagtagctgggactacaggtgcccgccaccatgcctggctaattttttggaatttttttttttttttttttttttttgtagagacagggtttcatcatcttagccaggatggtctcgatctcctgacctcatgatccgcccacctcagcctcccaaagtgctgggattacaggtgtgagccaccgcgcccagccaaacaccttcttatagcagagtaccaggagcttaactagaagttttacataagttacctcatgtattgaacagcattcataggaaatactggaactcttaaaggaaccaaatagagtttgtattgaatacaaatgtagctccatagagaagattagacatcatgaattttcatttgagaatgaatcatcttgccaatttatatcattttcctgcaaaagcttattggcttggtcatgtactttactagtcaatgaccagttattatggagttgtcagaacttggccaagaccataagctctatattacatgcaaaatcttagtattattactatttatacaacttcagcgttgtgaactggtggcaccatgaactccattttcttcgtgatcattgtcacttcatcaccttgtactaactctgcacgtggtttttgacaatttgtttatcttttaaatttacccctgaagcccacctgtttgggcatccattagttcttagactcatgaagatcttcacccactgacttgacattgtctgttctcaatggttgtgatctctgccctcaaataaaatatgatgttacagtatgtatatatctcagtgagttgctgttgaagggtctcataaaaatgtgatgacagggaagaaggaaaggcagttttccaccacaatcctctccaggattctaaagtttaaggacataaacagtaagtcagaagcagccgggctataggtgctgccctttacttctaccgggataacagggaatgtggattaaaagggggctaagggctcatgcctgtaattccagcattttgggaggccaaggcgagtggaccacctgaggtcgggagttcaagaccagcactgacaacataatgaaaccccatctctactaaaaatacaaaaattagccgggcatgatggcgtgtgcctgtagacccagctcctcaggaggctgaggcaggagaatggcttcaacctgggaggcagaggttgcagtgagctgagatgaagatggcgccactgtactccagcctgggtgacagagcaaggctccatctcaaaaaaaaaggggggtgggtgctaagtacaaagaaggaagttattactacttttatccattcttttaattactaagcagttagtgctgttgtgtggactttcttctttccctcctagggaaaaaagactaaaataaataactataatgcaaagcagtgtgaactatatccattatgatgcaattggaagttctggatgcaaaacatcaaaattatgttctgacaatggctagcagtatttacatatctataaaggtacagaacaccagcctggttcatactcagcttatcaaatctgctacctgttgttgctattaggactataaaatagagatttgttaaaggtggccatgccatttatttactttatgataagaaattgtacagaggctagatattgagtcttgtgatctcactccatgatagactttacagtatcaacttagtaacgtatcatacagagcatgtcgtcgtcaccgtttctaaaatgttcagtgagccaagagcaagtccacagtcacagggcaggtacagtgagtttcctgtgtgcagaaacagaaacctctgaatcttgcacactgccaccaggggtcagggaccgggcgggaggagaaggcactctggcagaaaggaaatgttatattaccctgagaagcacaggaatcaaaattcctgtctcctcttcttgaaagcagctcactgctagctgagcaaggttcgaaggaaggacctcagaaatgttctgccagcgcaaaggtatgtgtaagtgctctcttagtggctttaaataagttattttggaaagtcagatacagcggacattaaagggcacactttatgttgcattttcaaagtccagatgagctgtatggatctgtgacgatgcagttggaggttctatagctactgcctccaaaatgcaaatgtttggctggggaggttaggagggattaaactgtgtcagaacactgaatctaaatagaatatctttctaaaaagactttacatgtgtgtaaattatttctctatgatttgctgtagatactgctgctaattatgattccataagtactcccagaaatagattcagacataatgattttgagtctcttcatgtccagtggccatttgtaacaagtccttagcgatttattttttattcattcataggacaacatttgtcagtaagatttccatgttgccttaccttattcttcactcaaaaattgtccctaactcgggtaatggcagtgatcaagtcacatgctctcacttttgtcaccactgtattctgggtttcaaagacttgtaattcatttcattaagactctccaaaccatccccttaaacatttgtttaaatgtctctgttcttcattagcgttttattacgttacattctctaggctccagaaaaacgaggcaagaaataggaggatttttttttttgccttttttcttttttttggttgaagttttggtcaaacaagccaaaataacattatcattaaacagatcgacctgtacttttaaatggaaggaataaagatataaaaagaactgaggcgtgtaagtaacctctttgatttttaatggcatgcagcagatggaattcattattgactttaaaaaatgaaattgctctgcattattatttatttatagttttgcctttcaaaagaagtaattaccattactaggttagtttttcctcaatcacaagcaactgtgtgacagtatcagaatgtataatatactttaccacttatttagacatgaggcttaatgatgttgcaggacattatccctttttaagttagtaataaatttatgagcataatgcacagctaagaggttgactatcttttctttttatctgggtaatttcaaaagcaattatttcatatcataagacaatttatttatgaaattctcattgctgaaacaaaagtgtttttaattagaaataatctaatttcatttttccagttcagcacacagatactgtgatgataatcataatttatacaaaattatcaagtgaaatgtttaggtgattggttttgagcccaaacaattttttaattttaatcacaaattctaaaacttttaagtcattggggaggttgataaccagtcataacaaaatttaatttttaagcaatgccaaatatttaatcaattatatctagttcaaatttgagaggtactaaaattgcctttgtaataaaaaaatacacaagaaaggataaaaatttttagtattaaacatggagctgtcaacgctataaaaatgtatgaaccccttttcaaagctgatgttttaaggtatcatttcatatacaggacagcatttatatttaataagatcaggagatttggcgtgagcaggattcagaccacttttgaatttcaatgaaactcctggttcaattagatccctcttcccatccttcttacccctccccagcccattctcctttccccttgctgcttctgcctctgtattcctctctctcctcctccctcctatgccttatatcctcttggcacttttacactgagacatctacaagtggatctgctgtcttcagcagtggtcattgttgtgaaactgaaggatagcaatgaatatttcatatatagcacttaaacctcttcatctagattatgcattttgcttcattgtacccatccataggcacttaataagtgcttatcgattgtctagtgagattgtattataactgattttgagacttttcataccctctgcagttactagtactatatttctttgattctaagatgtacatttttttcaaattttaactttttaaaatctaaaatcaccttgtgatcaagctgtattgtgatttaattgacagtttttttttcaatctttctttcttggtcatgcgtctcacaatcagtggtatcttagattgatgaaatgcagcagtgaaaatatatacctaagtttgtgacttgtataatatgttaaaggccatatatttggaacttcataaagtcttcttttttccttacgtggcttatctgtggccaatttttgtctctcctcactacattcttccactctggcttcctggcactgtggttctaactgttcttaggccactgtcttgactgaactccctggaaaatactcagagaattttattagtaattaccaatattcaactgtaatgaaatggacagggaacaagtttttaaaactgaagacccacattcaagttatgtttctgctcattaaaagctatgtgtatttagcaatctgataattattcccagagcttcaaattacacatctaaagaaggaaataatacaaataatttctttatctataaattaagacaattagtaaaaaatattgtaccagtaaaaatagtgaaaatgaaatgtgtatgacagtactttttaagccatgaagtactgttaaattataaaccataaggatcaacattaaatgaaacattattagaaatgtgtgagtagaaagttagggaaaggaaagaaggaaaaattaaataattcattccaaattagaaagttttaaattatcattggaaatgatgatacgacccattaactagctttctgaatttagaggagaaccgtgaaatctatcttcagattatttcttgcatatcagagtcctgtctgttctgaactccagtgctgaatgcatgccaatctctgagagcttgtatcctttattgaattagcaagccacaacccacagtatctctgtggtattaaaaataaaagagattacttagattccccacttcctttcctgccttgattctttccatttaaaagtgagacccctgtctctacaaaaaattcaaaactaactgggcgtggttgtgcatgcctgtagtcctagctacttagaagactgaggtgagaggattgcttgagtccgggagttccaggctgcaatgagctatgacggcaccaattcactccagcctgggcaacagagtgagatgctgtctctaaaaaaaacaaaaacaaaaatgaattgtattggttttcacagtttcaaaaacattcaataagagtaaaaaaaaaaaaaacttgttatttttgcatctttaaaagacaggatacttcaatggcacttgaaatagtactgttgaatagaaattccattgcaatagtaactataaaacacaagattatccattaaaagttaatatatttagtatatgtgttacttttgaggatagggatactttgaaaaggcaagaataaagaaaagaaggaagtgccatattaaaggcatgtgcaggttaaaaggggaattgaaggagagggaattcttagtcattacttgaaaattatatttttctactatactacatctgtcagtggaaagtctaaatcactttatttccaaagaccacaagttgtgactctgacatgaacatttagtcatatactggggtttaaaaaatgttcccatttcaatgtattattaataacaacaaacacatcagacccacttgatgttaactgctatacttagtgcttttaattcaccaattcattaacatgttaacacattttggcatgataatatattattcatatattaaactatattcttatttccattaatggaagcatcatttctctagctattcaggccagaaacattggtgtaattctaggccttctctttcttactgaccctgcatctaatcagcccagagatcctgttggctctcttctcagaataaacccagaatctgtccagtccttaccacttgcactgcttcctcctcggtccaaacaccatcatcttttgactgcactgtgcaagagactcccaaccggcctcctgtctctgcttttgctccccaatccccaccccagtcagttttcagtgaggcaactgggaggaatgtggttcaaacatgaatctcattgtatcgctcctttgtccaaacccaaagtcctaatcatggcccacagggccctaactgatcacccccagcacacacacacacacacacacacacacacacaccccttacttcatataattcccccgccattactccactccgacttcactagtctctttgctattccttgaacacaccatgcctgcttctttctcaaggcctttgcaatttgtgtgccctctaccttgaaggctctcctcctagagatccacatagccaacttcctcactttcttcgggttcttataaaattgtcttttcagtgagaccttccctggccactgtacctaaaatttcaaatcccctgcccatcaacagttcacatacactcttctctgctttttttctttttctccttacactaacacatatttatctaccttattggaatacaaacattataaaaaatgaatttttgtctttttccctccatattctagcccttgtaccaagagcagggcctaatacgtagaatgtcttcaaacattatttgttgaatatatcctcagttaaccctgtaccctcaataggtacaattattacccccattttacagatgaggaagttaaggacagaaaaattaagaaacttattcaaagtcaaacaagctaagcaagcgtcagagctaagattcaaacccaagaccctggctccaaaatatatgttcagatcactgactgagtagattaattagaagaagagagctacctatagattcctctattccctgagattttcttcaatatgggttccatccagttaaatggaaaaattgtgtcatctgctactgacaacatagtcagatatagtaaagctcctttttctcattcctctttaatttctttttgtaaaaaaaagtatgagaccttttaaaaatagaaaatatatgtatattttttaaaagcaaccctaatcccacccctgtggacattaaaatagtaataataatgttaacttacacaatagtaaaaaaaaaacactagggaaaagtatgaaatgaaaacatgcattgaatgcctattatattctgtaataagtcggcactctgaggacatatttgttacatggagtctaatgagagagacagacacatactcagacaaactctaaattggaattcagaagaaaaaacatcaaacagaagtcttgtgacagctgaaagtggggcctggtagagtaagttgtggggcaggtgaatagtagtggtggaaagggattgaagaactggagactgaagaaacagtttctgaaagaggaggtgggagagtaccaaagagaaatgtgacttacctcactattttgctatagaggatgggacttagtatgagagaaggtttttaaataacattttatatgccgtagaatagaaattacaggaaaatcagttattgaaaggctgtgttgaatttaacttgtaaaagggtatcattacttatccaaatgcatcatgtgagaaaattgtccagttcatttccccagactacctcaatctattccttctgacaaaccagaacaagaaattctgttttccaaattgttatttttgctaacacattaagccagcttcagcttcctacagcacacatacacacacactatcctgtgttatcctgtgtctgtttagtgttttcattcacatgtgtgttttctttcctctccacccttgtttctctggaaagtcaggttttcgaccaattatttccctgatttgacaaggtcactctgaacttactttcattgaaaccattggcagtatggtctagcttagtgacagactgctgggtcactcaggtcctttgataaaagggcatagtgcccttgtatggtggccattccaaataaggaagtaaagaaggagtaagatatttagataacaaatgttaagaagaaaataatagagtaatgagactggagtagggtagggcagtggtgcaattagcctggctaacgatgggggcatctctgagaaggtgtcattagaattgaaacccaaattgtgagaagaaagcagaaaaacaaggatcgggaagaatagctaaccaggtagagagaaaagccaggtggtagaaattaatttgctttgttcaaggaacagaacaaataccagtaagatgggacagagtggtaggggtacaaaaatgaggtctcagagatagctgagggctgggtatacactcaaactgaccttcgtttacatctacaagcactggaattgctgtttttcaggtgtgtcccaattgtaaatctaccattatttattgtagaaaataacttcacattgctctgcactgtaaaaaacctttgacatacattcgcattttatttaacatttcataacatcactttgaagtttgcagacctgatgtttgtttttggttttgtttctgagacaggatctcactctgttgccgggctggagtacagtgatgcaatcatggctcactgcagccttgacctccctgagctcaagtgatcctcccacctcaacacactaaggagctgggacttcaggcatgtgccactatgcccggctaatttttctattttttgtagagatggggtttcatcacattgcccaagatggtatcgaattcctgggctcaagcaatcctcccacgttggcctcccaaagcgctagaattacaggcatgagccactgcacctggccaagcctaatgttatttctgttttgtggataaggaaattatgataccaaaaggttacatgaattccataaaaaggtcaactccccttccctccccataccccacatgttttgacatgctatgcttgacacccattttgacttgctaggctaaatcaaaattttcaagctgggagcagtcgtgtgtacctgtaatcccagcttgctgaggcaagagaattacttgagaccagcctggacaacaaagtgagaccaccccctttcagaaagtcaaaactgccttttagcttggatagaaaatggatttgtgactttggtataactaagggctcattattgctcaaaacaggaaaacaaaaagaattgctgcaatgaatgaaaaacaggcaaccttggtttgttctaatagcacatgtgtgtagagcaagaatctacattctctgtttagccacattttttattctgctgggtggctagtttataaatcatgtgttggtcactgtcagatttaagttttaagtaattctctctgaaacatgtatttgaggagagcaggacagcttaggcctggtgagatatgttgacaatctgaactagggtaatgatagtttaggtctcctcgcttagccatcttagtcactaaggtgtgtctgcattgtataatcaataatgtttcccaatcttgttgaaatgacctcacatgtgatagcacttaaaaattcaaagaagtgagctatagttacttttcttctatttttcatatatttactttattgtaaacgtatattagattatatatgtctttttaggaatttcagttatatttaatacatatttttttctctatatgcttaaaattgcttttaattttatatcttttcaaatactaatgtataatttttagaattaaaaaatattttctatcaagaagtactattgtgctctgttctgcgttttgtgtgtgtgtgtgtgtgtgtgtgtcttatagcataagttcttacaagaaaaaagacaattttcttaagttgaaaaaacaatctagatacattaaaaatattccagtgttgaagctatcaagcctactttttagaggcaaaagatagctaatcctgtttttccttgtaaaaaaaatttttaaaaagatattatatagaagtatattatttactgactcaactattaactaaaaagccgtttcaccctatgcagatgataagatgaaggttatctttaaaattcattttctaaaaaaaaaaagtctttcctgtttcttgcttattgtttttataattttagttgtatttctacacatgtcattctctgtatggcatggccttgattgaagtttggtgtcttttcccttttcattcagtccttttcatatttttacattaatgtaattatttttgctttggttttctggtttattaacaccttctctgtctgaattattaaatccatgttgtaaatttttttttaccttaaaagtagctcattttcttaggttttttttttttttaacacttacacatttattaagcttgaggtatgtgtttaataatatctttaaaaaaattatttcacttttctgccaagtctcaaagctgctttcctgatttaacattgtagatccctgtaataattttttacaaatcactattaccagatcttaaacttgaggaaaaaattttgtggttattattcactagcgttgtgataaatatttcaaattaatttttaaatatatattataattatcatattttaaatgcatcatgattttaatgtgctcaataacttttgtaaagcactaggatatattttttcttatattatttaaaatattcgagtcctgaaaaatatgaaatgcttggatacatttcctctattatgtttcgatgcttttctccgtagttaacctctcgtgtctacaacaacctgtatctcaaagtacatgcacatgttatgcaaacaactaaaaccaaggcaaaaaaaagtacattctattaagcaaaattggattggaagcacatccgtaaagggaagaattcaggatagaatagtgatatttcaaaagaaaacttggtttctcacagattcctcatggtatatattcagatgttgttacataagagaacattccttccaaattatttagtttctggtgttttgagagaagagtagccttcgacatgtcttaaacttcccttgcattcattactttttaaatgtatgcattttaatatggagactctcccacaaaaatagtggaaaaggactggtgttttacagtggaaatactaaatgctgttgagataaggaaaatcaactttttgaaagaaaaaaagatgaaatgatagccatctgatggttaaaaagtggtaacgtgagatattctatatttgtgttttacatcaattctattatgtctgatttacccttgaatcaatgtagtggcttaatgatgatgacatcatcaacatatgaagatgacaaaaaaaattaagctaccgaactacccaaatgtttttagggaatctttctacttcttccccgcagccaagaagcaattatactgacatttagttctttcatttccagcaggaagcttacctactcttttttcggagatgattaaaacctcatgccacttagcaataaagagaccaccattactggtgggattcatagtggaaagcattaagcattttggcagtgagtcctaaagcctttaccatagcaggattgatataggaataagtggagattgagggcacaggggatccaccagctatcccttctgcaggtctgtatgattgcacttagcagatttcccatgcttactattacacagagagatttactacatagaattcctaactggactcctacctttcaggtttctccctgcctttccaatccattatccacactgccatcttaacagtatttctaaaacgtaaaattcattggttctctcctttaaaaatctttggagatttcctattgccttcttcatgtggtccaaactccttattatggcacatgtgggtctttcagggtttctaacctatattcctagaacctcctgttttctgtgtccttttcccaaagagctgacattaggaatgcctgtccattggattgttgcaagggttcgatgataaaatatatagaaatatttcataatagctagcatttattgaccctttatcatcttaccaggtgccaaagactgggcagggaatttatacatattctctcatttaatcttcatacaaccccaagagatgtaaatgcttttataaactccattttataaatgaagaaacagattttgagaggtcaggcaactttcccaaggtcacacctatagatagaaatggagttgaattttatctctccaactccaaaattgatgcttttatagattttactgttgcttggcacatttcctagtgtacaattccatttgattaaatattcattttttaaaaaccattactataaaacttacagtatctaaaaaatattttggtttgctttccttgccctccaaggttagctgatacctcacttcttggactctttctagatgtcccatcccctctctgctatcctcttccatcttcacacgcatcatacttcaagtgtaatggttgacctgtatatctaatgcctctgatctgttggcacttcacgtatgcagcactgtgtctccattgtcttcgtaccctcagggattagcatcttgatgttcagcattcaatatctgttgaacaactgaaggaataaaacagactccaaggataattttaaagtatgtgggctctctcttttctcacaactgctgcatttctgcttccatttaatgtttaactgcactaacacttcaactaacactcagctagattatgaaagagcaaagacagacttcagagcgtaacagagtaagagagaatgaagaaaagacaaaatcaccctcttttacttcattcctctcccccaccctccaaacttgagagattgtcttgccagatgaggaagagacaaagttgaaggagagaaaaggtgtgcttagatagtaaaataacatttaaatttttttaaagattagttataccttgtgttaagtctgctattcaagtctgtttttttttttcctcatggtcctttttaacaatattttgcaaacacaggaaaacctacattcatggcatttctgagaggttggcaaatgaggaaacactcccaaattctctcctgagaacttacaggagatcaactgatgagcacatggtcaccaagtgagtcagtgtaagttctatgaatagggcttggatcttctgactactcgtctagggtcctagtcatctagctactgccatgttccctgaagaatttggtaaaaatagcagatggcataactgacaaagtaaatcattgtcattgccactgtccatgttctatttttccatgttcagtagcataatttaaaaactcattaatgcatgtatgctattggttattatgtaataatatgtaaaaaacaccagtacagaaatacttctataatttacattatacctttaaatacagagaacccacataatatcaccacaaaggcatttcataaattatagaataaaacacataaatattcattctgcattattattctgctaaggaagagcgcaaacattatttttaacaaactgctctttaaaaaaacttgtgtggtaggattctccatctgtgagtgagattcaacaactataaggtccaaagcagatttggtactctgggagaaaatagtaataatgtaaaacaaaataatagtcaatgtgatctaaatacagtatatctataaagtacaatctctttcttaagagagagaaactcctgcctctgcctttacatttattagacaaacattaaaatctcaccaatttaccccctttgtctcttctttatatagggagattgtggcttagctttctctgggagattgtggcttagctttctctgtagatataaaaggcaaataaagcctgggtttgggtcctagcgctgctaccagacaaatgtggaacagtagaaaagtcctacaatctcctttagcttccgtttctttatctgcaatgtggggataatgttacttactgtccttcccctcaaggttgttgcagagatgaatgacataggtgtaaatagggctgaactcattcaatctctgaacagagaaggattcttacaacatggactctaacttcgccatttttcagctaagaaaactggggcacaggaatggtaaaggtcatgcgtgtctaagacacttggccagtgagttatacatctattataagactagaaactaagtattttgattccgtactatgttgttgtgttttatttttgtgttttattattgtgtcgctgtaaggtttctttgtcttttcacttactaggcacaacagaactcatatgcacgtgcaagaagtaaaagctatgataaaattatctggaaggggaagcgggttgtttacacaaagtaacatgatagcagatgagcaaagaggaaggtacaaggaagaatatttactagagagtttacagcatgccaaacatagagtaaaaagtgaaaaccttttagccagatttgtatacctgattaaatatctactaagggtattatttttaatgtatagagttatcaaaaacacattccttgctttctgtttctaacacttctagttctagggctcagtggctcttaacaatgagcaccaaaaccctgcttcatgctgtgttgctgcctgtgctagctgagggcagaaggtgcagtgagaaaatgtaagggacttttgggggttggtcggaaagagatgaggaatagttactgggcatgaagataattggaaaagaagaaaatattgactaaacatgtcaaatactcattcaataatgaaaagtaagaaagaccaacaatatgtgagtggttgagagaggagaggcagaaaagggaaccaggagagtggaagtgcttgaagctttttagatgagagtaagagctgacttaaccctgtgtatgtttgatcattactaatcctccttataccctagttccttcctttatttccttaatttccacatctatataaatagaatataaatacaaatgtaaatgtattatctataaatagagataaacgtaagtattacattatcacctgtggttttctcaaagctcacaactattctatggcagttcttgatggcattaagtgaggatgttaacctgttgttttacatgcatatggatggaacacaaaattaaggtggcaatgtaaagcctttagaaatattcacccttcaactgtttaagcaacccactttgcatttatctattagtcttttgtttagctgccataaaagccctattaaaatgtttttgtggtcttaatttttaagttgttgcaaattgaattgttaaaggtaaaatattttatggtgtaagcctatagtgagagcaataagtgaacatgtaatatgttttaattgcattctgttaccgtatttatttcacttcacagatatttattaaatggttactatatgccaataatgagctagatcatgttgtaaaggatcataatcagcctactaagaaagatttgattctaataaggtcatacagatgttcagtgaatttacttggagaacatattgctgagatagggatttaattgccaactgaaaaaatcccttcagtaaagttctgagaaaattgctatgtctgctatttattacagcaccttatatactactatatccctcatcaagatatagtacaaaaaatatactaaatacttagtttggaaactgaaatatgatcagaggccctgggaatattttagttcttatcctagacaaggagaccaaaaagtgtatactcattgagaaaatgtcaatatgctcgctaaacctaaatatagattaggaagacagaaagttttctagatatgaaatgaagaaagatacaacatgatccaaatagagctacccttcagattttaatgaaaggtttagagagaaaaaaatagtgttcttcaagcttaatgtgaaaacaaatattaccttcaagtggtgtcttcaagtacatacctagttttgcagtagcatccattattgaagtgattacataaaacatgttctgtgtcttttatctttatatggacagtttttggaaaactgttatggcctaaaatctgaacatgttttaaaaatgttattgtgtttgtttctggataatcttatttcatctaattcatttttatgttcagcttttaatcaataatttcaggttaaatgcaattaaatgtctgaaaatcaaacaagctgtcaaattaaatgctctactatctaataattgatgggtttttcttgttggctaatgcttcttctgtattgatcttaattttggtccaggcactcaaaagaggggaacactttatatacctctttttttttatttcaattgtttctgccttttgtcaagttagacataattttgtagcctgtcatacaatttttacttatgctttacttgcatcacaatgtaaatagtatgattcaaaatattgcatattccagcatgggcaactggcaaaaccctgtctctaccaaaaatacaacaaaaaattagctggacatagtggtgcatggctgtggtcccagctattcaggaggctgaggtgggaggctcacttgagcccaggaggcagaggttgcagtgaaccaagatcacaccactgcactccagcctgggtgacagagtgagaccctgtttcaaaaaacagccaaccggccgggtgcggtggctcacacctgtaatcccagcactttgggaggctgaggcgggtgtatcacaagctcaggagttcaagacaagcctggccaagatggtgaaaccctgtctctactaaaaatacaaaaattgccaggcatggtggcaggtgcctgtaatcccagctactcgggaggctgaggcagagaattgcttgaacccgggaggcagaggttgcagtgagccgagattgcgccactgcactccagcctgggcgacacagtgagattccatcaaaaaaacaaaacaaaacaaaacaaacaacaacaaaaaaaaagccaaccaaagaaaatattgcataataaaaaacactacaaaattatgttaatagcactactctactctgctgttattatatggccgtcttacaaataactcttcaaaagttattgattttcaaaatattcccttcaattattttactttggtcttagtgctctttgtcaattttaccatcgtatcttactctttgtatcattaaagtaagataatacatctctgaaagccatagtcttctagaaaagacatctgaaaaactcaagcccaaaaggaaaaagaaaagaccaaagtgtagaacaatgttgggcttattatctaatttatttttggccctgatcatctgagccagcagttgcttcttttgaaaggtggctcaaagttactctgtgctgatagaatttattacaaggaaaggaataatttcctcgtcatggtgtcaacttataattgcagacttcaagttcatataagtcatctgctatgttcctaaagtcataagacaattcagaatgtacattgctgttttgggtcatcctaggcttccttctctagcttcttagatttcccaaagtgtcaagtttaatttgaggatttgctccaaactgcaggagcttattaaacaaaagtaaggaaatatcagaggtcccatatgcttaacttcagcaatttccttattaataatgacatacaaaaaggctacataattcatattggatttacctgaatcgacaataatctcccttggttttctaatatccaccttaggatgattttgaaccattttacatagtaccattttgttacaaaatttccatgataaactatcagaactactactctttgaaagacttacttgaatgcgttaacataagattttttgaaagtcttatttgtaggctttatgagccagtataacgtgaaaggcaagttaaaacatgaaaaggaaatcctccaaaaactaacaatatgctccctctgagggtcctgcctagttctgtggcatgcaaagctatagctgatttataggagagcctcaaatgaacaaagggctgaaaagctaattttagaagaaaggtcccagcaactaaaatattttagctcagagtaaaaaggttacaaaatcaagttatagtagcatatatttattgaccacttgtcacatgccctataatgtaggtactattatacccattttacagatgagaaaactgaggtttagggaaattaagtaacttgcacatacaagtagtaagtgatggaggtggaagtggactaatagaaatatgactgtagagccctctttttaatgctacagttattacaaagtataaggatgatattcctacagatcaagtagttaactgaatcacatatctccttaataaattattcccaaaaaagatgagcttgaatctattcaagttttttagacttaacatcatttacttaattagaaattaagggtaataaaggaggaatatgttaaataataccacatggaagcaaacatgcaaatctagaccaggataactgacctatttctgtaacaagctcttggcatgcaaaaaaaaaaaaaaggcctttgctaggatcttgctagtgtggtccactttgagtccagcaacattggcactacctgggagatgttaaaatgcagtagctctagccctccccagaccctactgaatcttaagatccataagtgattcatttgcatattaaagtttgagaggcactggtcttaatgacaaagacttaatcagttataatatgtagaccttgtttaaatgatttaaagaaccagctgcaaaaagatatttttgccaagagaggagatttggtcattgacttgttcatcgattctaccaaagaatgactgttaatttcacgaggtgtgataatggtgcctcctggatatgaatgaatgtccaaatcttttaaaatttaggcatgcatagtgaagtgtatatgtctagaattttctttacagtgttttatcaaagaaaatagcaataagtgatgcaaatatgagaaaatcttgaaaattgttgcatatgtgtgattggccattctactcctctatttttgagtatattatagagcttttcataaatttgtttttattttaaagattaaaagaaatgggtttatgccttaggagaggtgcatttgtttttgtttttgtttttttgacatagtcttgttctgtggtccaggctggagtgcagtggcacaatcttggctcattgcaacctccgcctcctgggttcaaacgattcttgtgcctcagactcccaagtagctgggattacaggcatgcaccaccacacccagctaatttttgtatttttagtagagacagggttttgccatgttcccaaggctggtctcgaactcctgagctcaagcaatctgctgcctgcctcagcctccaaaagtattgggattacaggtgtgagccattgcacccggcctcgaattttagaaataactataagaaagaagtttcttatagtaagagtgattaatcacttaaagggatgccagaaaatctttctccaaaggattttttacaataggacaaattcattggtctggggcagttttagatatagtcttggtaaaagccagaagacttaaaaaactttcaagttctctttcacaagaaatgattccatggtagatgttatacttgtgaatactttgggccatttgcgtcagatttaatgccttagttatgattttcttaaaaagcagttgatgatggctctgttctagccctgtacttactctcatggcattcttcactggcagttcactttaatggttgaccaatggaatgctgagctacctacttgtccacatcaagcatttaatagagtcctgtactaatctcattcttataagtgcgaactaaggccttttgatgttatgtgatcaataggaaacactttaagctggtatgtgtttgtcatatagaaaagcattccttttaacatcatataaaccctttaatgtacttactcactgtaaagcacatcatttttttttttttatttctggacaaggagggcaaacaggaattccacaagctattaccagccaaacccttttgcaacttattaagtggcagtatttgtgctagtatgtcttatattttgtggctccttcctatagaaacccgagaatagttttcaaaaactaaaataaactcagccatcatccccagagatagacactatgctgtatgcagatgaaccactaatgcctgactggtttagtagatgccatgtatttatagagtgagtcagtgggacagcaaaaatttgcttccagaaaccttcctatttaaaatacaaatagtttctcctatatggttctatgttttggtctatttgtttgggcttcatgggataatacaaaggatctaagtttttctttaaacgaatacctattaggaggaataaatgagtagaataggatagtgaagggaattttggtttcaactgtgaagcagagtcactgacactcagacagtgctacttacattcctgtcatttaggtatgcccatggtgacaggctccctatttataggaagccgcattcttagatgtgtatgattttcaattttgtagatatttgtttgcttttcctcttctttattcttctagtcacctagtctctctctgttccatccacaagagcagctcctgcataaaattttctccattgctcattagccctcagtgagtacaaacaaaatctggtagtcaaatcgtaatcattcctttggcatactgcaaacatgccccacacacccctctactcctcagcttgtttgttttgctatggtacaatattatcatccttggctagagaattgtaattaaaataatttgttgtttctcctaaccttgttgctactgttaaagattgttcatgattataaaatataataacatttcaagatacctaaaattcttctactactgtaggagcatgatgctattttaaaattatgttatgtcaaaagaaagaactttaatgtgtgtgtgtatatatatatatccaaaatggattctacagtgaaataaaacaatgagtaccatttaaggatcattttccccagaaaacataagattaagacaaaaagatgaacacgtgttaaatattttatttcattctgtaatgaaggaaccagtaagatgttacagatagttcaaaggggaactcaaaaaccagacatatttataaatcaagacgactgaaatgaaagtatagacggtacattcttccaaccttggggaggaaagtcaattcaaagtctattgggttgaatttgcatagacaagaatgtcattgtttatagacaaaaaccgttttgtcttgctaccagcttttacaatttatagagttgtaaattagctcctatcaaatcagaatcagatagccctaagagtatactctagacactacatagtttcgactttttttttttttttttttagacggagtcttgctgtgtcacccaggctggagtgctgtggcgcgatctcggctcactgcaagctctgcctcccgggttcacgccattctcctgcctcagcctcctgagtagctgggactacaggcacccaccaccatgcccggctacttttttgtatttttttttagtagagacggggtttcaccgagttagccaggatggtcttgatctcctgacctcgtgatccacccgcctcggcctcccaaagtgctgggattacaggcgtgagccaccgtgcctggcccgatttttattttaaccagcagttttgtattcctaagggcaggatatccatagttagtccctcctgccaagaaaaagaagtccagcctccttaggctgacgttcacaatttagcttcagcttctttctaacattttcttttatgaatcccaccatccctatatcctattttattcagtcaaagttaactacatattcccaaattctaattaatctttcaagtcattgataaatcgtcaccttcaccaagaagccatgtcgtattttatctattctaaccgggaattactaccctccttttgatacttacgcattttttagtacttttcttctatattgactatctgctgttctcaaacttgaaggcatcagaatcacctagagtacttgttaaaacacagattgctgagcctcatctatcctctgtatcactggatttgaggtggggcctgtgaatttgcatttcttacaagttctaagataacattgatcctgcttctctgaggacaacactttaagaaccacccacccagggatgtcaaaaagcaaatacccggctgggcgcgatgactcacacctgtaattccagcactttgataggccgaggtgggcagatcacctgagttcaggactagcctggccaacatggtgaaatcccatctctactaaaactacaaaaattagctgggcgtggtggcacgtgtctgtagtcccagctactcaggaggctgaggcaggagaaatgcttgaacctgggaggttgaggttgcaagtgagcagatatcgtgccactgcactccaacctgggcgcaagagtgagactccatttcaaaaaaaaaaaaaaaacctataaaacaacacaacaaaaatcaaaaaaaaattcagtttaaaaatctaattggcttttttctttcagcagctcatgaatgggacagcatcccatctatgaaatagaaaggtgcttgaatgagttggctttataggaagaaaagggctaaagaagtggaaacaaaaagtagagtggtcattttgaagttactttccttatagagttaaaccagaggggactttcctatcataccacttcaggttgactggaccccttctgactggttgctatgaatcttccttttttttgtttttgcttttaaactggttcattttaaatttcagtctgattgtgcggcacctagcacatgtcactctattctgatttgttctggtcttatggggcctactgcaggtgcttccataaatggccttaaacaattgccattaaacaatggccaaccttccataaaacaatggccttctgtaaattttattttatacagagaaaccatgtaaaaaactgcagacaagaagatgaatgagacatatacccagctcttcatgagttcacaatctaacgggagtgttgaaagctggctccccaaaatatcactgatattacctttttggtaagacaaaacaagttcattgaggtatggagaataccacttcaacagagcctttgtagtgcctaaaaagaaggaaaagggtgggacatagttggaatatttgagattttcaagtctaatttaaggcagatctctcaatagggcaacttggctaagattgggtaaggatcatgatatgatagtttaggattgataaaataagatgtggcaagggattcaaagagtcctagtgtataaactattgattaatgctttctattgaagaattgatgtatcattccagatgctcctagaataaactaggagacagtagagtgagtgtaaggtcatgttaatgtagacaagtatattaatggtttccattctcagagacagacacataaacaaaaaattagtatggtaaggtaagtataatcaaggtagtcacagtgccctttgtgagcaagtatatcaaatcttgtaacctccctgccatctgccactgccaggaattccaagatggtgaatgtcttactttggtttatctctggtatatcaaggaaaaggcactgatttttagcaaggcaaagtttgtccttgtttctttctctttctttgtttatactgttaacagcctcagaactgatgtgtatactttcacatattttatcttacaaacaatatcaaatttgtggggaatgaaaatagttcatatttattaaagacctactatatcatacaaccaatgcaaatatatatatatgtttgcatatatacaaatatatacatttgtatatacgtatttgtgtatatatactaatacatatatttgcatatttgtatatagatgtatatatacacaaatatatgcatatgtatatatacatatatattaatgaactatattttatattttcatgttaattatgattttccccttataatgcagataatcatcattgagaccttaaggataagcaggcatctgtatggcgctctttttattttatctaagacatatggtctcttcttttgaggagaaagtagtgagaatggcagaggaatcctctctttaataataatagaataagtacatgtatatttaaagtgtgaataacatgtaatctttactttgggaagtaacttcgatagcataaaaataacatttatttctttgcaaatcaatttttagaaataccctaaactgattatatttaaattacatctgagaaagacaaatttaaaattttgaaattcaaattttgccagtgattcaatgttcaaattcttgcaataatagttacaactttgtttttaacaaatacaccctatgtttgttcacaatacttgaaagaatacatagcatgctttttactagttccaaaatcaaactagaacatatgcatactataaagtaaatttacttcatttatttatgacaagcttatatgcatgttgcagaaattcactgaggtaaaactcacttctatactttttaactaaaattttaagaaagcatctacatagacagtagtataactctacaagttatcaaatacatccaatcatgctaatgacatttacaacatataaatttgctagctaaagaaacatcattctgttagccataaacttttttgcacacagctgtcttcttctttttgccatatgagcttacaatcacatctttcattcccagatttttctgtgccaattgaagctaagtcaaactggtataaagaaggctttagagagtaggatgtcttgaatgggacctcatagcttttgaagctagtgagtgaaaacgtggggctgaaagagcaagcccagaaagatatgtcaggaagtggcaacagcctgccctgcatcttctctgtaaatgagatggagaagcatcaggatcaatagaagcatgttatctccacgcacagcatactaaagtacgagtgttaaagaatattgaatattgtgtctagatacaggatgaaataaggctttttacaaacagactataaaagttgccagaggtgtaaggtggttatgggagcgctgaatctttctcaacatccagtagaatagggtttcttaattgagtattagtagcatacccaaaaaatcaaactctggcaaacaaagtcatgagtaatcttaataagaaagcaaaatggggcgataccagtgtgatttggcaagctgttttctgagcttagttcttagaagaaacaaaagaggaacatattaccagggacaaaaaacaaacaaaaaagactggcataaaactgtgaaagagtatcaggccaaaacatagagtgaggttatataagcaccaaaaaaactagtgaaaaggaaagtcctacaataaaggagaacaagatggatgggtgaggcttgtgttgtttaacaatttattaaaagaaagagtaagtttaatgcctatttaattttttttttaagagatggggtcttgccatattgccctggctaggcttgaactcctgggctcaagagatcctcccagctcagtgtcccaagttgctgtgactacaggtgtgcacaaccacacttggccacagttttgctttatttttctcaattaagaagaatgagctacaaggaagtacaaaacaaatactgtaaaattgaaatttttaggctaaggcacacagggatacagtgaaagaacacctacatctactttacatgaattgaaacctcttggtccagaaaaccagaatattttcctatgtggtcacaaaacctttggtagtaaccttacaggaatcatagtgtatttttgacagttatactccctcctgtaacaaacttcaaaatatataaaatggcttaaatacaagagaagtttattcttgtttgagtctacatttggagttcctgggtggtggtggctctccactaagggtgggttcaaggacctaggtaccttctatctcaaggctctgtcatatttaataaatggcttctcaagtcaccatgttcatctgctacaagtatgtgaaaagaaaagagcatggagatcaccaatagggactctctggccaggcctggaagtagcacacaccatttttgcagtccttccattggctaaaaaataatcacttgagcactgctgcccaaaaaggaatctgggaaatgtaggctcactatgtgcccagaaaaaagaagaatcaggtttggttacagctagccattctgtagctggataatgagacatctgccagaaaactgtagttaggcgaatagcccgaatttttaaaatgctattgaaatggagttgaagggtatagaaacatcatagacttgaaaccatttcagaggggaaagcagtgatcacttggagtctgtaccttatcttctgcgtattagaaagatgtttaactaatatgtggcattgttgataaatgagttctgggtgatggtagcatttagtggattcatacttctttagattaatgtgttcaatgagtggtagtcattgtcatccttgaaggtgtcagttgacctgtgtcttgtgactttcctttctcatgtctcattaaatatttttatgaacaaccttaacagaggcaaatttatggttgactcagtaattagggataccgaatgtcactgtgggtgaaagaatcaaaatgatcccaacagtttagaatacagtccaacagaatttttctgaaaagggccagggagcaaatattttaggctttttgggccataaagtctctgtcacactagtcagctctgctgatatagtcccaaagcagccgcagacaatacataaatgaatgggcatggctgtgttcaaaggaaaccaaatttataaaaacagatggccggccagatttggttcatgggccatagtttgctgttccctggtctagaagaataggctgaaattctgaagggaatcaatagaattttttttttttttaatttacagccaaagaacaatgggcctaatacatacatcatgtcctttctaataatagaagagctccaagttaggcactatttgctcttattttacagatcagaaagctacatctcaatacataaataagtcaatagtttgacctagctttcacagccagaaaacccgctgtgggacatcatgccactttaaccaaatgtttgggtgaactgagagagtaacagttaattgcttgagtaaaagatggagggaaatgtcatgtggcagcatttcccatgggcaaaccctgcgttctggctctgttcttttccaagtgtgtgaccttgagaggtacacttgacctctctcggccttgatgacccaatccataaaaatgaaaggcttgactagataaacaccaaggccccgctcatgtcttatggttaaggttgcgattagtatgttaagggcattgtgtgaaagacaattgagatgtattctttgtagctcttaaagtaattattttcaaccattttctagtgtacttttatgggagaacagtatgtaaaacataaaaatggcattttatgagcctacatgtgttttacaagttcaaatttacattttgattataaagatatttattgagagaataaggctgataggaaaccaaatttttaaactgggaggataaatgatcgacagattctttttagcttcagcaactccgcattctccccattttgcttttgttgtttgttggttttcctctggttgtattaagaaaatacttattcacatacacaaaaggtaaatgaatagtttcgcaatctcagaatacttttcagaatatagacatggcaagagacaattgaaaagcaaaatcattaacaaatcaggtgatctttagcatattaatatatcattaaaaatgtaacttaatcatttgcaaaatctatcagtcaaaataagctaagcttattctgtgatgccaaatgaacccctaaacctaagtgacttgctgaaataggtgtatatttcttgatgtatttcttgttcctcttacatatccaattttgggttgtattgggagcaggggctctgatccatatagttacatagggatccagactgatggaggctccaccatcttgtagctgtaccgtcctgtgcacatcatatccttagctgctgaggcaggggctgaggcacctggagcgtaaaacactggcagttttaaacagcgcctgttctttgcacacgtatgtgaaacacatacatcactgctcggtggttgccagatctagtctcatggacctttttcggaagtcattgtgtgactcatatgaactaaatatgcaaaaaccatttggaagaactaaagtagcaggccgcaaacgtggcttataatttaaaaattgaggttcctgagttccccaccctacagccatggaaccagaatctctgcgtatagttggagaattttaattttttaaaaagttccacagctgattctcattatcaacaggcagctgctgctgtgaacaaggagtgtttttaaagcggagaaaaggcaatacttagattggcggatttaagattaccctggctgcagtgttggagatcgattaaagagggggtaaagtagaagctgggagatttcattttactacataatgtataggctctaatgagcaaacacaaatgcatgtgcttacatatcatgcagtgtgttagcagaactagctcaatctgagggcctaacaatgttgttgatgtctctgtatatttaagaatcttatccccaacccttccttccggactcctagaaaaccagtagggtaggtacaaattggctgccaaccagtccttgttcaatgcatttgataaattctactggtggtggtggctgtatagccagcttggcacccatatgagtctgtggatagtaggtggggctgaggtgcctaggcatgccctgcttctctcttgagaggcaattagaaatgatccaactttccttcaagcctgttagggcagcatagatttgagttttgaatctggttatattgctgtgtctactgttctctaggaagacttgagaatttagagtagatctgcaacagaagaaaatgaccagtgcatgattctgcttgaaaactaaacctgtctagtcagtgctggatcatttaaagattgaccatctaggtttgaatttctcttcctatatgctgactgcctttgggctgattcacctggggatattagcatctttcccagattgtgtttggtatggggaggtggggagttagggaactcccatctactttgggaagaggaataagttctattcctttcaaacattatgtacagcacttaggagtttgctgttcatgcatcatggctgaaacatttggacaattgataaaaatttgtcattgctgcccagcactttctctgagatggatgaacttataggtaggctctctttttattgtacttcatttcatcttgtattgacacagccccagttatagactttcccccaacagaaggaacaacaacaacaaaaaactacctaactactggttacaggttaaagctggaaatgtgctggcaacagatttaggtttttccaatattattttgcctgttcatcttcttttttctctattatcttttttttttctttttttgagacagagtctcactctgttgcccaggctagagtgcagtggcgtgatctcggctcactgcaacctccgccccccaagttcaaacgattctcctgcctcagtttcccaagtagctgggattacaggtgcacaccaccaagcctgactaatttttgtaatttttagtagagattggttttcgctatgttggccaggctggtctcaaactcctgacctcagggtgatctgctcacctcagattcccaaagtgctggaattacaggcatgagccaccgcgcttggccctattatctttaataaaaacaaagatagggaaattatccaaaaaattagctaaaagctatataactttaaaatatgtgaaattaataatttcaataaagtacttaatataccacaaaacaaatgttttcacttatcagcttttcagattaagtatcaaaattctattcaagtaacatgagaaggtacagcaatatgtgaagacccattatagaattaagagaggagaagaggaagaacaagggtaaagaagggcccagaaagataaaaagacagagggtaagacctccttatagctatgcatacagtaccttctgtagacacacactctctactgcaacctcaaagaaagtgcaggcaggaaaagaaatctgcagaagaaagaaaatgagaatgtttgtcttcatgatgtaacattattctttgggtgtcctgatgagctattgttcctcaaggtttttaaagctttattgagttttcagaactttaagcaccattggtaataccaattggcacttgtccaatgagctgagtgaaactgatccaaaagctccagaagctgccacattccaggtatggagtatttgggggctgtaattataccattgtaattactgtctttaataggattaaaaatagaactggaataattctatggtaagttgatgtcacttattgtgacccaagtttcaattataattgttaacgatgctattgctgagtccttgtttggcttgactgccatgcagtgtttttctgatgagtgaaggagttaacaccttttggacaattttcagaattgaaagaaaattacttggtttttagtagggtttgtaattattatatccaaggttggtatcttctagaggggaactttttagaaaattaatattagactctctcccagtctattgaaaggccgtattaaatctctatcatatactcttcaatgctgtgatcatgattatattcaaacgataacccacattcttcctctttgtggtcatttgggacacaggtggcagtctcacatatgataaggaatttgaatgttagcataaaccattttagtggcaaaaaacacacaaatgctttatataaaaaaagagtcaattttaagggtatcaaatttgtctatgaagttaagctttaggtttactggcagatgcagatgtagtgactgtataatagattcatgccttagtttctaaacttacaaaatctgtttgcttagtttagtgtcagattgtcagtctgctttattgattccatcagtggtttggcttatcatatcagaaatttgagtgctgacttctggcctcaagcgatcctctggcctcagcctcccaacgtgcttagattacgggtgtgggctatgatgcccaaccctaacatttctatcttatgaaatagttgacaggtagatataatttgttactggagaagattattttttcattttgttcttttaagatccaattgttattttctgagtttattaacatagctagccttataatgagaacacagctctcacttttaccattttgcttaaagatttgcagatgtgtcgtgctcatatacttcaatgtctctgtgttttctcaggatgttacagttctgcttcttttatttcctaaaattcaataattttatctgtgttaaaaagtattttaaaatgtaatgaacacaatgttgtggctactcataatagttttagtgaatcaggaagtatgccaggggatggttgttagtagaaaaaccatttcatgtcatcttcagtaaaagataaagaagtgagcttgaattcagagagcttggtatataggatgactgacagagataggagctggggcaggaataaaaagattgagaagattgaacattaaacagaacttcagtcattagccaatgtaaacaagcaatcaaagaatagtccccttaaaataggaatcatttaattcatctaacaattaagaaaatataaacattacaaaccaatgtttttgttaatctggttctaattatttttaggttactgatgatattcttttagtataaaaatataaaatcagagccatttgcctagttttcatgtcatttttcttcatattttcagaaatcattgtcttacttgaaagttttctacttaagattccacaattaaaagaacaatgtttcctttaaggaatagtgctgcgggggcaggggcagaatttcttaaagcattttggggagtggtttaactaaataacctacatatagtagtgcacaagtttccaacttattaatagttgctttccagtgagtttttagctcctacattttttttggaagtaaatgtgatgtaattaaattaaatattctagcaactaacaacaaaaggctttttcaacagataataataaattgaactcggaaactgtaaaaagaatgaaggagaactaatagaaattgatatggaaaggtgtctaagacaaagtgaagtaaaaatatttgtataaaactatggacattggccaggcatcttggctcatgcctgtaatcacagcattttgggaagcagaggcatgcagatcgtttgagcccaggagttgaagaacaggctgggcaacatggcaaaaccctgtctctacaaaaactacaataattagttgggtgtgatagcatgtgcctatggtcccagctacttaggaggctgaggcaggaggatggattgatcccaggaggtcgaggatgcagtgagccctgatcacaccactgcatgccagcctggacaacagagtaagaccctatctcaaacaagaaaacaacaacaacaacaacaaaattgtggacacaatatgttcccatttgtgtgggttttttttttaaagaaacacacatgcatatatacacatactaatccctatgtaaatatatgcatacaaaatttacagaaggatatacacaaagctgtggaggttgattcaggaaggatgtaacaaatttactattatatagccttctgtactatagttttgttttcccatatgcatgtacccagttatatattgtccttttaatttaaacatctagtaaaaaataataatttcaatgagaccagaaattactaagcaaaggaaatggcaaggtagttctacttttttggaaaaaaaaaaaaaagaaaagatggtcattgtatttgaaacttaagacaagataataacacgtattatctggttaatgaatgcctgtcctgtcttcacaaggatttttcctgacataaaattctaaatatctgtcaaaaatatatatatatatatacttgagatggagtctcgctctgtcgcccaggctggagtgcagtggcgcggtctcggctcactgcaacctctgcctcccaggttcacgccattctcctgcctcagcctcccaaatagctgggactacaggcacccaccgccacgcccagctaattttttgtatttttagtagagacagggtttcactgtgttagccagaatggtctcgacctcctgacttcatgatccgcccaccttggcctcccaaagtgctgggattacaggtgtgagtcaccgcacctggccaaaaatattttttaattatatacactaaataacaacataatgaataatgtcttcaatatcagttcctcacacaattatttcttgcgttgaacttcaataaaattcagaatataacactaatggtataacttgataaggtattttataggaagcattatagctcacatttaccaaggcttaatgttttacaggcactcttgtaggcatattgcttgcatgatgttattaaatcttcccgacatctctatatgatctctattttacaggtaaggaacctgagggagagagaggctaagtcagttactttcccattacgctgctagtaagtggcaaagccaggatctgaagttagactaagggcccatgttctcaatgatgagacatgccttaggtatactgactgcagatgacctaacttgatatgcctgtaactcttagacaacttaagaaagatcacatttttcttactgatgattgagaaatgcagtctatctcaaatgcctttcataggagctgaatgacagtcagattggcagtggacagtctagcaagctcctacaagatagaatgggcttatgggaaacaggtcctttttaacttaaaaaatcattttcgaataggtgatacatgcatattatacacacagtgaaaattaaggctctctctcatcacaccctaagccacccacttcttttctcagaaagcaaccaccattactaggttcttatatatactaacagaaatgttttatttgtatgtggataactacacatacttcacattgttttcaaaaattgaagcatacgacatgtggtgttctatatcttcctttcccccttaaaaatacttttctcaagattctttcataatcagttataccaggaactgtgtagttatttttaatggctgaataatattccattatatagacatgtcatattgtatttaatcatttccttattagtcaccacttaggttattttcaacattttgctattgcaaatagaaaattgcatcatttcatacatcagtaggataaatatcaagaagtgaggacactgagtcaaaaggagtgtgctttaaaaatgttgatagatcctgcaaaatgaccctctttgatgatcctgcaaaacggtagtaccattattcgctcccctactagtaatatatgaaagtggtagtttccacccactgttagcaaaatggcttgaaactttttgatcttcaccatcctgatagaagaaaatggtatttattggcagatatttgcattcctcttattagtaatgaagcaaatttgttgtttatgcctttggtgtaatctctgagtccactgccaattccaagatcatgaagattcaccttatgttttcttctaggaatttaatagttttaagtcatacacttatgtctttaatctattctgagttcatttctgtccacggtgtgaggtaagggtttaatctcattcttttgtatgtgaatatggagttgttactgcaccatttattgaagccactatttttccccattaaatggcctgggcatcattgttgaaaatcagtctgttttccctaaatgtatgtgtttacttctgaaccctgaattatatttcatcaatctgtacatctattcttacgccagtactacggtttttgattactgtagctttgaagaaagttttgaaattgggaagtatgagtcccccaactctgtttttctttttaaatattgtgttggttctttggggttccttgcaattctatatgaatttgaggatgggattttccatatctgtaaataaaacaggggaattttgatagggagtgtattgcatctgtatattgatttctgaattgccattttaacaatattaagttttctagtccatgtatatgggatgtctttccatttatttagattttctttaacttctttcaattatgttttgtatttttcagtaaatgtcttgctcctccttggatagatttatttctaagtatttttgtctttttgatgctactataaatggaattattttcttaatttcatttttggattagagatgcctttttgtaatgtgtctatttgcaggggtatctctttctaatcgcacaaaaacatcttgtgctggcactggtgatctttgggagtgtaacatcagcttgaaagtgccatagaaatagggactctctatcttagtgctgagtaggcatttactaaagctgaatgaatggatgacaatttgctgagagtgagcttgggtaggagcttaagagaggcagcaaatatggattttcaagaaattcagtgatgaatggaaggccttaaaaatgaaggaaatggaatattatccaggatagactataaactaggccataaaaaaactcaatgattttgaaaggatgggggaattgtaccaagtatgttctctaactacagtaaaattaagttagaagtcaaaaacacaaagaaatttgggaaattcacaaacatgtggaaattaaacaacatactcctaaatagccaatgagtcaaataataagtcataaggaaaattactttgagataaataaaaactaaagtacaatataccaaaatttgtgggacagaactaatgaggtatgtagctgtaaaaacctatattattaaaaaaaaagaagatttcaaatcaatagcctaaccttctgccttatgaaactagggaggttggggggcggcggggggaaatagaagatactaaacacaaaacaaatagaaggaaattataaagattagcatggatattaatggaataggaaatagaaaaacattagagaaacctcattaatgaaacctcaagttggctctctgcaaggagcaacaaaattgacaaagatttagatcgagcaagaaaaaaacagagatgactcaaattactaaaattaggagtaaaagagctgatattaatataaatcagagaaatgaacaggattataaaggaatactatgaacaacaaattagatgacttacattaaatgaacaaattcctagaaagacaaaactaccaaaactgactgacacaaggagaaatagaaaaaaaaaaaaatatatatatatatatggtaaatgattatagtaatttaaaatattaccagaaagaaaagcctagagccagatggcttcaatggtgaattctaccaaacatttaaagaatgattagtaacaatccttcagaaactcttccaaaaaagtgaaaaggatggcatacttctcaattcattgtcaaaggccagtattacccaaataccaaagccagacgaggatatcacaagggaagaaaagtataaaccaatgtaatatctattatgaatatagacaaaaaataatcaacagaataccaacaaaccaaatcaagcatcatattatacattctgaaggttatctaaggaaggcaaggttcatttaatatacaaatattaattaatgcaaacactatattaacaggataaaggacaaaaagcacaatattatatcaacagaagcagaaaaagcatttgacaaaatctaacgtcatttatgacaaaaaaattagaaattaggaatagaatggtgcttcctaaactagagtaagggcatctacaaaaaaacgatgtataatatcatatttaattgtgaaagactcaatgcattttctccaaattcaggaataaaacgatatctgctctcacaacttctatttaatattgtactgaaagttctaaccagggcaattaggcaagaaaaaaaggcacctgaattggaagggaaaaaacaaaaccacctttatttacagaaaacatgtacttatatagagaaaatgttaagaaatccatttaacaatgaatagaatttattaatgagtccagcaaggttgtaagatacaagaacagtattcaaaaatcaattttatttctgtatactagcaatggcaatctaaaaaaaatctattcacaatatcaacaaaaaataaaacacttattaatgtatgtcacaaaaaagtacaagatttatacaatgaaaagcacaaaacattgctgaaagcaactgaagatctacctaaatggaaagacatccttttgtttatagaagatatagcaatacttcccatattgatctactgatttaatgcaatccctatcaaaattacaactgacttttttctttgaagaaattgacaaggtaatcctaaaattcatatggaatgaaaaggattcaaaatagccaaaacaatcttcaaaatgaagaacaaaatgggaagactcacactttccaatttcaaaacttactacaaagctacagtaatcgagatagcatggtattggcatgggtttaggaatagaattgagagtccagaaataaaaccttgtatttaaggtcaattaatttttgataaagatgcaaagacaatgggggaaaaatcatcttttcaataaatggtgctggaacaactggatagccacacataaaagaatgaatttggaccacttcctcacatcaaacctgaaaattaacccaacatagatcaaagacctatataagatcaaagatctatattagacctatattagatcaaagtcctatgttagatcaaagacctaatataagagctaaataaaataaaactcatagaaaaaacataatagttaatcttcgaactttggattagtcagtgatttcttagatacaatgcaaagcacggatgtgataaaaatattgataaatttggacttcatcaaaattaaacctttttgtacattgaaagccaccattttgacccagcagtttcacttctatgtatatatgtgaaatgaaaacaggtcaacaaaaaaacttaattacctagatgttcctacattattcacaatagctgcaaggtatgaacaatccaaatatccatcaatggatgaacggatcaataaaatgtggtatatcttatacaaagtaatgttatttggtggtaagaaggaatgaagtaccaatacatgttacaacatgaagaagcctcagaaacattaagtgaaagaagccagaccccaaagaccaagcattatatgaaatgtctataaaaggcaaatccaccgaggcagaaatagactagtggttgcctagggctgcaagtgtgactggggagtgactacagatggtaaaaagtttctttttgtggtgatggaaatgctcaggttcaaagattacattttgatgatggctttataaccctgaattgttatcaggtgaactatataattttaacacgtgaattttacagtacttaaattacatatgaataaagttttttttttttaatgaggcaaaaggtagcgtgaaaaagcaggcatggcatataagcaagctttttttaaggctgagtgacttatgtggctgatagaggaaggataagaggaaaggaaatatagtgaaaaggaacagagaggaataataaagctggcaagtcacagacaacataattagactatcaaaagaaaatctggaagaaaggcatggacaggaataaagacctccttctaaagcaaggtagggagagcaacttgatgtagattgaagagaaaaaggaaagaaaaatgaatgttcatatttgatggcctatgattttctgggtcatgtagaaggcaaagtaacatgttcaagtgatgaatttggtaactttaggataatgatgacagttcagacaacaaatacagagaataaaagagaacactgactatatgaatagaaggattttagagacattacgactcagccgagtttaaatcaaagattgtaaggcattcagtcatcaaggttatacatttttctccagcagctctagccttctatgaaatagaagcagaaaaaaaacccaaaacagatgggttaactacctgtaaatctggatttgaactggtagaatgaagcttcctgcaaatgttggatgtaaaagtgcagatctaatcaggtaaaatctcaagcattaattggatatgcttataacaaaccggtaaatttttagaagatgtaaaacatatcttagaaaaataatttaaattattaatgagaattagactaagtcattgaaatttgatttttaaaacttaccgagcctctctttcattgaactcagaagtagtgtgaatggtaagtcttccttgtcaaatggaatgctacttagcagctgtcttagctcgttccagatgctataataaagcaccatagactgactgactggtttataaacacacatttatttctcacagttctggaggctagaagtccaagatcagggtgccagcatagttggtttctggtgaggaccttcttctggtttgcaaactgatgtatttttgtatcctcctgtggcagaaagatggagacagctctctgggtcccttttttataagggcactaatcgcattcatgcggcctctatgctatgaattacctcccaaaggccccatctcctaataccatcacattggggttaggattttaacaaatgaatttaagggaaagcacaaacattccgtccactgcaacatctacaaaataggtccttaggaagtgcagaagtctggaacagttctttcccaagccacaaccctgaaaacatggattgctgggtatgcagattctcctgggtccctttcccataaacaccgaattagacactctgaggatgcagcccagacattctgtatttttcaccaggcataatggtgatggctgatattagaatggtgaaatttatcccacctagtaagaatctaaactgaaaatggtgatgatgcaaaaaagatctgtcaaccagttaaaaaaaaaaaaaaaaaaagagggtgtgtgtttgtcaggagggatagtctttagtagtatggccaaaagcttaagcctgattttcagggctctattgttggagtgggtagttcatcaacttcctaagtaattcaaatctttttccccccaatatattaatatattggtgattccaagaaagagggtttaatttatttaatgcctgggaaaactaaaagaactacaaacagatgtgaaaggaagagaataaccacatctcacaggaagcaaaatttctgtcaaaagttactgttctttccctgtctaggttctttgtccctgaaaggtagatccgcaaactaaatccctcaataacgttgcctaaacaggactgggatcatagaatgtccaacactaacatgagttcataatggcacaacgaacttaaaatgttactattcatgttttaattatgattgcagtcttacgttgaaggtatctccgccgtccttaaacataaaaaaaaaaaaaggaaatacaagctgcaaaagttttatgtaatgcactccaccctcttttttccccaagccaacacacacccttcaaactttttgacagttattttcagacccctcctaggctcccgaactccatgcaactccagcagtctcccctgggccatttttagcctctgctctgacctggcgggaggctgggtgtccaccctttcccctgcagtcctgaaagtccggtccgagcgcggacggggcggggaggggctgggcgggccaggccagctccattggcgccaggcgggtgggggaatgcgctgagaggacccgtccagcttgcttaaaagccatcagttttctgaccccgcatcggttccaggaagaatacacctatgtgacaagctaagttctgcctcattttgcatttagaagccacaagaaaaacttttcgaaaacttttgtccgtcttttgctcccccgacgcgtggtttcctgatggtccgtccccgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcaggtgcgcttcgaagattacctgagggagccagcccagggggacctcgggtgcgggtccccgccccaccggcccccggcgccgtccagcccggagggacctggtgagcccacctttctttcgcctcccgcgcggccgacctgggctgagggctgtggggaggcggcggtcgtggcgccgggcgggggtcgctgcccggctctggcaggtgtgcctgggccggggcgggcaacgtggccggggtggcggccgccgggggcgaggaaggaaggactcgttcggctctggggagggaagactttcagctgcgtgccagctcttcctgctctgctcttcctgctttcctcacctagacttgattttctttccccgccaagtatttcaaggggacgatccattctctctttccctcccactgggaggtgaagactgaaccagttatgacgtccgtgttttcagtcttggattcttgaagagcgctgtgcctgctttggttttggtttgggtcagtctttccttaatatttctcagttgttaggattcacttcctaaccgaaaaataaaaagccagatacttctttgtaaaataaaacacttcattaacattggaagctagttgacattttgcgtcgtgtactttttgaacggctgcacgttgtcttgtggtggcagaacctagaaactttctcagttcctgtttattttgtgttgtgttggccgatttttttcaccacagtggctttgtaccattctttaaaacagtcatttgtagcgacatgatattgataacttaaagaatttttgaaagtgctgctgaacagttttagcataatgcatagggtaacttccagtgtccttggcttcgtttaacaggtagcagacatcctagccatgtctgatttttatttttgttaattgctttaatatttgagggttatgaaaataaatgagcattagagagtttagaaaatagagataggcacaaagtgtgtaaaatctgtttataactccacatcgtgccagtcattttattttaaattttatcttactttatttttgtagagatggagtctcgctgtgttgcccaggctggtcttaactcttggcctcaagtgatcctcctgcctaggccttcccaagtgctgggattacaggcctgaaccaccatgctgggccctgccagttgttttaaagcagtaaaacagtgaggacatttttgatctatgtgtgtaggtatgtaatttaagctttgaagaaatattaaagtctcattttagcatagccctttaaaataaattttccttactttacataaaatattttttatctttagaaatgctgtttatggaattaggaaatgaaaaggggaggggaatacttttgtttctgctctgaaggacgttaaccaaatgcagaatcctcttaaaggtgggaccaggcataggaaagggactttaaagtgttcaaatcaaggactttttaaaatgagttttcagtagcctaattgaaaacagttgatgtgtgaccagccttgaaatgggtggagaattcagaaatatgtggggtaacttaactaaaaaggaatatggttagtattttaataaatatggccaaacacgtgtatctgattcattcggtggcccgtgtctgtagttccagctactctgctcaggaggctggggcgggaagatcctttgagcccaggaggagaatccagactgggcagcagagagacacttatgtgtttatatatgtggagcacacagctatatctgacaccctccttcaaagtggcgcttctgaagtgatatgtattcctcttctgttgaagctgccttatgtattcattgcatattctttaatagtcatggtgcccccaaatctctgacacattagagaggcgttgtgaggtcaaagtatgaccacagtcatgtgggcaggtacgtcctagcattaacttcctgaaagaatttggacaagttacttagtgtctttgggcctatattttcttctttgtaaatgaggttggatttggtgatttcaaaattctctattctagagcattttcatttggagcagaattagtgaaaactagctgacttttgagaggcaacgtgtatatacacaagtgaaaaataaatgattcttcatatgtttccagctagcctttgtttaaaatgagaattctgtgctttgcagctgcttctcagatggattttggctctagggttgttctttgtgtttgtgtcctttagaatgagtgtctgtcagtctgtttgaaggatttcttctgctctttctactcttatttcagtttcttaatagctgcttaagtttcctgctatcattctttcttcagttctttaagaagccctgtgtattataggagtatttcttgttacagatactttcacacatgtaaattgactgcattccaggaaaccctttgttgttagtgatcttattcctcctttcatccactaagatgaaaaagtagaaccttgtttctgttccttctcacaacccaacatcggaggagttacgcatcaagaaggggtggagggagtcatgttcagcaatgatgttgataagatagtttcaccattgacagattaaggatagaccagataaaattttggtcaaatgtcagccagttgcggtggctcacgtcggtaatcccagcactttgggaggccgagacgggcggatcacctgaggtcaggagttcgagaccagcctagccaacacggtgaaaccctgtctctactaaaaatacaaaaattagctgggcgtggtggtgcgtgcctgtaatcccagctacccgggaggctgaggcaggagaatcgcttaaacccaggaggcaaggttgcagtgagatcgccctactgcactccagcctgggccacagaacgagactccatctcaaaaataaaacaaaaacaaaaattagccaggcatggtggcacactcctggaatcccagctactcaggagactgaggcaggagaattgcttgaacctgggaggtggaagttgccatgagccaagatcacaccactgcactccagcctgggtgacagagtaagattccatctcaaacaaacaaaccaaaaccaaaaaaaactttggtcaatgtttctgagtttaccctttctataaagaaaccacttactgaactgttaatgtctctccttcctttactcctctccaaggtggctgcttttgctcttaccagcttttagtgcttgctggctccatcattatagccctctcaggaaaaccataattgagacttagacatattaaggacattatcacaccattgatctagttaataacaattacaaaggaaacatcttaaaatacaatgcttgttcctgattaacgggtacattatgctttgattttaaaaaattgttttgaactttaaatatagctcttgtttgggggcataactataactcataatgtataatctttaaaagtactcacttcactagattatattgtaataaatatagataaattttactagtgtagactctcaacttactgtcgtataaacatgaaatcgtttttatcataagcgtcctattatatcaacctcattttcccacttggtgacaggattctttgagcacaactcagcccttttacattttcttttcatttatttttagcaattaaaactatctttcagttatttaagacttggtccatttatttaaaaatttcagtctcatattcaatttatatctccatttacctttctacctcagttcccattccaagttaggttggtagcggagaagaggtgtggtctagctctcacaaactcccctccaccccttcttgatgcattaactcctctgatgttgggatgtgggaaggaatagaagcaggggtccactttttcattttagtcctttttggccccttagtgggaggatgacaatggtggatagcagtagtagcagcagtgatggaacagttctgctaaaatggctactcctatgcagaagtgctgacttcagtagccaacagttctttcaactttgaatctgggacattaacatctggtaataccaaccatagaccttagttgcaaattgttgtactaggcacctaaaactgctctgcctcatagcatatatgttactggtatgtgtgtgtatatcaatagagttgatgaaaaatgaagttaagtgggaatgtattacatttttatgacttgaattatttgacatgtcaaggaaaaactatttaataataatatttttttaaatgattatccctgttgctgaagtttcattttaggtttacattaagcaaatcctatgtactgaatgtatgtaactgaaggagaagcgtttagaagcctgagattgatattcttgttactggttcacttttgataatcatggaaaatgtaaaccaagacatggaataataattataatagacaaaacatatagtgcttgctgtgtcttacgcacaagttaaccctcagcaacaaccctatgaggtaattaatagtagcattttcattttactggtgagggtactgaggttcattaatgatcctgtctagttgggaaaatagacattggacaaagaatttataactgtgttggttattgggcatggaatgtaaaatatattatgggagtatataagaagggtttctaacctaatattggggggtgtaaaatatcatgttttgcttggattgggggtaatgtctatttcagtaaatgggatgatgatgatgatgatgatgatgatgatgatgatgatacttgtagtaataacagaagtagtaatacaggttgagcatcccaaatcagaaagtccaaaatctgaaactttttgagggcctacatgatgctcaaaggaaatgctctttggagcattttggatgtttggatttgggatgctcaatcagtaatgcacatattccaaatccatcctatcctttaggaagattcaaaaaaatccaaaacactcctgttcccaagcatttcagataagtggtactcagcctatagcaagaatgatagctgtaatggggcaggctctgagcaaaagttttttatttaatcctaataaaaacctgatgacatagtactattattatcctattttccttttgaaaaatctgagccaaagaaagaagtgagaaattcagaatttatttgggtgttttcttagtatttgcaagagttacagtccttgagataggggaaaaatgtgagaagaattaaaattctatcatgtaaggtattaaagttaaattagttaagattgtaaaggatagaatggattgtcattgaaggttctttagagttagaaagatagtaaaatgacagagctggaaatgcaaaatccaatgagggtgtgagaaaaattaggtatatattaggttggaaattgccacctcagatgatgtgttaagagttagatgatggtttatcttgaacccaggaggaccaagtgcctctaaggcaggggtccccagccctggtccatggcctgttaggaaccaggatgcacagcgggaggtaagcagcaagcgagccagcattactgcctgagctctgcctcctgttagatcagtggggacattagattctcataggagtgtgaactttattgtgaactgcacatgcaaggtctaatccctgatgatctgaggtggaacagtttcattgagaagccatctctctccccatcccccaccccttgcccacatgtccataatccatagtcttccatgaagcctgtctctggtgccgtaaaggttggggaccactgctttaagagacctggagtgtaccagttgttacagtaactttttaaaacaaccaccaccaccacaaaacaaaaaactcacagtgttggtagaagataaccctagctggccccagttttagtctcttttcctaaagccggatgggaggaagagaatactctctacttgatcggcaacctcagtgggctctagtggtaactcccaactagttagcctttcttaatagtgtatcatttagttcagtggttctcaggcatgaggttgatttgcctgttttagaattgctgcttgtctcacaggatagctgataggaagttctgtattatctatgttgtagaacaaaactgcctctaaaataagctgatgattctcaaacttcagcatgcaacagaatcatctcctgaagggcttgttagaaaaatattgttgaatacctctcctagaatttgtgattctgtgtggctgagaatttgcatttctaacaagttcttaagtaatgctgatgctgctggtctggcaaccacacttttcttagtgggtaagtcttttatccatgggaaggttagaagtaaatatagaaatgatgaaatttattaaatgcttatattaatagttttgttttaagtctaggaataatcagtgtatttggtctttaaggtatttgttctgtttcatagaattaggcctataaaagtggccaacaaattagtcttaagagtataatttaaaatgcatacttgcgtaattgttttttgacttgggattttaagttgaaaggtgcaacaatttggctaaacttagaaaccactggaatgtttaagaacttaacatttattatatttaaaacttagtatagggtttttaatatttttctcaggaggtttacttgttagaagcaatgtgtttaaaatagaatatagtaaatttataaatgcagtttagtatagtaagtcctcctttgacatcatcaataggtttgtggaagttgcaccttttaagcaaaatgatgtgtaaagaaaccaattttaccataagctaattgatgtaaacaagagttaggttcctaccatatatttctggtcacaaaaacattagcaaacttgtaagtaaagacctaaaatacttccattattaaacattgaaataaatgtgaactatgcaaacattaaagaaagattaataaagacaagagaattatttactcagttattccagtcagagtcactgttggctggatcctgtcctgctcatggcacaaggtgggaaccagccctagacgggacaccattccacctcagggcacagtcacacacacacacacgcacacaaacacacacattcatactaggacagtttaaacacactaattaagctaatgtgcacatctttggatgtgggagggaactggagtacctggagaaaacctatacagatgtgggtagaatgtgtaaactccacacagacagtggccttgtctgggaattgattttttgttcttatcaaagttataacaaaacaatgataacaaaacgatgttattcaaggacctgtaatatatgtaagagaacttagttacccatgtttataacaggattatttagggatatttaattttccagtttgagttggtcagctatttaaagcaccttagaaagtgttaaaatttgctagattataaatagaatgcactttttatggtagaagacaagggaaagtaggtttttatatttttaacttcaagaaatctaacattaaaagtaaagtgactgcagatagtgtttttctgtgtgtgaaggcttatttcatggccactaggaaacttacattaggagactctttataaatgttgttcaataggtgatactagtacaaaaaggaatgtgttttagggtcaaatacatacattagagaaaggacaaaaattggcttttattttctagcagtaaatggaaagaaggaaatgtaatcagccataaatcacagtgtccctaggataaagataaacctgttgcttaggcagccaggagaaacacagttattccttatagtgagaatataacaaaaaaaaaactcatggaactctgtaataaagcaaaacaaaccaaaaagcttatttttatggtaagtacagacttcagtttcaaaaatctatttttaatttttttaaacccattaaatctttaatgtagttcaatggtgtagctctaaactgcaagttagtaaaagcacttctgtacaaggggaaaacaattaatccaaatatgcagttatctaacagtccatcttaactgagaggtaggttttacattttaaactatagattttagatagttacgactctctgttttggatttttttgagagtactactcaatagaattttttgaggtgatgaaaatggtctgtatctgtgatggccagtatggtagccactaggcaaatatggctattgagtatctgaattgcagctaatgcaaatgaggaactggattgagaaaattggattcaggattctgtatttgctctatctaatatggtagcaactagtgttaaaggaaaaattatttgataatacttcctaaagcacaataagacagactttattcaggaccattgcaatagggatagggactgtggcaatgagattttgtagttgaggagagagattgggctcaactccaaatacaaaatgggcaagtgggaatttctagccaaggagtagagtaaggatagatggatggacaattgctaagaggtaacgtcaggaataaggggtattatggtgaaactgacctaccaggattcttgctgaaggcaggccagagtaatcagacttcacctggacagtggaggatgagaaaactgatcagatacggaaggtaatcagatatccaggatcggggtgggggttcctgctacactgaccttaacatgattcttgctgaaactcggttttataaggaagtgaacagattggcataggagaaggttcagcagcctgactaaaatttggctatgcaaataatctttgtgactaggcacatgtagctattttaatgtaaattaatttaattaagtaaaactttaaattcagttttcagtctcactagagacatttcaagtactcacaagacagatggctagtggctaccatattatacaaggcagatataaaacatttttaccattgcagaaagttttattgggcagcattgatagcaatgagtcccaatgcagggtacacattagaattccctgggtagccatgaaaaaattttgatgccaagatctgattataatcaaagatttgatcttgaaatctctgtttaagatctccacttacagtttcttacggaattctaatatgtaactagggttaaaaaccactgacttaggatgtgaaggactctacatcattctgttttccttaatgatatttctctcaatcaaactcttgctgaatttagcaggttattatttatttatttttctttacaagtacttggggcatgcacctattttatgatgcaagttaataaaagaaatgcatgtttaagttttctgccaacctctggatagtattgagaccttaggaaagttgaggtgacttacaatgaaaagttcctaaaaggaagacatgtttgtatgctgagagaaagatgctgaagataaaatgactgtgtggcaaggtccttgtggaataaataaactactggaattatgatcattcttttttcacatgccacaattaagagccattaatattgtggaatatttgcttccagtcttttatacgaaattaatttttaaaataaacctgatatatactatatataaataagtcatatgttgcaaatactgaactttaaaaatcacctctaatccagtcacccagagatactgttaatatttgggtaggcattactgccaagtaatgtacatcacttctatgtgtatgtacatatagaaggatggatgggtggttagaaggagggagtgacagaatgaaagataatacttattcaccacaagaggttaattcctaaggggtgtgtctaaatttaagcaaattctaaaaaaaaaaaaaagaaaaaaaattacagatactgttattacaatcttgtttcagttttaggtgggatatatttaaccatgctttggtatgacattagcagtttcatttctcatttttctcctcctcacatcctaatatttactcattttactatttttacattgtccatgtttgtaacattcatacttagtttttcaaccacttttttataacttattattgttctatattctctagtaaccttttagaatgtcctccttgattctggagtttttgatacaattggcataatttcagtcttatagcactgagtaatgtttcagtagagaagtctcatgcaagccagccagattcttttccatttcccctagtagatgatttgctttttatgcatgaattgttgaataattttttaagctcccaagcataataatttaactaagagtagaaatgggaatagcctgactcatgtgcccacatgtgtctatgtggaataatcttttaggaattacacctttcttctggaatacatgttgatggagcagccactatatggaagatctctggttttgagatagaaaagagagctaagaagtacaattttggctccaaacacttccacctggaagacatatatggttcattgggcaaagcaagttggccatgtctgacatcaataggatggtgaggtatattttatattcctcaacaggaaggaatacaggcttagtaacaataatatagtctatcaccatgactaatttagaaaccattatattagtttgacagatttgaaaactgctggtgttaactgtcacaaatatgaagttatgtagggaagcccatttcttctgtcacttacgcagtctgcaggtctttgatctcttcagaagctctatttgtatgtctctcaaatgtgttgtgcgtgcaaatcaatagtaaatctgtaggtccggactgagcctcagatcttacattcacagtaagcttctgggtgatgtcaatgcagctggtccctggaacacacttttaaatagcaaggctctatagctctttaatatcatggatcttttcacttagaagagagccaactttaaggtctagatggaggaaaaggggcagtaaaaaggaacattaatgggtatgagaccaagaggagtgtgaaatactttcaaataaagggaaagaggaacatgcagaagaagtctcttggatgtttcacagagatcagataaaaaaaaagtggaaaagcccatcaaatttgccatttaatttattcattttagggtggggattgtgaactggggaagagaagatattacaatacattgtggattctgtaggagataatggagtaaagacagtaaaagtagatttctactttcaaaaattcaactgaaaagaagcagaaagatggagtagtatctagaaaaagatagatactagatttgagggaaaattgaggggttttgttttgtttttgttttgatcgtggataaggagtcaatagtgaaatgttgaaaatacaggtttttttccctagtatctcattattgagagaattattagaaaagctacaatcagcaatctgttttttttttagtttagaagatacttttaaagtgtttgaagttttagtatctatattactgtttttgaaaatactgacttgcagctcaatgttttaaatagtcaaactttttatacatagctattatcaatattgtaatattcagttattataggagtcttttattacattaaacctgatctcatagtacgttcattgatgatttccagactttctacagcatacctttccatttctttaccaaaatgatttttttaaaggttttatactgctctgttaattctctgcttgaaagtccttcaggagttctgagtctagtaatagcaagctaggtaattcagactatcctgctgagaacaatttaaaaagctggacacaaagcaaacattttattaagggtatcagaaagctaagtggtatgggtaggataggatctgaatgaggacaaaggtctaaggagggagaactccaatttgattgctttttaccccaggggtagtgttgattcctgaaacaggaactgagagaccaaaaggtgcatttgacaggctgtgggtataatggaaccgggccagagtgcaaggcctgtcacaggggatgggtggccctagtgatctcttctcactttggaccccaaaatgttgtacattagggagaaagataaactgaagtagctaggcctccctaggaagatacttcaacttcaaattatcaaaatttctgtaacttaattaataagatctggtattactagtgtcctcaggcacttgacagaagcaaacattaattctttctggagaattaccagtttctacatgtaaaaatgttttgtcagacgattttgcaaattttatgttctgcacacaaaataggcacatgacaagatatgtgacacaatagagaatagaaacaggcccacggtaactctagatattctagttatcagatttaaaatagctatgttgagaattttgacctgattaagaattttgtagaaagttacaaactatgagaaagaaaaatggatattctagaagtgaaaaatacaacccctctaattaggacctttgtagatggatttagcagcaaattagacaccgcagaggaaagaattccctaactgaaaggtaagtcaaaagggaatgttcagagtaaacaggaaagaggaaaatataggagaaggtaagttcaatacaagatacagtgagaagttctaatatgtatgtacatatacatatgaatcctgaaagtagatgagagatagaatgggcaaaagcattatttaaagagagaatggctggccaacatggggaaaccctgtctctactaaaaatataaaaatcaggcgtggtggtgcgtgcctgtagtcccagctatttgggaggctgaggcacaagaattgcttgaacctggcaggcagaggttatagtgagccaaaattgcacctctgcactccagcctgggtgacagagtgagactctgtctcaaaaaaaaaaaaaaaaaaagaatggctgaaaacgtccaaactaaagaaaaactttaattcagattcaagcatccctatcaacctctagtggaaaccacaccaaaggcaaaaaaaaaaaaaaggaaaaaatagtgtttctaccttcaatcatacagcattaagatggacattgatttctcaacagacacagtaaaaactaaaaaactgggaacctatagatttaaaatgttaaaagaaagtacctgccacctagaattctgtgacctgtgaaatttcccagagatacaataataatcataaatatgagagcaaaactaaatcaaccttgactatcttaaaaataatgttttttaaatacgcatgtattcagcgtgtaaaactgtttcatatatcttggcagtggcagacagtttttaacatccttgcattgtctgggaagaggataaaagtaccagttaatattaggctgtgagcatatgtttattgcagcactattcacaatagcaaagacttggaaccaacccgaatgtccatcagtgatagactggattaagaaaatgtggcacatatacaccgtggaatattatgcagccataaaaaatgatgagttcatgtcctttgcagggacatggatgaagctggaaaccatcattctcagcaaactatcacaaggacagaaaaccaaacactgcatgttctcactcataggtgggaattgaagaacgagaacacttggacacaggaaggggaacatcacacaccagggcctgtcgtggggtggggggaggggggagggatagcattaggagatatacctaattgtaaatgacgagttaatgagtgcagcacaccaacatggcacatggatacatatgtaacaaacctgcatgttgtgcacatgtaccctagaacttaaagtataataataataataataataataataataataataataataaaaggctgtgaggagtcagtaattcagactttttatctctgggatgaccactaaaagaattgtttaaaaaaatgtgtaactttcagatatgtggggaaaaaccggagttaataaatactgaatccaaggaaggcaacaaaggagagaagtctaaaagaacaggtagacagatagaaaatagaacaaatagtgctgggcacagtggctcatgcctgtaattccaacactttgggaggccaaagtgagtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagagagaaaagaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccctcctgccaccttgtaaagaaggtgccttgcttccccctttgctttctgctatgattgtaaatttcctgaggcctctccacccatgcagaactgtgagttagttaaacctctttcctttctaaattacccagtcttgggcaattctttatagcagtgtgagaacagactaatacagtaaattggaactacaaagtggggtactgctataaagatacccaaaaatgtggaagcgactttggaactgggtaacaggcagaggttggaacagtttggagggctcagaagaagacaggaagatgtgggaaagtttggaacttcctagaaacttgtcgaatggctttgaccaaaatgctgatagtgataatggtaaatgaagtccaggctgaggtggtctcagatggagatgaggaatttgttgggaactggaataaagttggctcttgctatgctttacaaagagactggtagcattttgcccctgccctagagatatatagaacgtgagagagatgaaatagggtatctagcagaagaaatttctaagcagcaaagtgttcaagaggtgacctgggtgaccgtaaaatcagtcagttttatggattcacaaagagatggtttggatttgaagcttatgtttaaatgggaagcagagctaaaaagtttggacaacttgcagcctgacaatgcaatagaaaagaaaaacctgtttctgaggagaaattcaagccagctgcagatacttacttaagtaacgaggagacaaatgttaatcaccaagacaatgggtaaaatgtttccagggcatgtcagagaccttcgtggttgcccttcccatcacaggcctggagacttaggaagaaaaaaatggtttcatgggccagacccagggccttgctgttctgtgcagtttcaggacacagtgccctgaatcccagctgtggctaaaaagggccaacatacagcccaggccatttatttagaggatacaagtcctaagccttggcggtttacgtgcggtggtgtgcctgtgggtgcccagaactcatgaattgaggtttgggaacctctgtctagatttcagaggatgtatgcaaacacctggatgtccagacagaagtttgctgtaggggtggagccctcttggagaacctttgctagggcagtgcagaagtgaaatgtggggtcagagcccccacctagagtctctactggggccctgcccagtggagctgtgagaagaggcctaccttcctccagacctcagaatggtaaatccactgacagcttgcactgtgcacctggaaaagttgtaggcactcaatgccagctagcgaaagcagctgggagaggggctgtaccctgccaagccacaggggtggaactgctcaaggccatgggagctcacctcttgcatcagtgtgacctggatgtgagacatggagtcaaaggagattattttgaaactttaagatttaatgactgccctgccagattttggacttgcgtgggacctgtagtccctttggtttgcctaatttctaccatttggaacagagacatttacccaatgtctgtacccacattgtgtcttggaagtaactaacttgcttttgattttacaggcttataggcagaaggaacttgccttgtctcgggtaagactttggacttggattttagggttaatgctggagtgaattaagactttgggagactgttgggaaggcatgattggctttgaaatgtgaaagggacatgaaatttgggaggggccaggggcagaatgatatggtttggctttgtgtccccacccaaatctcatcttgaaatattatccccatactctccctgagttaagggagaaaccaggtggaggtaattggatcatgggggtggtttccctaatgctgttcttgtgatagtgagttctcatgagatgtgatggttttataagtgtttggtagttcctcctgagttcattcttcctcatgctgccttgtgaaaaaggtgcctggttcccctttgccttccgctatgacttaagctgaggcctccccagccatgtggaactgtcagtcaattaaacctctttcctttctaaattatccagtcttgagcagttctttatagcagtgtgagaacagactaatacataaggatacagaaatgttgagagtagaaagaaaaagcagaaactaatgaaaagagaattggtacattaatattagacaaagaatactttatggaaacagtattctgagaaaaagtttaattttccaggaagatataattttcgatttgtatgagcctaataacatggtcccaatgtataaaaagcaaagtagggagacctactgggaaccaaataacccataatttagagtgagagatattaacaacctccattggtaacagaataatcagacaaaaacaaatcaatacaaatatacagaatttgactaacacagtccacaaacttgacctcatggatatgtaaatacatgtgtgtgcatgtatgcatacacatatataaaacactaaaccctgcagtgcagagtatacattattttcaagcatatatggggcatttacaaaatttatacatcttataagtttccctcttaacactatcttagctgtgtcccagagattctggtatgttatatctttgttcttattagttgcaaagaacttcttgatttctgccttaatttcattatttacccaaaagtcattcaggagcagattattcagtttccatgtaattgtatagttttgagtgaatttcttagtctaatttttctaatttgattttgctgtggtccaagagactgtttgctatgattttagtccttttgcatttgttgaggagtgttttacttctgaatacgtgatcagttttagagtatgtgccatgtgacaatgtatattctgttgtttttgggtggagagttctgtagagattaggtccatttgctccagtgctgagttctggtcttaaatatctttgttaattttctgtctcagtgatctgtctaatattgtcagtggggtgttaaagtctctgagtattatcgtttgggagtataagtctctttgtaggtctctaagaacttgctttatgaatctgagtgctcctgtgttgtgtgcatatatatatctaggatagttagatcttacgaattgaaccctttagcattatgtaatgcccttctttgtcttttttgatctttgttggtttaaagtcttagtttaaaactagatttaaatcctagttttgtcagaaactagaattgcaacctctgcttttttctgttttccatttgattggcggatttttctgcgtacctttattttgagcctatgtctgtcattgcatgtgagatggatctcttgaaggcagcatatcaatgttcttggtgtcttatccagcttgccactccgtcttttcattgggacatttagcccacttacatttaaggttagtattgttatgtgtggattttatcctgtcatgatgttagctggttattttgcaggcttgtgtatgtgatggttttataatgtccctggtctgtgtacttcattgtgtttttgtagtgtctggtaatggtctttcctttccatattttagggttcttttaaggcagttctgatgctaaccagtactcttggcatttgctcttatggaaaggatcttatttctccttcccttatatagcttagtttggccagatgtgaaattctgggttggaattttttttaagaatgatgaatattggccctcaatctcttctggcttgtagggtttcagctgagaggtctgctgttagtctgatggacttccctttgtaggtgacctggcctttttctctagctgctctcaaatgttgtgattatttgattgtactttcatattgatggaagaaaacaaatagtttattttatgtgctttggtatttagatctgtgaataaacattttaatattaattattaaaatttagaactgtttttataatatgtaattattgcataatattttataatttttaattagtaaagagaatattttccatttgtttttcaaactttaaagtgtagaaagttagtacattagttttcttgccctgaactgcattctgtggtgagcttttgaaaattacagagcaattgcaaacttgcaaacatgtttaatgaattattgggatattatgaaacacagatcgaaaagctattaggcaaagtaaatacaaactaacggttactcctaaaatcaattaaggaagggtatattattagttaaaggtaatctgtaattgtatattgcattgcttgagaagtttaaattgcaagtttaatttgctattcaaagaaatcatttaaaaattatttaaaacataaattattcaaaaataaatcgaattttattttaatacattttcagttgtttaaaataaaaataaattctttaaaacttattttatcttaaaatagttttaatgtttgcattttctcattagagaagcaaatttaaatataaactattcagtgtagaagaattagaatactttgataagcaaaaataatattctttataaaaattctaccatattgcattgccaccaggaatgcagaagaatatctcatttcctactgtcaaacagtatgtgaccaaacttcttttgagtttttaccaacccgataggtgtgaaatgatatttcagtatagtttaaatttgcatttatctaattatgagtgagattgaacaacattattacatgtttaaggacatttttacatcctcttgtgaattgtctgattatatcttttgtgcatattttcacctgcattattttttccctagtttttaagagttctttaaatatttaggatacaaaagtagaatatgtgtatgtatgcgcacgcgtgtgtgtgtgtgtgtatctctgcatactatttttcctagagttgtaatggatgaaccataattctttctctacttttctttatggaaaattaatggcagttcataatagttttggtagttcaaagtatagttcaagttgttgcttcagaacattactttattagatgcttgccatgtgtcaggcccctagttaggcactgaggaggctttgtggaagaaaggcaatgttttggaggttacaatttagtggaagggatttaaacccaaatattaacttaacactgtgtcagatgctgtgaaggagacataaagatgctatgtgactaataacagggacttgggttagctgggtgatcaggaaggttttaggatagttttttaaagcattgcagaggtaattgtcctttttggggattttgatattattattattttttagtgcttgtttagaaccattcacccgacagctgagatgattaggtcaacataaactcttgtatggtcaaaatgccatttaagtttagatagagggagaacaatgaaatagatattttctagattatatggtcttaggttgaaccataaattttctttgaaaactatagtttttaattttggtaaattttgagggtaaagtaaatgtagcattttgccatgtttactatcttatttaattttgtgatttatttagttttttagatttcattttaataatttttatgtttaggtaggagtggtgttttattaattcagtgttgttattacatgaagtatagatgaaaaggttaacactaatacaaaatttaaagggaagcagtttcgctaatcttgatgataatgaaacattcaaggaagtcttgataagcaaatgaaaaatattaataattggcattcaatctgaaagtaaatgttcaaatgtatgtttctatatgaaagcacaccttgatttacttcatggcatgttaatatgaaagttcataatttaatcccatagagaagactatttttcattatgacttgtagaaaaattttttcctgtgagaactaatgttacaatttcttatttggaaaataatgatatatatcttgaaagatgtattttaaaaatatataatgtatcttaaaatgtgttggtattataatcaggttaaatctgttgaaataaattgtaatttagtttttaatgacttcctttctgttgacaattatgttttgcgttgacttgcaattattctattggttcatactagttaagttcctaaagcaagcaagtaggaagttcagttccttttttttgacagttgcttgatttttacagcagagcatcccagggagtaagctgtattactagtaaattagacatctgcccaaagagctctattcagtagtccttgacattactctgaaagaaagatgaatttaataggaattttgcctttttttcccagacactggccaaaagaagaccctagacaagaaagatggaagacgaatgtcttttcagaaacctaaagggactattgagtatactgtaagttatttgctttcgaaaaagctatttttctttgtaagagtcttctttaagacattctctgtttatactataaataagacaagcattgttaattgccttatttttaaaaatctgtatttcactttggataattgttttattttttagttgttgtttttttctttaaagagaaattttactgagatataaaggtagttatcctagaaaatttaatttaatatagatgatagtttactgagagagttcccatgggccaataatttttattaggttaggcttttaggaaaatttttagttctttagaaatgtgatcttcattatattcgcagcagtgctagtgatagttataatggcagatgggatacataaaagaaaagttgatattaatcttccagtataaccttccacattaaatcatttgtatttatttatagctaactccctttagctctaaacattgagcttttttttttttttctgtattcttgaaatgaacttcaaatcttcctgcagtcagctggcttttcacatttctggttactctgggaaactgaagtgagaaatcagctttggtatatggtatgctgcatatttgattgaatgtaaagattgtttatttggataatgttaacgtgttgtaaagcacttttaactgagcttaattttgttattctgtgtttttctaacataactgtattaaggagaacagcaattttaaacattaatttagcatttgtatcattatgaaaccgtccagtcttggtttgactcttattttccatgcatctttaaaattgaacaaattatcaaaattctaatttatactctattttgatataccattcatatatagcggacagtgtgagattttaaatatttttaaaaggaatcagataatttaggatgaaataaaatttactaatatcaagataatctcacagcatattttaaactcaaattgcgtgtgtttgtaccttctctgcataattgagaaaataagttcaaataagttttttataggtaacctttaaaatttcttcgtctttacaattctgcagtgccaatatgaaaaatttagatatatacatgtttttatcatgtttattgtgtttcttcagcctaagaaatcatgtcactcataaattctagaaaaattcttggtaattatctttgattgccattttctcctccttcctctattttgtttctccagaactctaattttttattgaaactaattgtactacattttgctatcattatgctttgttgaccttgctattattttgattgtatcttctgtctgctttgctgggtgtttgcctcttcttaattcccaatgtgagtggtcccttgtttctttttgcttttctattgacattctattacttggagtgcttaagaactttataaactacgtggagtgagacccaaactttttttctatccctccctttctagttgcttgcatttcctactatcacttcatactaaacaaattatggaagcctcttaccaattcttcttcctccatccttccacaattcctgattttctcatttccgttccctttcagtttgttattcattcaggttgcagtctttagagtcagcatcagtttgctcattcacatttgcttccctgacctactgctactgctgtcaccacaactccattcaatccatgaatgtcttctcttgagtcttagttgaaatcttgtaccttaatttctttctttacatttttattactttaaaccttatctttgtttttctgcatcctttctctttcttgttccagtaatcctagccctgatgccagtaatatgagatgccacttgggctgttttgttaccttcatcatctcatttaatagaatcactgtgagaataaaatgtgttattattaattatgaaagtacttggtaaacttacagattttactgcaaaatatcatttgtttacagagaccttttatatatattatctcggtaacataggttttatatcagtacattgtgtagatggggaagtttgcatagaaggatgtaggcagaactagattattattgtattaacccaaatatttggcataaatttggttttataaaaccattaaggaaaatatgtatattattgttttacatacacaaacaaatgcacacgcacctgcttttcctgacttttgaaatcttctataacctaattctaaatgcctctttttttattttattttattttgttttctggagacagggtcttgctttgtcgcccaggctggggtgcagtggtgctatcacagctcactgcagcctcaacttcccaggctcaagtgatcctcccacctcagcttcctgagtagctgggactacaggcatgcatcaccacgcccagctaatttttgtattttttgtcaagatgggattttgccatgttgtccaagctggtcttggactcctgggctcaagtgatccacctgcctcagccttccaaaatgctggaattacaggcatgacccaccatgtctgacctctgaatgcctctttatcgtttttagagacttaactccatgtaatcaccttcccaaaaatttgtgcttcatgagtctactctggatggtttaggaggaagaggacagtatcccacaaatatgttatgcttttctgtctcttaactatgtcagttctgttatcttcactttgaaagttcattcctttctctctacttttcaaattcccaacccttcttcaaggcccagctttaaatcatttcttttctgtagtcttttctggaaaatttggattacatggtgcttttattcatactcaaaacttctattgcattcattattccattttaaattgttcatcttttgcataaccttttctatcttagtttccaactagattgtaaattccttgtgcaaaatgacttttagttgcacttatttgtgttttcttcagagctctctctttttttttttttttttttttgagacagagtctcgccctgtcgcccagactggagtgcagtggcgcaatctcggctcactgcaagctcggcctcctgggttcacgccattctcctgcctcagcctcccgagtagctgggactacaggcgccgccaccacactctgctcatttttttttttttttaatagagacggggtttcaccgtgttagccaggatgttctcgatctcctgacctcgtgatccacctgcctcggcctctcaaagtgctgggattacaggtgtgagccaccgtgcccggccttctttagagcgctcttaatgccttgtgtaatggggactttaagtggttatattatattggccaagtgacattttcttttagggtaattgatgaaatctcattatttatgatttctacacatatgatcatggaaacgtacgaatgattcagaactaaataactcaactttagttcaaatatttttctaatttatatgtgcaatgacagaatatatgcataaagatcattttgagtttaatacaggtgtactttgcaaaaatgaaattagtatgttgctagaagtcacatatattttagaaactattcaaaggaatagtgtattattttaaaacctttgtaaaatgaaaataatcagtttttgacttttaaattatgttttgtattttgaaattacttgaagtagagacctacatgtaaatgtattgtgatgaagcctttactctgtattgtaatagattaagagcatttgctaacaaaacacagtgtttcttgacagttattttcaaagatgacaataccagttgttaatcaaatgtaagctggtccctagatatattaatgctcattaaatattatagtttagtttttctgttttaaacattgaaataatttattttttcttttaaacaggttgaatcaagggattctttgaatagcatagccctgaagtttgatacaacacctaacgaacttgttcaattaaataagttattctcccgagcagttgttactggacaggtagtatcttttttttaatgtgctgatgtttagaaacattaaacagaaaggcagaaagtatttattgtactgtagttaataatatagaaaatttgagaataattttatatgtgcttttaacaaatcatattggccatgtaagagaaaattaactgttttatgtctgtattagtttcttttttaatacatattgaaaataattgtagatttttctttttaaatatagttacaaagagctttttaaaatattcagaacaatatatgcatatgataaaaaattactttatcaaagtaaggcatccctccatctcaaactttcagtttcttttccagaagcaaccagttggcagtttgcatttctttcaggaataatctagcctacttttgttgttgttgttgtgttttaatttaactttgattcttggaaagtgttgtatttaatcacagttctagttcagactttttcacgcgtgcatggtattacattgtattgatatatcatacttatttaaagcattagactatttctactcttttgctaaggtcaatagtgctgtagtaaacatgcctgtacacatctgtttttctttaaatgtaagtatttctgtagggtgaattcttagaagtaaagttactatatcagaggatatgtgcactttaaattttgctagctattgccaaattgtcctttaggagtgacacctctatagtgtatgacaattaatgtttcctcaccctattccagccgtatatattatcaaatgtgtctaaactgattttaaaggttcttttttaaaaatgtttttatattcttataatttgaaaatttttatgtttttctgtttaattggtaattgttaatagtgcttgcttatagaacaccatctaattattaacacttcattttaactaaatctttgtgtgaatgttttcttacaggttctgtatgttcctgatcctgaatatgtctccagtgttgagagctctccatctctaagccccgtaagtcctctgtcaccaacatcatctgaggctgaatttgataagaccactgtaagtatctctgctttgcaaagatggcgatgaagaaatctcactttgtctacattgactgtcttgttttttacattccattttgactatggttagaatgaaatatttcctttttattttgttgcttaagtttgtaaatcccagctttaaaaataagacattcttatgaaaccatatagcttaaattgacttacctttgtaggtggtggttgtgggccaaaaatattcatcaactcttattttttaaagaacatatataatttaacttacaaaggaatcttacccaaaaaacatgacattatcacagtagaggaagttcatgtccaatttgatgtttatttcatctataaataaatgagtatatagtacttagaactcttgagtttaattttgacacattgccttttaaaaaataatttatcatcttagtcatccaagaattgacatagtagattaatttatctagcatttctaaggaatgagtgttctaataacttacattttacaaatgaacttcagggaactaaacttcatttaataattttgattaaaatcttctgaaaggaattatatattatatatttctttgcctttcatagaataaattacatgatattattaataactatttttctccttgcctgggaacttttttctgcatgtgtgtgtgtttgtgtgtgtgagaaagagagagagaaatgaggcctttttcatttatttgatggatatcttctttatataattatggcaatactatgctttagaatgcagtcacatgaaaggaatatattacatttgttgtcatcattgataagaataaaagtcaggttttaatggtaggtattacttaccaaatgacacaatacctttttgaacatagccatgccattttcccatgggacttacaaagagatgtactcataaggggcaatgacaaagtaactacgtagccttaggttaatttagcctgtgtttcaaaccctaaagcagaatgatgaaaatctaagctgtagcatcatgcctgactagaaacctgtggggtctcttcctgttcctcggctttaacctaaatctgcctgtctactggctttcttggaaggtataagatcaaagaaaacaaaatgttgaaagttaagggagcaacaaggccaggcctcaacctgtgtgaaaatgtaccccttcttacttttgccatttgactgaaagagatggagaggataaagttatgtgaatgatcttttaatcctcagtgacttagctactgtcaaagatggaccaaaaaacttcctgtaatttggccagtgatatgagtaaattctttgtccctgggatagattaaaaaaaaaaaaaagaggtgagagattccttaaagaactaaaagtacacctaccatttgatccagcaatctcactactaggtatctaccccgaggaaaagaagtcattatataaaaaagatacttgcacatgcgtatatagcagcataatttgcaattgcaaaaatagggaaccaccccaaatgcccatcaatcaacaagtggataaggaaaatgtggtatatatataccgtggaatactactcagtcataaaaaggaatgaaagaatggcatttgcagcaacctggatggaattggagactcttattctaagtgaagtaactcaggaatggaaaactaaacatcgcacgtactcacccataagtgggagctaagctatgaggatgcaaaggcataagaatgatatagtggactttggggactcaggcaaaagggtgggagcagggtgagaagtaaaggattacacattgggtacagtgtacactgcttaggtgatgggtgcaccaaaatctcagaaatcaccactaaagaacttactcctgtaaccagacacacctgctccctgaaaacatattgaaatggaaaataattaaaaaaaaaaaaaaaagaggtaagagaagagtttgtaaacttctctttacatggaatgatactctttacctgccatcaaagagattatgggcaatagttagaaataattcttacaacagttgattgtgtaaattttagttgtattttttttacctaggattatattcattaccaggctccaggataatatttctatgactttctgcatatctcaagtgcctatatttctatatttctaattattgggttttatgtctcccatgctgtataaatcccttagaaataaggatattatgttttattagatatagtttacattttcattacactaattaaaataatgtctattagtattgttattatatgtttttcccagaaattgtcagtttatattaccagcaaccactgataaattttttgaatgtccagcttagtagtggtttactatgaagctaaaaatatgttcctggctttgtcggcataaagactttcattggtaataattcgttttcacttaaaaatattgcattttgagaatttccatggaaaactattttttctttatttttcacttttttttgttcacatatggaggaagaaatatagaaggagatagaaccaaagtaatggtaaaaatcataaaaatagctaaaatgtagtattgcaacaggtataattctaagcactttaaaagtattatttatttcttatctcaaatttatgaggtaggcacttggcctgggtttctgtgtttgtccctccagacttactctgtattctctagtgtcctttgggtggtagactgcatcagtgcactctctcttgcccttttgcttctgttggtggttttctttctggagcagttgcagaagataagggggaaggaaagagagaataagatggggacatatttattctcctagctccttccctgtaaggttactccagagtgaccacattcttcagcatctcatcttatcttttgtcagccctttccacagagccatctctaaatttaggtatctgtttctcccccttacctctttagggatagaggagtcttctgttattgttcaccctgggtttttgtacaccatatgtacctttgtaaatagttccataattaaatcctcttaaaattattcagtttctaccgggcatagtggctcacgctggtaatcccagcactttgggaggccgaggcaggcagatcacttgaggtcaggagttcaagattagagcggccaacatggtgaaacccatctttactaaaaatacaaaaattagccgggtgtggtggcgggcacttgtaattccagccactcaggaggctgaggtgggagaatcacgtgaacccaggagtcgggggttgcagtgagccacgccactgcccttcagcctgggttacagagtgagactctgtctcaaaaaaaaaaaaaagctcagtttgatgtgccatctgttttttctagtacctgaccaataagtattgtatccattttatagaggaggaaacagaggaagagaagttaattattttgtgtttaaggtcactcagctagtagctaagctaagattctaacccagatgggcttggttcggagcccatattttttattactactttatagctggaaaatgataactcagaaacactactcttgcccaataaataattggacccaaagagttaagtaatatttaatcattataaaagtcgatatagtaatagctaccatttcgcactatcatcttcctaagattctttaaatctctcattttttgaataaatatagaaacctgcttttgttttgtacacctttggtttttctcctttgtactgtaagttcacccattatgctaatgccattttagggtaaaactgttaatgtgttatattcaggatgaagttcagtggaaaaatgtttaaaataagtaatatgaaaaaacgaaataattttaaagtacttatgtttatattaatatactctattgaagggtgggatatgcagatagtcatattctctttaagataaaacatggtataatactctaatcaatctaaaatatgataaaaatagaatattaataacacttgaattggatacacatgatgataagacaatataattttgaaaaaaaaatacttttaagagattctgaggaaggcctaggaagtcctaaaggaggaaagaggaaaaagtataaaatagcaatagaatgtaggcatattaaatcttcctttttaaggataggctgtgattatactgctacagtagctattgtttttttacttaaagagtgcttactatgtatttactgtgttcatttcagaattttaatctttaacactttaataacattttaattactttagacttttaattaatctttaaccccatgaggtaggtacaataatcatgatctgtatttttaaaaatgaggaaagtaaggcatagagagaagaatgatggttagtaagtggtagaactgagactgaaaacctggcagtcaaggtctagattctgtgttgtgttcttaactactttttgtactgcctaagtaatgaaatgatgactactagcaagtgcaggtactctataactgagacatatgatctaaattaaatatatgtgtcacaatttataggaactaggaagtttgtagtaaagaactgtgtggaagtaatgcatgaaatttttgcttggccaaagcaaaaataaaaatgtagaagatttagaaatgttctttaattacctatattagtttcctagtattatcataacaaagggtgacaaattgggtgggttacaacaaaagaaatttattaccatacagttttggaggctggaagtctgaattcagactattggtacgaccatgctccttttgaaacttgtagaggagaatcatttcttgcctcttctaactggtgtttgccaagtatcattggcattccttatcttgtaaatatatcaccactttctgccttccttgtgacaagtggccatctacttcctgtatgtatgtcttcacatggtggtctcttctttatataaggaaaacagtcagattaagggcccaccctactcatgtatgaccttaccttaaattaataattacatctgaaaaatcctattttcaaataaggtcacattctgagatactggaggttagggctttaacattatcattttgggggagacagtcaaaccataacattgcctcataaaattataattatagagaatttatattatggagctttatttatattctagaattttatattttttgtctttgaaggaaaggggaaatttagaaaactttctaattctagtcaagtaagattttctaagagatgtttagttaattttcttcatttaagatatgttgaagggttaagttaatttctcatagggttttgggaagcttgtgaatatttgtaaaatattgtgaaaacttttttaaaaacgtctcttttttaatcatgatagtcacataattaattggcatcttgaagtggtatgcctgtatacctgaaaatagacattaattacaagtaatagcagacatgcaagaaattaaaacaattttagttaggaatatcaaagtagtttgaaaaggttaaatatcgcctgtgcttcaggaattgctttcacatatgacatcctttaacaattcacaaacataacctctcttttctctctgtgcatatatagaatatatattttttaacttaaaattaaagacactaatatctatcatatacaatattatatgttatatataaaacatgttttatctcttttatagaatatataaatcgtaattttttctaaattatgattttaacttcaatgcttttagacttcaatgttaatataaatatatacaacttatgtgatatataacttatatattaaatgtaagcttatgtattataataaaactataaatatcaataccactcaaatgtgtaaataacacataaatcatatatactacattcatattattacatataatttagctttgatgcttttaaacctattttaaataacaacttagtaaggaattgttttttaatatgtactttttaatagattatactgtaattatacctcggtcttatattcttagaacaaaattttatggttagtatctgaaaaattaaactttataataggacttagtgtttgcgaagattttaggaaacaaatattttatatagaagaaatccctgtatttttaacatcacaagaaatgggtaaattactagatgagagtttttttttttttcctagattccagatggaaacattatttccataattagaattaaaaattgatcccgatattttaattttattattttattctgtatttgattttaaacattcttaagttcttggtcccaggaagtagagattattgaacataatttatagacagtaaatggcaatcatcgtatatattggattgaaagaaaaatacagcatacactgcttcaaaagtaaatgttttctttaaaggatatatagtatatacgttgcatgaagtaaatacaaatgttggtatttctgtgcctgtatggattttcctcctcaatcttcctttgccctacctatgtgttactagagaacatttctacaaattttcaatcgcaaaagaggaaaaatacaataaagccaaggcaagaagggaagtggacagtttggagttgctaattcatttatggtaatggtttataataacatacaaatcatattgtataatatattctacaaaaaaagataactctaggtgattattaaactttttgtaaatcatttgccctagcaatgctttgcttttttacatttgaatatttggggcaataatgaggctagatagatagatatagatgtttatatttctatatttttaaggaccttctctggtggctaaaacaaaattatgcagggaagcatcagcaagccatcaaatgagctgcaaaaccacctcattaataatcacagtttaaaaatagcattcaaaaccatctacatagagatactaatactttgaatagtgtacatttatgtaagttacggtgaggtctggtaattcctctgaacaactttgatcttttttgaaagtaatctccttttttgtgctttgctttgagcatttgctaatctcatattctttttaaaagaattacattgacaaattggtattgctatagatactgagttcagactttcaggtaacctcagagatcatatattgttcaaaaaggcatatcttcatttaaggaaagcatatgacaatgtgcacatatatatacatatatatatatatatatatatacacacacatatatttatatttgtgtgtgactaatgcggttaactcagttttgggggaattgaggaatcacaaaatttgttgatagctttttgccagtttgcaggggaccctcttatagctctgcatcagctatttttttcttagcatatttttgagttgtttggtagaagatttgaaagggaagcgatacaatattacagttaagctcactggtttgtgtgttgataacataggtttgcatcttagctccttactcatttgtcaagttattgaacttggctaagcttaagttcaacaaaaaaaaaccaagaagcgtatatatgtgtgtgtgtgtctatatatatacacacacacacacacacatatatatatacacatatatatataactatacctctagtttgtttttaaaaaatgttttaataccatgttgtttccatttgtttttccttataattctctattttattttgaccattccaaaacattctgagaagctggttcataggcttcactgtaagaatggtcagtagcaccaaaaaagttaagaaacttgtgatctagtggaatgggatttatcaactgtagctcgagatttaaaaggctattccagtgaatgggttctgctgtatgcttaggtactaaggtaagctttccacctttttactgctcccagcacctgatggatattatattatatggtcttatcagagtcagtggtttaattcaggagcatctgagtgtgtgtgcacgtgtgtgtatgtgttgggtgtgggtacaagagatgtagtgttcactgttctccagattattttattttttaaatttatagatatgtgtatctccctattaaaaatcactataaatgtaagtttaacctgtgtttgtgatctttattgaatatgaaaatagtgccacttttgtcctataatttgtacgtaaaaatatttcgggctgacttccagaatgcggtgaaatgaaacaacacttattggggaaagctattcatttgactttttaatagtgtgctcatttttattttgttttctgcttttttttttctttcctttaaaaaaaaaaaaaagaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaaggtaaagaatgacactttagagaagacctttaatcatgctttagttattactaatgtatgatagtttggcatttacattttaagtcatcaatgtcagaaaatgcttgaatattatagaaaggtactagtgatactattattttgggttagtatggatgttgcttataacttagagtctggtgatctgttgtaattgttaaaagtaatggaatataaataaattcactaaggcacagctaagttgctgttggtaggatatttcaaaagtgtgaataaaatgactgctgccaggtactgtgtggagtgtgaacttctgtataactagtatagcacacaaataggaagatatctagtatttattgagtaccttctatatgccagagagtatttgaggtatcttaattattttatcaattcaaaacaatcttgtgaaataggcagtcatatttcttttccacagggaaaaacaaaacaggaagggttcataggaaaggttaataggtccaagatctctctataatggccagaattcaaacctagtcagaatcttttttttttttttttttttttgagatgaagtttcgctcttatcagccaggctggagtgcaatggcgtgatctcggctcactgcaacctctgcctcctgggttcaagcaattctcctgcctgagcctcctgagtagctgggattataggcactcgccaccacatctggctaactttttgtatttttagtagagacagggtttcaccatgttggtcaggctggtcttaaactcctaacctcaggtgatccacttgcctcggcctcccaaagtgctgggattacaggtgtgagccaccgcacccagcccagaatctattttgtctgcttcactttgttgcttttctaagcaaaaacttctaatctgaaaagagaatatagtaaagtaatagagttggaaaataaactccagattttgctcaaaaaatgtctataacatgatactgcctttagaattcacacatgagaactatttctttgaagtataattcataaatttatgagtatttgaaacacataataagcatttagtggtatgcattttgccctaaatattgttttaaatgttgtgttttcattttcatttactttaaaatattttctcttgatttcttctttgacccatttgagagtgttttatttttctagataactgtcttttactaatttctaattcgattctgtgtgatcagagaacacactactatttgaaggctttatttagacctgttttatggtctagaatatcgtatgttttaataaatgtaatgtgtgcactgtaagagacacattatatttgtgttgggtggaatattccacaagtgtcaatcaaatcaaattgagtgatagtgtcctgtatttctgattttctgtctgtcagttgttgatagaagaattttgaactatctcactgttattgtggatttatctgtttttgcctttcagttttatttatctgtttttgccatacattatatatttatatatatatttatatatatatttaatatatataaatatatttttatatatatttgatatataaatatatttatatatatatttgatatataaatatgtttttatatatatttgatatataaatatgtttatatatatttgatatataaatatgtttatatatatttgatatataaatgtttatatatatttgatatataaatatatgtttatatatatttgatatataaatatatgtttatatatatttgatatataaatatatgtttatatatttaatatataaatatatgtttatatatttaatatataaatatatttttatatatttatatatatatttatatattaatatatatatttaatagataaatacatatatatttaatagataaatacatatatatttaatagataaatacatttatatatataatatatatatttaatatataaatacatttatatataatatatatatttaatagataaatatatttatctatttacatatttatatatatttatatatatataaatataaaatatttatatatatttacatgtatattataatatatatctttaatatgtcacattctcactttaagtagcattatatatgccactttacatatagtacacacaccttacaacagtatacttttatttcccccttccagcctttgtgttcttatcgtaacacctcttatttctacatgttataaacacaattcattgttattatttttgctttaaaaagttaatttaaaataatttttaaaataagggtaaagtctattatatttatccacttacttattccctacacttgtcattccttttttatagttgcagatttccatttgtatcatttttccttttatataaggacttctaaatttcttacagtgtaggtcagctagtgataaattctttcagtgtttatttgccttgaaaaagtctgtttttccttattttattaaatgttactatcatgtttatgtatattttcttttttttttttttctccgagacagagtctcactctgttgcccaggctggagtgcggtggcctgatctcagctcactgcaacttccgcctcccaggttcaagcaattctcctgcctcagcctcctgagtagctgggactacaggcacatgccaccacgtctggctaatttttgtatttttttagtagagagggggttttaccatgttggccaggctggtctcgaactgctgacctcgtgatccgcctgcttcagcctcccaaagtgctggggttacaggcgtgagctaccgcacccggcacgtttatgtacattttcaaaattatatgtgtgtttataaaaaaggatccctaacttttaaattttatgccactttatctttttttggtccattgaattttttttaattaatatactttcatttttagagcagttttaaatggacggaagaattgagcagaaattagaattcatatttatactctccccctttccccagtttcccttattaacatcttgcttttgtgtgctatatttgtttcaatcaatgaagcagtattcaggcaccaaggaaagcccataagattctctcttgtacattctgtgggctataacaaatgtatagtgacatttatctatcattacagtattaccagattagtttcattgggctgaaaatcctctatgcaccacctgttcatccctccttccctttctttccctgaactcctgataattaatggtcgtcttactctctctgtagttttgcctttttttagagtgtcatatagttggaatcatagagtatgattgaatgaattcatattggcttctttcacttagcaatgtgtgtttaagattcctccatgtcttttgcggattgacaccttaattctttttactaatattactgaatattccactgagtggatgtactgtagtttatccattccactattaaatgacatcttgatcactcttaagttttggcacttgtaaatgaagctactttaaacattcatgtgcaggttttgtgtggtaagttttcatctcaggtaaaatatcaagaatcatgattactggatggtatggtaagaccattgttagcttagtaagaaactgaagaactctcctccaaaggacctgtgctattttgtatccaataagcaatgggaatccctattccacagcctcaccagcatttgatgttttcagtgttttagacttcagccgttctaatagatccgtagtggtaatatctcactgtgttaattagaaattctctaatggcatattatattaagcgtcttttttttttcctattcagaaatgacaaattctttaaatcgacaaactcatcttcctcaagccccagaccatggtaggcagccctccctctccgtcccctcaccccaccccttagccacagtgaagggaatggaaaatgagaagccatgagggcctctgccagggaaggctgccccagatgtgtggtgagcacagtcagtgcagctgtggctggggcagcagctgccacaggctcctccctataaattaagttcctgcagccacagctgtgggagaagcatacttgtagaagcaaggccagtccagcatcagaaggcagaggcagcatcactgactcccagccatggaatgaacggagggcacagagctcagagacagaacaggccagggggaaaaaggagagacagaacaggccagggcatggcggtgagggactgaggcccctaaattttgatcccaggggaaaagaagaggccagttggtccagttttgatgggtatggggaagggaatgtattagtaagcacgggggagaggctgccaacaggcacctcagaggtgataggacaggctgaacccctcaccctgacagaagggagcttaagagctctggggctctctgggaatgtcactgctaaaatatatatctacatgtatattaaccactcgtgggagggcaggggcaaggcctggggtgggatcaaaggatctggtgtggcatccagtagccagtcatgcctgcctgagatgccccccatctgtagcccgatcacgttcttgccctcttgcagctggttatccgagaagttccgaggattctccttggatttcttagggaaccagttgggatccccagagaagagcccatcatcccaggctactgccaacccacccagattcctcagcgtccgctgcacacaggccatgttctttccttcccagaggtccacagtttggaagatgtcagtggtgttaatgccatagcgctcagctgcttgcaggaactgagagatcttctccatctgcttgaaggccatggtggaggcctggatcttctttactgggacctgccccttggggtacagtgcattattgagctcacataacaccgtgccatccttgagccagttctggaagttctcgcgtccaggctgggaccggcccacatcctttcggcactgggtggtgatccactggatcaggatctgctccagatctgcatcatactgtttctcaatcttctgctgcacctcctggctcaggccataatgcaggtcccctgttggccattccaatgggtggcggtggctgcggggagcgttcaaacgggctggagagcggcacactcactcaaggcaatggctgcagctgccgagcttcttcttacatgcttattttctacccagatatcctcttcattttcaaaggatattttcactagacagaattttcagttgatgaggttttatttcttttcagaactttaaaaatttactccattgttttctggcttgtgtttttctaaagtgaagtcttgcattatttttatgtttggtgttctgttaaaaaatgtgtctatctttggttgcacttaagatgttctatttatcactgattttgagcaattttattaggatgtgccctggtatatttttttctatttgttttgctgggggttcctttagcttggttctgtaggtttatagttcatgccaaatttggaaaatatttgaccagatttcttccaatattttttgcctcccatcctctctttcctcttctttgggaactccaattctgcatattttaggctacttaacattgggtctcacagctccctcatactccattcacttttttccttctcttttcattttggataattttaattgcttgtttttaaattcaccaattttttttctgccatggctaatctactcttaatcctatccagcatatttcatctcacacattgcaatttttctccctgtaagttcatactgggtcccttatattttccatatccatactgtgtataatcttctatattgttgaatatggttataataattgttttaacgtctttttttttgtactctgttacttctgggtctgtttgcgtttattgatttttctctttaatgtggttcatttttttctgtttatttacatgcctggtaatttttgattggctaccagacatcatgaattttatgtaattggatactgaatatttttgtattcctacatatattcttgcactttttatctgggacacagttatttcttgatcctattgtggcttttatttctttgatgatcacttggtaatggcttgttcataagttttgttaggaccagaatagcctttagtgtgtagctaatttttctccttactaagacaataatacacttgtaagtattctgaggctttgtaaatacaagatttttttttgctttaatgtttagtgagaacacgaactattcttactgtgtgggcgctgactattgattcttctgctcctttcaagtactctcttcttatcgttggatagctgcgatacatgtaggtggtaatcagtactcagttcaaagctggaagggaaccctttgtagacctctaaagctttctcactggacagtgctcatttctgggttgtttgtttgttttgcttgttttttctctgcctgtggactggaaactttctccactcagtatgcttcggtaatcaaagagctgatcttatgtgtttctccttattcaggtatcattgcctagcattccggtgtctgaaaatattatgtcacatattttgttcgtgtaagtttggtgtgtgtatgcatgtgtgtgtttattgtagttttaggcagcattagttcttgactagaagcagaagttcatttgatatctgaataaaaattttatttaaagatcaaagcaaagataaggtcattggcaggattaggaatgatctgcagcctagtgtttttggaacgtaatcccttgttataggctggctctgtgcattctgctgcacaaaaggagataagcaggaagtggtgctttctcatggaagtcgttttttcttttttcatcttcctacaagttgattatacaaaagattatttatgtaacaattatggaaacttattaacaataactataatggctaagttattgtggatgtaagactgaaaaaatatcagtacaagcttttctctttgctaggatggattcccaattataatgattttatctcttagtatttgcagaaatattgtaatgtaagtggtaatttttcttttgcagatagactttattttttttactttattttctaatagaaataatttctctttagaagattagtcaggtaattgcacgtaaggaaatggaagttgttaatacaaaagaataatctgtgcttaaagtttctgaagttcatgtggattaagtagatactttaattgaaaacgtcttgctcataatagtcttaatataatcctgataatatgtaggagttatgaaatattttaaaaataatgagatgggagtgctttggtataagcttatgattttcaacttgatcaaatgaatttgagaatttactttttcaagacattttcatgaattttatgttgaagaaatgtttctcttggcaaactcttgatttatggagaatgatgtctaacagattaccgcagaaagccccagctgtatgggaactttgagtgtgtagcagagggaaagaaacttaaagaatatatcagtgtgtctttttagtaatagcacataagggagattcctggaaagtaacattagcagattgatcagtctagtgggtaggacttcaaactctttctaatccaaaaagtagactcatggttttgagatgcttttcaaatgatttgtatagttacagtactaggattaaggtattaaggtatatagagaattaaaagcattatcagtatactgaggcttttctgtcatacatagctagttatcactgtctttgtgaaaatcttcctaaaagataaaatgtagtattatgctagtgaaccaaataattggttaaaactaatgcaaaagtgaaatttatgaaatggagagtaacctgaagtgtttcagagaatttagagcttgattttttttttatttctagttgattgcttggtttcctttctcaaataagtttacagaagatgggagagagaaagttatgaaagatcagaaacctttaaagttgtttttttttaatatcaaatatactctatccttgattatctacatcttggattatcctagacaatgtaaatgttctctacaatgtactttaccatctctcattgacttgagttggtatgtgacccaggaatacaaactgatgtgtatggatctcattaaaatattaattgaaagagaaataggctgtagtttatataaagttactccttatttaggtggtccacgtcctcaactaaaagaggtgctattcagagtttcatatggattccctctccctcaccaaactgcacacacacatatactcttctctccaatattgtgtgcattaactgtatgtgatcttgaacatccgcagtaactttttttcacttgtgattggatgaccattttctgtagatttactttttattttatcatttttaaaagcaatatctgccataacttaatttttatattcttaaagttgaaccaggtgaattcacagagctgaatatggacttgggaggaggatgtgatgccaaatcaatcaggatttgagtttttctttttctttggataagaagctatttagtttatttttaaaattctttctggctcttcatttttacagttacaggatatatagtggactgaaaatttgaaaatgaaattaaggaatgttgcacccttggagtgattatggattgtgacttggatacagaggaattatatatagcataaagcatgaactagctggacttcaaatcctagctgtttaggacaagtttccaggtgtttctcaccattagtttctctatcagtaaaatggaaatggttttacccatctcagagctatgattgtgaagatcaaataagcaatatgcatataaagcatggtacatataaagtattcaataaatattcatgttagtatgatcagctgcctgtggaccctagtttgctcatttataaagtaagaaggttaaacttttaagatttgtatcactatttatttatttatttgttttatttttttgagatggagtctcactctgttgcccaggctggagtgcagtggtgtgatttcagctcactgcaacctctgcctcatgggttcaagcgatttgcatgcctaagcctcccaagtagctgggattacaggcacatgccaccaggcccagctagtttgtgtttttcagtagagatggggtttcaccatgttggccaggaactcctggcctcaagtgatccacccactttggcctcccaaagtgctgggattacaggcgtaagccaccgtgcctgccctgtatcactatttatataaatatatttaaaattttatagcttttcatggtgagttaaaagtatatatacactatatactttagatgtcatataatctacttaattttacagatgaagaaataagcccagagactccttgcccaaggtcacaaatctaggtagtagtagagtcaagtggaaacagattttttaaagagatgttttaaagatattatactcttttccttttataatattatcaacattatttattgagtctgcactgtatacatgacactgtatttggtacttgtagtgagggaataacacaggaagcagtatgcaaattaacataaaaggtggcgcttcttaccttactgaagttacctttctgatatgaggtaactcagtattttactcagtttgcacattttatttccttacttgattgtctttggggaaatatgatattctacctctcctaaagaggagaatttactgggaaaacttgggttttaataaaaatggtttcatgagaatgccacagttcctgagtgtactatttttatatatggcctaacatcagaagaaaattagtaaaaatagctagataatttttgaagtatcaaccttgaggattaaatgttactttcttttttcaccttagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttatattcctttgcaactttattgtatctagatagttgacccttgtctaataccttaactatttttactagttttcttatagctgccttttattttgtcaataatgaaacgaaaatatatgcattattgagaagattattcttaatttgcacctgggatagttatgaattatcttagatttgtatttgtgtatgtggtcagagaaccagatatttgaaaagtaacctatagtgcccatttaattcagtgtttaccagcctttttattcagacacagcttccagtcttctaaattacccctgtgagcaatcactgttgggataattttcaaatttcccttggaagtgactgaagagctgtgatttgagagaggccacatgagcaaagagctgacattgctgtgggcaagacagcttttttttttttaattgattgatttatatgtttgcaatcttctctcccagtataaaatacagtgtaaagtacagggaagaaaacccacaacttgctcaaatataaagagttaactttggaatatactggtcagaggatttgtgtgatatgttaagatagctgtgagactacagtttggacacagcttttgaaagtaatatgcttgtccaaagtaatggccagaaagaaaaggaggaatgggaaataaaaggagaaaaagataaaagataggtataaaaagaaaggaaggagaagtagcaaggaaggaaattgatatgtactaggaaataacctcctcattccttcatacatgactaccaacattttaaaattgtcttcactttaactgatactgatatttatatccctgtattagcccacaggaatgatagctgttttaaaattaacccttgtggggcagagcaacttacaaaggaaaaaagggacaaattatttttgtttctgaggaagactaaatgaattggtagaatatctgtgacagaataaaatcctttgctcaaaagtctccactgtaccttccacccaacagatattattttgacttggtagactaatctttagagctgcagataattcctagaaggtgttagtatcctctgtattagttatatttgtagatcatcatccaaggccagtttcagcaaataaggattattgggaggtggataatgggatgagacaaaggtaaaagagtgaaggattacattcaaagaagaggaaggatatatacatatatggagagagagagagagagagtcattggtgagattctgttgtcctccttttctttctttttctttttctttctttcttcttctttttttttttttttttttttttttttttttgagatggagtctcgctctatcacccaggctggaatgcaatagcacgatctgcaacatccacctcctgggttcaagcggttctcctgccttagccttccgagtagctgagaatacagacacctgccaccacatctggctaatttttgtatttttagtagagacggggtttcatcatgttggccaggttggtctcgaacccctgacctcaagtgatacactggcgtaggcctgccaaagtgctgagattataggtgtgagccacgatgcctggctttgtccttttccatttgcaatatggtactttggggttctcttattctgaacaatccatcactgttctacaaggatgctgtatagctcttccctttcaaatcactgttttgtcattcattgtcagctggaaagtgtcacctggatttaaatatttaaagatatttcttcagaaagaaatatctttaaattctgccttatggattgattaaaaacaatatttggcacaaaattagataaataaaacaaatgtatgccaaaaatgaggtataagatttgattgcttttcttctgtcttatgctccttgggaggttgatttcaaaggtattattatggtattacattcaacagtagtaacatcattgacataaatgtttagcctttcagcatattaaatctgaagagtatagcacttttctaaatatatatcctgtcacgtttgttatgtttatctcttacctaagggtcttctaattctttaaatgtacagataaaatttctcaaaacttttgcccggttccaacaccctatagatgcagtatgagtgcatcaccagtagatgacactattgtatatttaataacaaactagattcttgtttttttaagatgaatcagatacaaaggcagcagagatattgacttcaactaattaatacttcaaaaatttatccatcctagttatagaaattatgcatacttgttgcagaaaaattggaaaatactgaaaagcggaacaagacaaagagttacccagcttcaccattcagagatagccaattatttttgtgttgacttactttacaatctttccttttcagcatattttacatggttctcaaactatgtatgtataaatgttaatgcttttttcattaagaactcatataattttcatttatcacagacttcttgtaaccatcattttaaattagcaacttacatttcatggtatagaggtttacactccctctttccagaacttaacttttgaacattagtgtttacatatacaaatgtcattaaatctgaaagtctagacccagttatgaaccattcatttgtctagtatctaaacttttcacctgaacaagttctcttagaggtattaaagagtatagttgttagcctgaagattttctctatatacttttgcttgagttttattcagattggttttaagccttacatttgagccatatattttaatttaagctctatttgaatgtaaataagcactgtgtgtgtgtgtatatctatggaaatcagtttatttttactttattgggagatttaaaattttaattaaacatttctctgtgtttattttccatattccatcagtgagtaaattttagtttagaattacagctttacccagggtttatgtcatcaagttcccttcaagtggattacttgcaaggaaatcttactttgatatttcctaaatattaagcaattgatataaaagtttgacttaattacttgatttatagaattacttggtctataaggttaattatttggtcatattgaataaatcagattttttatattctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagtaagtgttatagagtaaatgaagttagttcatccaattgtatggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccattaaaaatgtcttttttcatatataacattttaattgccaaagttgtaatcccatcttttataaaatgtacagttaaacctaaaagtgtacttacagaattcttccacgtatcgagaagtttcatcatcatcatctaattattttcttttaaaaacctgccctcaggacaaataaaaacactattttatctgtcagttttctggtactgtttacttctgaaaattacactattttcagtcttttatttctaatatactgtgcttctgttaataaattatgggttaaatggggtataacaactaacttagctaacatttctgatattctattagaatgtttatcccagactagtccattcacatgtgaacttttctttcattttttaaattcaaagatttttgttttgctgtaatacataaaataaaatttaccatttaactttttaaaattatggtaaaatgtaacgtaaatatattatttgaagcatttttatatctacaatgcagtggcattagtacattcacattgttatgcagatcatcactactgtccatttccagagcttttttcatcttctaaaactgaaactctgtaccccttaaacaataagttggccaggcatggtggctcactcctgtaatcctatcactttgggaggctgaggcaggcagattgcttgaacctaggagttggagaacagcttgggcaccatggcaaaaccctgtttctacaaaaaaaaattacaaaaattcgtcagacatggtgatggtgcacacctgtaggcccaactactcgggagactaagatgggagaattgattgaacccaggaggtcgaggctgctatgagccatgatcatgccactgcactccagcctgagcaacagagcaagatgctgtctcaaacaaaaaaataaaaaacaaaaaccagtaacttgcttttctcccttcctcatagcttttggcaaccaacattctactttgtttctgaatttaactactctagatacttcatgtgagtggagtcatacaatatttatccattgatgtttggcttatttcacttgacataatgccttcaaagttcatttattctgtaatatgtgtcagaatttcctatctttttaaggctgaataatattccattgtatgtgtgtacattttgtctgttcatttgttgctggacattttggttgtttcaaccttttggctattgtgaataatgctgctttgaacattagtgtacaaatatctgtttgaatccctcctttgagttttttttgggtatattcccagagtggaattctggatcatgtggtaactctatgtttaatttcttgaggaacctccgtactgttttccatagtggctgcaccattttaccttccctgcggcagtacacaagatttgggtcagtttttaaaataccgaattttcttttcatcatgcagttgagatatcctgaagacctaagggctgtgttcagtagatattaaaataattcatatattaatacttgaaccaagttctataaaagatttaatatttttcttctgtaatatttttttaattcaaaactaatgcatgttcagtaaagaacatttggcaaacataggaagattctagaaaatttataaaaatcttctggaattcatcacccagagatgatcattgttaacattcaatatatctgtctttcttatagaacaaaatcatatgtgttaatttgttatttacatcaaatcaagattatactatactgttgtatcctgcttttttatgtcatgaaccttttcctatgtgattacagttctttgaaaacatggctttaaaggccctaaaatttatttaaccatttgcttattaagacatccagttgttattaacgatctgtattgttaagacattttaaagaatgctgcccagcattcttcaaaacatcaaagacagaaaatgcatctgatagttatcttatattttgaagatctttgactgcatctttgactacatctgatagttaccttatattataaaacctttgaaaaagataaaataatctgtttaagctgatgatgtggtggaccaattttgttgtgggggttgggggtttaatggggttaggggaggttattataaccaaatattaaaaggacaaaaattgatagatgtttttaaacagtcatctctaaactgttaccatttggtttcttctttttttggaataattagttttaagtaattttaagttacttaatattctgtaatagagaaatattcaaactttctgatctttatgactttataataaaattatgtaataaatataaaagtgtctagtccaattatgagaagaatggtgaaagctcatcgttttaaccacatgaaaatagtggggttcccatagattatctaccttgtgtaatactgcacagaaaaagccatgatgagtacccaggtctcctgactataagtgctatttcctccagtgtgctgccttggtaagctaatcaatgtctgggttcctaaattcacctatatattcagaccctcagtatactctatcagcacctctggttgaaagagttagaactaattcgttcttaattaactgtccaaacaggtggcagaatctaacatattattgactgttttattacaattttgtatacatgtaaaagcattagaaacttcattaaatttttgtctgaaacaaccatgttaagtatacctttaaaacttctacagttatttagatgtcattcaaaaagactgatagagaatatgtagaaaattatatatatattatgtgtgtgtatatatatatgattgctttagtatgggtgttgaaaatgtaacaatgtttctgaaacttttactttttttcttaatgtccttagacataatttttattcattaacttggctcttttgttaagtttagtcatgttgtatctgtgactttacctttgaaggaaaaaaaatataaattaagaaaatgtactttagcaccactaaagtgaggttttattctgtaactatttgtcagaattttgaaggtaaagttaactaaactacctaaacttggtgtgtgagaattgaataaacactgtttgcatctcaattctaggttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggtaaaaaacccatacgacaccttgagagcattattgagattctttgaactaaaattattttgtgtgtcaaaataccaatgataaactattgaaacatagtttatgattaaaagcagacaataagtctatttgaaaccattttgcccctactttataatttgccccatttttaattgcattcccttttgtagtttattatttaaaaatgtgaacaaatatccaatttgggtagtaaagagacttaagataccttggagcaagaagattcatcaaaatattatttgatatagctccttcctgaaggcagctaatggtgtataattcctttatattaaaaattcttcaaatattcattaaatatcttctatatacgtgacactaaattagctactaaaaggatgtagtggtcttcacaatatttgtgtgtaccctttgcacaattagatttttcatcataagttttaagcggttgtaaaagatgtctattgtactatcttgtcaatttttacattttaagtaaatagtgttacttatacccagtagaactgaaacattataacaactttccctgtactattattcacttaaaattactttaacagttagacattgcatcattactttttctctttaaacttctatttccataataccacctcacacaaactcattacaacgtactatatttttatccccattatagttctttgcaacaaactacatatacttaacacatttacatatctgtgtgtgtatattgaaattgcatttattttaacattttctgtgacttttgtaaaaacagtaaagggtttaaggttttaggctacctgcaagccaacaacttagtctgcctccatttggtgcatgctgggagaaagcacaaacatctgtacaacagcagtaatcagaacatcagcaattgtgtgatttctctgtacctcctttcctacaaaggatgtgaaaaaggccaagtgacagctgcacatacctggggttattttacagaagaggaaccataagtttagggaacctgaatttttataacagacagtaagcatggttaccctttgctagacagtaagatactatctctacttctaagataatgctacactaacatacttgaaaagatactgctgagcaaaggtattacacataaaaagtaaaatatcataggaaatgcctgtcttaaggagatagatagacctttcctatatccattgatagattaatatgtttcattgaaaggatgagataggactcagcatcagttctgcctctcccttttatttttctttataagtactgagaagctttgttcatagaaaagtcagtgagactgaagagagtttcattttaataatgtcattcaattatttaaacttgtttctatataattccaaaaattaatcatttttgtcacaatatttttagtgatcatcagtggacaactccattgaaaactccttcagttttgcggaaatcaattaatgagaaacaacctgacatacagaaggacttattacccagtctttataatcatttcctgtctcaacaccaatcttgggcagcctaaaagtttttatactgtagggcatatcccattgtaaattctgagtaggtgaagatatgcccttcttttataaattagaaaaagtgctttagtgaaagcagataacaggaaatctgtaaaatatcttgaccatactgtttttaggcagattattatgagcaaagagtaacatatggaaattggagatacgcgaattgattcccttagcaccatcttacacgtttgtgtacctcttggaaaatctttatatgttgctttggaagactacagcttttaggcataaaatgataatgctcttttcccttttcccactccaccatatatagagtaagtacaatgtgtgtcttccacaacattggcttaatcttaaaatatgatttgcataattgatgaatacctgaaagggacagagcctgatattcaaacgttccagtgatgttgaaatcactacaatgagaaatgtaactatatttagttaaaatggacataaaaatttagtttttctcattattcttggttttaatgtttacatggaattccctattttaatattcattcttttatcttggttaatattcattacaaattagtattattaggattctgatctttattgtagacataaaacttaggaaaactgctgcatagatagtgagaaattgataaaaaggtaagatgttacattgaaagataaaatgtagcaccttttaaatatgttagctgccacgtaaagaatggcaattttaaaaatcattatattgaaaatataatttctagaaccatggttattaactggtatatgttagctgaaagttatataatcaattttcaaaaacatgttaattaaaaccaataaaacgtagatatttgaaatgtgtgtgtgactctcaaatacatttatcagggaatgtaacaactggctttagtgtagtaaacaaaacattgaaaaggggaacctgagatttctaagattagatcatctgtctctcaacactgtatgttcctagtatcatttaaaatttaaggacattacatttctattaacttggaaaattgtatataatgtctcaaaataggccattaataaattgtttacttgtattttagatcattagattattgtaggaatgaggtcaaagttgtgtatctaatttccttttccatcactagtgtctttaaagaagaaaagctttataatatacaacatctgaactagtcaaacacatgccaaggaaaatcttaatttggttttctaaagaacaacctgacagaatatagccaaataaaatgtttaagttaatgccttcctgatagtagaccttttatattaatataaaacaatatattttgtgtatattttaagtcttcaagatttatcaagatattttacaaatataattttttaattctggcagcacagaatactaggtatattaatagtcacttctcctaacaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtaaggagaaaaatatgaagattttagtcatctttttagtttgtatgaatttatagctttatggtagtacaaagtataagtgatgtttccacaaaagaggaatttttttaaaggtcaggttcactatccgtgtttatttgtggttattgaatgaatctgaatagtgactttaatactatatttgtcattctgcttttgctttaaaatactagaaaacccactagcaataaaatgacttttattgagtgtcttatagaatatttagtttaggaaagattaacattatggcaaagaaggaaataattttaattttgctgttatattaattttcataaaacatcgatttcacatctgatttgttttaatttcatctcctccatggaggaggtacggcagtcatttaacacatctgtgcatagtatttgcatagcatctatacaaattactactcctttctatgtttcagacctaagcattatcttgacttaaatttttcaataataattttaaggaaataagcaggtgctaattttataaagtagtagaaattttatatgctcagatttactgaacttgtttaaatggtcaaagttatactaacaaactttttgtaactcctcttagatatatcttaagattacatattaccttttacatgctttgtcttataaggttggtagggtggcaatatctgttggtgttgcctagattagtctcttcttgatgcattagaaaatgtagagcagatgctaaaatgttataataaatgtaatcaaatttttttattcattgggtgttaatgtttgtggctgttaatgtgatatgaatgtatcttgcatgcacttaacatgtatagtaattgaaggtatacatggcttgtcttttgtttaaaatgcaaactgatttggaatgtgtctaatgtcattctgtgtagtatatacagcatcagtttctactgtgactccaatataagggagggaaagaagaacatatcgaccatgtattttgggttattttaatacttaaaccaacattatcaatcttcataccagctttattcataatggccccaaattggaaagtctcattagcaggagaatggatgaatacatttttgaatacttacagaattccaaataacaataaaaaagatctactggtacaggcaatgacatggatgaattttacaaataatatgttgagtaaaagaagcctgacacaaatgaacatatactatgtaatttcatttacacgaagttcaaaagggcaaaactagtcagaaatccatcacactacttgatactgggctgtgacagggtggctcagggacaggagggaactttattgcgttctggggatgttctatatgttactctcagtggtggttacttgggtgattacatatgtaaaatatatataatatatataatacgtatataatatatatatgtatcttatatatatatatattatatacatctatgtccctgagctgtgtttttaagattagctttagaaggtacttaaaatagcccaggtgatcaaagatacgtacctaactaaggcagcaacagttgaaggtagagtggaaggtgatgaaataaagctagaagaaaaggtattagctagctaattacacaggattcagtgacaacctggtaaccataaagttatctccagcttgggtggcacggtggatggcagaattgtcagtcatgaacgggaattgagagctttctctccattggggttggagtacttaactttggaaataagagactattgactattttgattcaaaggaactgtctcagtttctgtgcaagactctgcagggtataatttctaaaggaaaaataaatctcctcaccagtcctttgaccggaattggtgcagttcaaaagaaaatggaagagaaaaaaataattttggaaactccttgctacattgtctgaaaatattaccgcagtatccagtatagcagcactagccatatgtggctattgagtacttgaaattcatgtaatgccactaagggactgcatttttagttttaattattaattaaaaaccgatacttggttccattattggacaatttttaaatatattaggaataacttagatatatgatctactttttcaactgtaaatttcatgaaatctaaatatgatctaaatcagtctaaatctaattaaggtcaagtatttcctatgaaaatttagtgcctgaattgagatgtgctgtagtgtaaaatattctacttcctatagccactagccacatgtaaccattgagcatttaaaatgtggccaatctcaattgaaatgagctgtagtataaaatacacactggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaatacacactggattttaatgacttagaatggaaagaaaaaagaatgtaaacatcttgtttgtttatactgattaatattgaagtgataatattttgaatacattaggttaaataaactatattaatacaattaatttcacttttttaatgtggtgtctagaaaatttacaattgtaatgtatcttacattatattgctcttgtgcagtgcaggtctatgcctcatggatactaagtgcctaaaaaaatgtttgttaaactagggaggccgagggtaacaaataaaaaatgttaaactagggtggatcacgaggtcaggagtttgagaccagcctggccaatatggtaaaaccctgtctctactaaaaatacaaaaattagctggacgtggtagcacacgcctgtagtcccagttgctcgggaggctgaggcaggagaatcacttgaacctgggaggcggagattgcagtgagccaagatcacaccactgcactccagcctgggcaacagagtgagactccatctcaaaaaaaataaataaataaaataaaaatgtttgttaaactaatgagtactcatttaagtgaaagagtaattttaaatgttaacatgatttattttaaaacaggaagaatttggctaaagcccttatataaaacagtagtacttcagaatgtgccgtgatgttttttatttttttgttctacaaaggaatggagaataggtgtcctagaatttaggatgaacttgttatggctaccaacttgggcatcagttagatttaaactaacacctctactcactgttattctgctttagtgatacttaaaaaagatctttattatccctgactgttactcaagcagaaatatattgctagccagaaatgtatacattgactggggaagtttgtatatgataaatttggtaaacttattgtttgcttttttctccctttccctatgtaagtgtcataaggcagggatttgtcaatttcatacactattatatcttcagaactaagaattgtataggcatatagttcattctcaatatttattaatggataaacttgggcgtagattaaaattaaggtataaagcttctaatctttcaagattgctctatttcctgaaataagttcttacatcagttgtagtaaatattttcataaagccatagattctggacattttaactaatagtccacagtctgtcatttacatttttttttgttctgtttaaacatattcagtgaaagggaatttgttacctcaaagggcaatactttacattttaggacagctctgttagaaagttatttgttacaataagcttaaggaaacatatctttgtaaattggattcatttatctttattctgtcttccaatgcaagtcaataacaacaagaaacattttctatttactgcgatagtgtgaaaatgtttgtcttcccttttaatcttgtttcagaattattttttccagtacttcaactgtttaactttatgaactctattcagatcttattcatatcagtaccctaaaatatgttaaaagagttcataaactatggcaccccaaattactaaaatgtacacttgggatagcaggaaaaattccgtaatatttttaaaaattttaatttccaaatatgaacattgaagaccagtcctattgaagacagacagaaacatatatttactaagaaaaagaaaatttagccaaattttaaggtggtcaggagtaaaagttcctaatgataaatcagttcctaagtatttggataaaggatctgagaaatactattcttactgctcacgatgtgtaaaggactgaatttcctctttttgtagtgttactttgtatgccacatgataaagagtactttggtgtgggtcgggcgtggtggctcacgcctgtaatcccagcactttgggaggccgagacaggtggatcacgaggtcaggagatcgagaccatcctggctaacatggtgaaaccccgtctctactaaaaatacaaaaaattagccgggcgtggtggcgggcgcttcttgttgtagctactcgggaggctgaggcaggagaatggcgtgaacctgggaggtggagcgtgcagtgagccaagatcatgccactgcactgcagcctgggcgacagagcgagactccacctcaaaaaaaaaaaaaaggagctatgcctgaattaattgcgtcaacatggctgctattgataagaaagcatgtttttaaacaatcaaggcacaaaatgattaaggaaacctttcttcatagtgaaccaaacttatgtttttggtgtgatacccaaataaaagaaatatgcattatgagtcttgcttttggggatctgataaccttatttgataactgagaaggaactacttattacagtctttcccctgatttctgccggtattcaacacaggaagtcaataagtatatccagtgttgtgaggatactgtttgatgtggggctttgcagttctgtgataaatattactttctgttttttgatacagattttttatgccttttcactgaaaagggaagtgctctaatggcattttaacaaattgtcaggcaagtcctgaggtgaagatgaggcagaatgcctattgacatctgctatttcgtgatgatcgcacttttgttcaataaatatacaaaaataaaagattaatagtaaaacaaattcacatgtgccattcagcttcatcagcttatttcttctgtgtccctccttttctccaattgttcatagttattcaaatgtcataaaaatatttagaatacatgtaatatgtacagtatgtatttttacaatttgttttttgagtcatgatccaactaagttctcaaatgctgcagttagttaaaatatctcttaagtctctctaaatgtaggttcctcctccattgctttgctttgcttttttatttcagtttttaagaaatcagattttttttctgtagaatgtcacacagtctggaatatgctgtttgcatccccatagtgtctgttaacatgttattctaccacttgaatgattgatagatctagagcaatacacttaagtatagattatcatctttattttacagataatttctttgtatttttttatttattttattttttttgagatggagtctccgtctgtcgctcaggctggagtgcagtggcgtcatcttggctcactgcaagctccgcctcctggattcacgccattctcctgcctcagcttcccgagcagctgggactacaggcgcccgccaccacgcccggctaatttttttgtatttttagtagagacggagtttcatcgtgttagctaggatggtctcaatctcctgccctcatgatccgcctgccttggcctcccaaagtgctgggattacaggcgtgagccaccgtgtctggcccagataatttctttaagctggttttttatttggctaaaattctcttagtggttaatctctaattcagagcctataccttttccaccataccaagtactcaactttggcggaacctttgcatcatgatggggagctttcaaacatatcattgccaaggtcacaaatcagaccaattaaatcagaataattggggctaggacctagttatcagtgttgtttaaagctacctaggtagttacattgtgcagtcaaggtgcgaaaactagtataccaccatgccacaacttcaggtgttgtgttaaacatatacaatattaagactgtggaagactctttagactatattgattataatatagatcagcttttgagttcctgtcatgcaagttatatgaaatacttttcatattcctttcatctgggctgctgcatcaaaaacataaatttggttcactatggaaaaaggtttgtttaatcattttgtgccttgatttttaagaaaacatattttctcctcagtaacagccatgcagatacaattgatgttgtcatagctcccttacataccacaggacttccatcatgttgtgtactcagagatactacaaggagaggaagatcaaaaaacataccaggctgtaagtcaatgatctttgaactttgtcttcttcaactttgtccatcaaataccctttaaaatttaatatatttggcaagtgcctgaggatccagtagtatagcttaaaggagtgaccaccacaataagctcagattcatgtaaaacttttcattcagctttataatttatttgttgtaatataaagatgaatttggaatttcttatcatgaagtcaaaatggtaatactgtaagttgaatcgcttttatcctgccatcatttatcatgagacattacatgctggacaatatcagcatccaccccaagtaccaacttcaagaggctgtatactagaattttctgaaagtcaaggattcattgtgtcacatgttcagtatgccagtcttgctgcttgaccacacaggcctcaaaggtggagctttttatgctaacattgctttttggttcctttcctttggattgacttttccagtccttttgggataaaagctggcagagaaagctttccaaaatttttcatctctaattttataccacatgtacttcagtatctttcatactacaaacctaattaaagtatccagttctcctaggatgataaataaaaacagctaagaaactggttttattaaatcaactttacttgatttatttagtctcccacacatttacttgattaaattttaagaacgaatttactaagattatgtgttgatagggtgtgtaacagtatttttcattcttaaaatgattcgtatttgaataaaattgctctggcttccctcttgcttctcacctttgccaaaatactgataaaaagacattctgtacagttttggggttttgaaacaacctgtatctttttaggtacatgacattagtcacattttctcaataattgaagtttagattatttaagtataaatgtaaatatgttaactacttactatataaacctctatactattattcaaaatatgttagaatctgcctttcagcttagtttttaaaataatttatagtctttccattttgactttagtatttagtgctgtcccttttagttatataagtgtaaaatatgtaacccgttcttagcattgtaggccataacatttatcacattatgtcattgttggatttggtttttcactactatgtggtgattgccttgtggagccagttctgttttcacagctatcattaagtagagttatggtcaggatcattcattaggtttcccagaaaacttctacaaccgtggttattgctgcaacttttaagaaacaccttatcaggagacttcccttgtttggttaatatcttatttcctaagctgacaggcagtgagtattctggtgatcattttattaaacatatgttttctattattattaaggtacaagtaacaccaaaattaaaactgagttaatatgttaaacgcacaaaaccctcatgatctcttctcagtctagccagcaaaatccacatagaattaattttgtccaaaagtgaaggaattctttgtgtataaagtcactacattgagaaatcacatttctcagataaagggaatttttttaagtattctttttttttaatactgatcgaataatcaaataatattacaaattataactccagaagaaatttaataaatctaaaaaagaaatcagaaggattaaacacttaattagaatttattagttgataggtactgactttcataatacggtcatgcagcacataatgacattttggttggtcccctgagattataatggagctgtctcttagtgatgtcataacatcatagtacaatgcattaccctctctatgtttagatatattttgatacacaaatccttatcactgtgttacagtcacctatagtattcagtacagtaacgtgctatatggtatgacctagaagtaataggccataccgtataacctggttatatggtaggctattccatttaggtttgtgtaagtacacactgtgatgttcacaaaacgaaattgcttaaagatgcatttctcagaacatatccctgtcattatgtgatatatgactatatttctatgttgagaacctgtatagttacaaatgaaacttttagactgtttatgttttcttttattagcatttggcacccaggttttatgcctaatatggtctgttttgactactgattatgttatcttaaagttgttatcgaccttaggagagttttgaactagtgttttgctttccctgttaaaaatattcttcaattgctagcccaaagttatgagctataacatttccattaaaaatctttatctaggccaggcgtggtggctcacacctgtaatcccagcattttgggaggtcaaggcaagcagattacctgaggtcaggagttcgagaccagcctggccaatatggtgaaatcccatctctattaaaaatacaaaaattaggccaggtgcggtggctcatgcgtgtaatcccagcactttgggaggccgaggcaggtggatcatgaggtcaggagatcgagaccatcctcgctaacacggtgaaaccccgtctctactaaaaatataaaataaaatacaatagccaggtgtggtggtggatgcctgtagtcccagctactcaggaggctgaggcaggagaatggcatgaacccaggaggcgaaccttgcagtgagccgagatcgtgccactgcactccagcctgggcgacagagcaagcctctgtctcaaaaaaaaaaaaaaaaatacaaaaattagccgggcgtggtggcgcacacctgtgatcccagctactcaggactctgaggcaggataatcacttgaacccaggaggcggaggttacagtgagcagagatcatgtcattgtactccagcctgggcaacagagcaatactccatctcaaaacaaaaaacaaacaaacaaaaaacctctaatatagactgtcagaagaggatttatgggtgacagactagtttatgattttaaatattaaaattctaaaatattactttatttttaaatttattattattttttgagaaagggtcttgctgtgttgcccaggctggaatgcaatggcacactcacagctcactgcatcctcgaactcctgggctcaagaggtcctcctgcctcatcctcctcagtagatgggactacaggtatgtgccacctcatccagctaattttttttttttagagatagagtcttgctgtgttgcccacgctggtctcaatcttctaggctcaagtaatcctcctgcctcagcctcccaaagcactgggattacagccacctcacctggcataaaataataaatagtgagtagggtaaattatatattatagcttctatcataccattcccaactcaaataggaagagatataaggtaatttaataacttcagttcgaataaagtaaaggaaaaggattattaaattgaatatctgaattatgagaacagattatgttcaacttgtaaactggtagtgttttcaaaagtgctttgttttatatcccatcatgttataataataacaattgacatctgcttcaaattcttggatatctaggcaaatttaaatgacttagcaatatgtattataaatactacaaaaacagaaagggcaagaaggagacttactgagctcattttatgtttgcctgacactgtatttataaatttggatgacttcgagaaacagaaaaccacactcagaatagcttaaacctgttgtttctcgaagtgtagttcccagaccatcagcagcagcagcacctgggaatttgttagaaatgcaaattctcagaccccatttgagtctgattaattagaaaccatttttggagcccagcattctggtataacaaatactccaggtgatattgatgccggctaaaacttgaaagccactgatttaggtctctaatgactagttctgtccagagatgagagccagcctcctcagaaacacatggctggaaggatacctgagcaaaatcaaggccacttcaggaaggagttgtaagggtggatattgaataggcaaccaacagaatagactatgccatgcttggtggtttttggttttgtttttaatatctcatttaaacctcattttggaacacacgtcatatttgttattttagaaaatgtagctggaagttatgacaagctttcaaaatgctgcttccaccaccaccaccaccaaattatataatattgctgatggttgttaggagagtctgtgatggaggggtggagtgtgaccacaatgcactgtatgtagaagagaactttcctggtgtgaagataatgatggtgttcctatgagggactgtgggagagattttagggtaaatgtagtggggctgaatgagaggaataggggaaatggttggtatgtgggggaggtagggtgttactgtggggtgtgctgtgccctgtgtgagtgcatgctggaatgtggaggaaggagatgggagtgggggtttggttgggatgcagtattgcgtgttagaaaggtagtgtgtgtgtgaaaaggtggcatcatgtgtgcatacaacaaagtgaagtggaaggagctgctttaccttaaaatggaagaaattttcaaatgtatcatcatgatattgatattctgattaaaactgaattctagatagttttagtttatatgtatttgtagtttatatttaatctttaaaaaattcacttctttgcttatattcaaaatatcactggttagtgaagtatatgtaggcatagtgaatataactaccttttcaagaaattagatgttagaaaatgcaatttaaaaacagactgtgtaacaggcagagggattttcaggtcactttgaatatttgtgtaggatttatttgtagcatattggcttggtttttacacagtcattctgtaaaattttagggtggaagagtccacaaaaggcatcttattgcttaaaaaatgttcacataaaagatacaatcttatagtactgttagctgtaagtaaggaacataattttatgactatatgaacaaataacaaaatgttcattcaaatcattcatgtgctttaagagactctggaaattatatttactacttttttgttactgggttacttttagtatattcatgtactgatgtttggaaatataggctctgtgtctttaaacttttgagccctttctttgcacatttgggtacagtgcaaccaaacttaagcatgggaaattctctcttccctccccagctttacagcctccactcaggactatcattgctatggatactacttagtgattagctctctctcttgtcaatcaaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtaaatcttagtcaattattttaatttgtatatatactagtcttttcatggtgacattatgaaaaattatacaatttctgaaagtttaagcatagaggatatttatagaatacaaaattttatgattgtacaaagtaccttgaagttgtttctgttaattctgagtatcttcaaaaagggaaattaataagggactgtaattttgtttcatattaagtgttttgtatgttctacaccaacaggaagatatcaaatcttaattgttgccttaatgttttttattttagcttaactttttagaaaaatattcagaattttctcttgcttgaaaataaattgaatagaacagagtaaattaattattattgactggatctcaaaccagattcttttatgatattgtttacttaagggtataattttaagaatctgactaaaaggttttttaagctgttcaaaaagttttcaggcaatgctacctaatacaaatcttcaaacgatatcctagtaaggaaattcagtcaaccatactattgtaagaattttatttatttttctgtacgtgtacattgttataaaatgtattgtccattgctctttctgtggtaatttgggattatattttgcttatgaatgtttattttattttcacttaattgtagatgatttaaaatccaataaggactttggaagatgcccccaaagcagcttgccgcccttaaatgttaagtgtgtcaaaatattaaaattttaataggtgttatttttaattgtaatttcaaaattcatttatatgttacatcagcacagagggatttaggcacctgaaatgattgaatttttaaaatttgtgattagatttaccagataaatcagttaacaccgttgttttttttttaaaccaagaacaatgaagctattcatacattttttttatttgaagtttgaataatcatttattcttagtttgcaaagacttcaatacagtttattacaaatacaagcaaaataaattgtggttattctgaaatttataggtcaatctaattaatgtgcatcaaacacttacatttattacagtcaccacgtccaaggcctgttcattctttatttttatttttatttttgagacagggtctcactttgtcacccaggttggaatgcagtggcgggattttggctcacttcaacctgggctcctgggctcaagtgatcttcctgcctcagcccggcaagtagctgggactgcaagcatgcaccaccacagcccgctaatttttttgtattttttatagagactaggtttcgccttgttgcccaggctggacttgaactcctgagctcagctcaggagatctacctgccttggcctcccatagtgttaggattccaggccactgcgcccagccaagttctgttcattcttatgggaggctatataattttgtcagatactttatttcatgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaaaaaaaaaaaaaaaaaaaaaattctaagagaataaccagtatttcagaacaaatgaaatttgactttttggagtttataatgtgtagctttttagaattcttcgtctttacccaacaaataatatggccatattattactacctctgtaagagagattatcactgaggtatctatagataccttgacagttttccaaatgcctatgtatgtagtatcacatgaccttacagtaaccctgtgtgttaaccagattgttttgttttataagtgagttaatttacatctcaaatacattaataactaataagcagcatacactcctaacaaaatgcatggcatgaaattaaccttttgccagttagcttcgatgagaaccatattgatcaagcatgcttaagttttgttatcttttattttttaaaggccgttttatagtttattctgataacttaaactttaatcattcatttatttgaagctattcatgtatttgatatattcatgtgccatactctaccttgttagtgtctgtcaataagtcgtaatttacttgaaattataagcccattttataataaggatttagtcttaatcaaagtcacaagtcattaaatagcatcagtgtttcattgcctttatcagtagtcactaatttcatcaccattttcttagtttaggccgtcatatatgaacagactttttttaaatttaggctttcatatatgaaaacacaggagaaaagtttgtatgtcgaattgtttacatctgttcaagaattagctgacaggtggatttttaggaagagctaatttaaatgtaaaaatctttccagtgacttcagcctgagataataactataatgataaaaataattacttgtactgacagtgtataccaaatattgttctaaacacttaatatgagttaccttatttaattctcacaaccctgtggaatattactttatcatctccattttacaagtgaaaaaacagggacatagcaatcatactacaactagtgcaagtcagagctgattttttaatctaggcattctggctctagctgatgcccttaaactctttgccatacttgccctcaaaaatcttcagaatataacaagaggaagagaattatttatttcatatatttaatgtatcagaacctattttatatatactttatacatattatttatttctcataaaatgtaaagtatttccatttgaagaatcagaaatggggaaactaaatgaggctccctaagttcacaaaactaataaaaatcagaatcaaaattaaggtagcagtctaaaaccaaagccagtattcttcaatattatgccgcctatctatagtagatagtcataagacatttattaaccagtatttatgtatgtcttatggtaagtgaaacatcttctgctctccagtcacaacctagttgaaaaaagtatacacatatattcaatgtagaatattttttcttaatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaagttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgacattagtgtgatatatgttacagtgtatgaactaatattgatatattgtcatgcagagtctatagtttacattaaggttcattctttgagttgtatattctgtgggttttgacaagtgtataatgacatgtatctagttgtagaatcacatgctataatttttctgccctaaaaattccctgtgccacagctatttatcactcattcccttccagtgaacacctggcacccaccggtctttccactgttttgcgttttgcagagtgtcatatagttggaatcatatagtacgtagccttttcagattggcttctttcacttagcaatttttatttaagactccttcatgtctttttggcttgacagctcatttctttttattgctgaataatattctattttatggttttatccacttctttacccattcacctggtaaaggacattttgctttcttccaccttttggcacttatgaaaagaaactgttacaaacttttagatgtagattttgtgtggacataagttttcaactcataaataccaagtaacatgattactgtatcctatgttaagggtgtgtttgctaggccagtgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaactgccaaactgtctttcatctggctgtacccattttgcatggcatccacaacaaatgagaattcctgttctccacatccctgctgacatttgctgttgtcagctctttggattttagcttttatttaaatagatgtgtagtgatatctcaatcattttaatttgcatttccctggtgacatatcatagtgagcatcctttcatagtcttattttccatttgtatatcttctttaatgagatgtttattcatatcttttgtccatattttaatcaggttgtttgatatcttactgttatgttttacataaacatagagatagaacagaccattgtctccttccttcctatctgtattccttcatatattttggataacagtcctttatcatttatatatgttgcagagattttctagtctgtagcttgtctttttcattctcttgacagtgtctttcacacagtagaagtttttaattttaatgaaattcaacttaataattttctttttcatggattgtacttgtggtattttatctaaaagtgcaccttcagacttagggtcaccaagatttttttcctgtgctattttctaggagatccatagttttgtgttttcctctgtagtccatttggtataaagactttgtctcaattgactgttctgcaggtggatatccagttgttccaatactattggggtaaagaccattatttctcctctgaattgtctttactcctttgttaaaagtcagttgactgtatttatgtgggatatttctgagtgttttattgtgtatcattgatgtatttgtcagttcttttgccaaaaccatgatgtattgattactgtagctttatagtatagtaagtcttgaagttgagtagtgtcagtcttccaactttgttctttttcttcattgctatcttggctattctgtgtctttgcatataaactatttctataaattttagaatcaatttgcctgtatctacaaaatagcctggtagaattttgattgaaattgtattgaatccatacatcaagttgagaagaactgacagcttgacaatattgagtcttcctatctatgaatgtgggatatgtatttaaatcttttgttaatcacagttttctactttttttcacgtagatctctatgtattttgttagaattatatgtatttcatttacattatgctaatataaatggtattctttttaactttcaaattccaagttttcattgctgatataaagaccattgacttttgcatattaatcttgcactctgaaagcctgccatgatcacttattccagtagagttttggttgattctttgggattttttataccaacaatcatgtcatctgctaacaaagacagttttatctctttcttccctatttatataactttaattttctttgaatttaatttatataactttgtcttattgcattagctaggacttcctgcataatgtcaggtaagagtactggcaagggatatcctttccttgctcccagtcttagtgtgaaaggatcttgtttctcactattatgtgttgtattaactgaatttttttaatacatgttctttatccagttgagggagttcttctttattcctaacttcctgagcatttttattagtgttggattttgactagtgcattttttgtatctgttgataagatcacatgatttttcttctttaccatgttgatgtaatagattacatcaattgattttcaaggctgtaccagtcttgcgtaggtgggataagttctacttcgtcgttgtatataattctgtacatttgtacattgctcaattcagtttgctagtgttttgttgagaatttttgcatatatgttaatgagagataattgcctgtagtttttctttcttgtaaagtttttatttctattagagtaatgctgtcctcacagaattagttaagaagtattccctccgcttctgttttctggaagagattgtggagagtttgtataatttcttcgtaaatgtttggtagtattcatcagtgagtctatctgggccttgtgctttctgttttaggaggttattaattattgattaattatttaaatacatatctttctttctttttttgagttggagttttgctatgttccctgggctggtcttgaactcataggctcaagtgatcctctcacctcagcctcctgagtagctgagataataggcatgcattatctgtttcttcttgtgtgacttttggtggtttgtgtctttcaaggaattggtttgctttatctagattatcaaattagtgagtgtacagtttatagtatttcttcattattcttttaatatccatgggatcagtaatgatggcccctcttcatttctgatatttattctctcactctcatctatcctggctagaggtagaggtttatcaattttattgaccttctgaaagattacaaaattggcttctggttccattgctgtttttctattgattttgtttttaatctattgatttctgctctaattttattttcctgtgcttcagatttaatttgattccatattctttcatctcttagcatctcagttatacttttttaaaaaacttttttaaatggttcctctagaatttgtaatacacattttttttagtatagtttacatggtgaaaccccgtctctacaaaaaatacaaaaattagccgtgcgtggtggcacacacctgtagtcccagcacacatctgtagtcccagctacttgggagactgaggcagaagaatcacttgaacccaggaggcagagattgcagtgagccgagattgtgccactgcactccagcctgagtgacagagggagactccgtctcaaaaaaaaaaaaaaaagaaaagaaaaaaaaaaggatatggggatatggctccctcccctcttccttcccttttttttccttttcccagtattgatgaaagacaggaagtgattttaaatgcagattttttcaaatcaaacttcactaatagaattaattctggatttttttttttttttttttaagacaggattttgctctgttgcccaggatggagtgcagtggcttgatcttggctcactgcagcctcaacctgctgggctcaggtgatccttccacgccaccaggcccggctaattttttgtatttttttgtagagacgagatttctccatgttgccccggctgttctcaaactggaatgttattttgaaagcagtagttttaatttgggcaaaatggggcaaagtttaacataattcaggtcttattttgtaataaagactgttaatatatgatgagatatagtagaacaacggcttatgtgacttcaaggatgctgttgtatgctctttttgtttgatacagaagctcagaattatatttccttctttaacatattttttgagaccaaagtaagtgtaagtggcattgattagatagtatttctttttctcttgcatttccatttactgagaaagtagtaaaaatggcacattgacatataactagcagatttttgttagtgtgcaagacattgaagaaagggagatttggggtttgttttggagtaatcttggggaaacactggaacgtccataaggtattgttctttatatctaagagatgaacgtgttcttaatcatgggattggcagcaactgtgaattttctctagtctctgtttttgttagtccatttgtaatagtgatgggtggatttacccctgcctttccattggtaattctgtagaagtaaaggcttaggaaaatactttctctttgtgagggtcctttgtcaaagactgaaaagactagagagtggcatttaattctgcagagtataggtcatggtacttagttcctatagataggagttagcagtatatccaaatactttattccttaagaaacgattttttagccagtgaatgcacttttaattggaaggtcttggttttctcaactgtttactcctaataattcagagcgtgataagggatattttggagaaatgtattcattttttatttaggtttaatcttttgggtaaagtaataaattgtatacatggagtatggtttaccaagggtttaaaattaatgtaagagtaattccagtttcctcatatatactgggaatatatagctcttttatccctttattttgagagaaggaagtatatttctgtactcaaattcaaatctcttttttctattaactcacagacttttttttttttcttacagttttctgtatcctcacccatcagggcatgagtaaatgtttaaggttaaggaagcagaaagtttttaagtcctagaaaaaaatataattgaaaaaaataaatttgaaagagtagatttgtgacatgaaagaaactatgactttatcaagtgttattaagataagcttagccttatggcgatttattgttctcttattagtaactcctactctcagcaatgctgatacaattaggttatgactgatctcttttgtaagcataatttaatttcacttccacccaggaagtgtttttcttatagtaaatgaaggagttttagaatatagatataagataattgttaactggagggatagaaggaaagcagagaattagataagttatttttgacaatccttgtctaggagactattggattgaaggccatgaaaaaagaaagaaaaatataattggccattaaatatttctagagacctgttttgctgggcatagaaaagcaagcccatgatgttttttatttttagtacctaatttttcttttatctttattgaaatcctattgttcttaattgaaagtccttcattatttttatctaatactgaaatataaaaattaaattcagaataatcaaaatgttaaaaatagttgagatgtcaaacctgaaatattctcattcaaaaataaaaaccaaaaattaataaggaggctctttggccattatcatttagtctccagggtaattggtgaaaagtaatcaagtaaaagtcatatgaataatagtagttctcattaatatgttctgggcactatactcagtccttaatatgcatttcctcagtaattcacataaaaccagatttgatatgcacttttactattttcattgttttataacaaaattgataggcaatggggaacccaggtttatctgacacccccccccatccgcccccagagctagagagaataacagcttctggtttctaagtacagagtcagctaacatattgtatgctttgttgcttcacaaaattcaatataataataatggccagaatggaaatctgtccagcctcttttccttttttctattctcatgtctttcagaactttcaacaagtttacatagcttttcatagttaccttaatgtttactggtagccagttccttttagttggctaaataaaaagcctttaaaacctaggttcaaaatctaaactctttatgagccagttggattaactcattttgtggtcagagcctctgtgcatttttgattgattacaagaggaactagtcatagctcaagagaatcgtcacatatttatcacaccattagcgttcactgtagtatggtaactgtttttagaattatgtcatgatctgaaaaagctgtaactattatgtcaacctgaggaaacttacctgtttttgtgggctttctgtaatagtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacgttatctttaatgttagcaaagtatgtgttttatatagtgttttctgtataaaaaactataatttctatttactaagttgaatctatatggaatagtccataaaataaaccttacataccaactagttggatgtagtagtgaaaatcattcatggatatttcactctagtttgatatataaatctcttggattttcaacatagagtggggaagaaatcctaattacagttctcttcccattttaatttctcctcttttttttttttttttttttttttttgctgtttttctcaactgtcagtggaattattgtcttcctgtctccatatttaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttctttcagcgatgaggagttttcattcatttaacgttggaagaatggtgttggttttgagattgaatcttttctaaacaaaatctgaaagatatggtactataggaaaactaataaaaaatttaatagcaaggcttaaatattttatttaaggctatttcatttatatcagcgtcacatcaaatatctcaataggataaactgttcttgaggcattcttggttggtattaggagtacattggaatagtacagtttagacacagaactggataaattacttaaaattctgtgaaataatctttgtgattttttttttagaaacaagaaagcaatgtaattgaaaactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaagccagctagctgacttttgcccttcaagggcttaattaaagatgcatgcaactatcttctttacacagaaatatggggatttatcattcctaccagtcgttcctcatgtagtggatgagaaaacgtctgcttatattgttataaaatcttttcctacattggctacatcatagatattagatatgggccatcttttgccctataaaatcttaaggttaaagatttagccacattttctacgatataaagctttatttatctgaaaagtctgacaattttgaaagcatgtcacaagtttacattaatgcactacctctatttactgttttagattactacaagggaagacataaattcaaagcaggttgctacagtgaaagcagacctggagtctgaatcttttcgaccaaacctaagtgatcccagtgaacttttactgccagatcaaattgaaaaggtatgacatgctcacatatgtgcatttctgagtgtgagtgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcgattaacttgttcaaggtcacacagggagaagtattaaagcttgattcctaacttggatagtctgtctccctagcctattatttaagagatattttaataatcaagctaatagtctatcaagtatttttgttaattcaatatggaaggcaaaagcattaagtaatctatgtttcttatctctgttctaatctgtgtctggttcagggtgattctttattttcctaatagacaattaatattttattctgagaaatgtgtaatacttttcaatcatcttagtatctttgagaataataatttctactgttaatttatttttatagcctatattatataggcaccattacattccagctggcattagtattctacataatgaacaacaagctatcaagtaaatactaacactttgttttctaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtatgaaacaccaactgcatagattgcttatcctttaagagcagtaacagtaacttttagcatatttatttgataaacattactttattagtgcattttattgtttaactgataattactgggtacttttaatatgcaaggcaatgttgagtattacagaggatagatatgagcatgatgattaagaattactgccttcaaagggattatagagtggtagaaaagaacatttgcacataccaacatctctaatggtggggaaaatggtaggtttcttagaacctagaaaaagtgaggaaataagaatgaggttcatgggaaaggtagaaattgacagaatcttgaataatgggtgaagttttgattaaagataattgtttgaaggtgatagccagaacaaaagcacaaataagagtaatattggtttgttcttcaaacagcaagttcaagtcagttgtaattggaaactaatgagaaggtaaaatagcaatattagaacaaaacactggtattactaacacttttagtgttttatgtgtcaggaacttgactaatcacttatgcattatgttatttaatcatgaaagccctatgagattgatactgttatctttatattaaagaatgagtcaactatgacataagctcatcaacttgcccaaggttacatacccaagaaaaagtatttgcaccaatgaaaatgaatgaactgctgctacatgccatggcataaatgaatgtcacaaacataatattgaattagaaatcaaacaccagagagtaactttcttatgatttcatttatagaaagttttatcagtgggccaaatgaatctatagtggtattaggctagtaactccttcaggtagttgagactattgatgagaggaagcacaaagagagcttctagaactagtagtgttctgtttcttggtctgaatgaatgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattcatcaattttctcattagggtactgtgtgtcttgtataagatcatgcacagggttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatcccaaaatttaaaaactaggaaaaaatctgtatttccattgaaaaaccaatatacttcatatttgacaataatgtaaattatatagcagctaaccatttttccctttttaagtatgattagattaaactataccagatttctattttttgcattttatttaaacatatatgatgaaataatgcttactggaataaatttgttagtcgtgtcattgaatatgccttttttatccttaggtttttggtgcgttagcatctgagccactgaaagtgagtgatggcttttatggtactggagagacctttgtttttacattctgtccggagtttgaggtaagaaccactatttcaatattttatttataaagagttgacataacatactgcccaaagcaatttatagattcagtgctattcccattaaactaccactgatattcttcacagaattaggaaaaactattttaaagttcatgtggaacccaaaaagagcccaaatagccaagagaatgctaagcataaagaacaaagctggaggcatcacgttacgtgacttcaaagtatactacaaggctacagtaaccaaaatagcatggtactggtataagaacagacacatagaccaatggaacagaatagagaactcagaaataagacctcacacctgtaaccatctgatctttgacaaacctgacaaaaataagcaatagggaaaggattccctatttaataaattgtgctgggagaactggctagctatgtgcagaaaattgaaactgaaccccttccgtaaaccatatacaaacattaactcaagatgggatagagacttaaatgtacaacccaaaattataaaaaccctagaagaaaatctaggcaataccatttaggacatagatacgggcaaagatttcatgacaacaatgccaaaagcagttgcaacagaagcaaaaattggcaaatgggatctaattaaagagcttctgtacagcaaaataaactatcatcagagtgaacagacagcctacagaataggagaaaatttttgcaatctatccatctgacaaaggtctaatatccagaatctacaaggaacttaagcaaatttgcaagaaaaaaaacaccattgaaaagtgggcaaagacacttttcaaaagaagacatacatgtggccaaaaaaacctgtgaaataaagctcaacatcactgatcattagagaaatgcatatcaaaaccacaatgaggtaccatctcactccagtcagaatggctattattaaaaagtcaaataacagatgctggcaaggttgcagagaaaaaggaatgttttattttgttgttgttgttgttgtttttgaggcagagtcttgctgtgtcgcccaggctggagtgcagtggcatgatctcagctcagtgcagcctttgccttccaggttcaagcaattctcctgcctcagcctcccaagtagctgggattacaggtgtacacaccatgcctggctaatttttgtatttttagtagagacggggttttgccatgttggccaggctggtctcgaactcctgacctcaggtgatccaccctcctcggcctcccagagtgctgggattacaggcgtgagccaccacgcccaactgaaaaaggaatgtttttaccctgttggtgggagtgtaaattagttcaactgttgtagaagacagtgtggcaattcctcaaagacctagaggcagaaataccacttgacccagcaaatcccattactgggtatttacccaaaggaatgtaagtcctcctaatataaagatacatgcacacaaatgttcattgtagcactattcacaatagcaaagacatggaatcaacctaaatgcccatcgatgatagactggataaagaaaatgtggtacatatacaccatggaatacaccatatacaccatgcaaactaatgcaggaacaggaaactaaacaccacatgttctcacttataagaaagagctgaatgatgagaacacatggacacatttcaggggaacaacacagaccttgtgtctgtcgcagggtgagggtgtggggagggagaggagagcatcagaaataatagctaatggatgctgggcttaatacctagttgatcggatgatctgtgcagcaaaccactgtggcacacgtttacctgtgtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcaccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattggagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaattaaatgttacataactatgaaaaacgagtgctaaaagaaagttttattgaaaactgtaatgaacacattttaaaaacttgataaaagtaagttgctagaaattgctactatgttaggtttaggtaaaacacccataaaaggttagaaaaagatatttaagaatattcatgtctagtttgctcttggatttctcaaatgattttaagttctcactgtttaaagaaattgaaactgaaaatcataaatacccattatggtcatggtttatttaagaactgtgatcagtaaatatatatgcaaagaaaaggccttggccctatgttaaaatattatccaattaacatacatttctgtttaatggtaaaagttaatggcatttgtgtccgattttttttcaactcatttacttctttctcaattttttctattaaccgtccaactcttggtgtctgtagagtcaggagaaagaagtatgtgtgaaaagttaacaaaattttgagaaattggaattgaaagttaagtgatagagtgtgtgctttcaaatttagtcatataaacactgaaacccaaaccaccagagccttctgtgcggagctttttgtggtgttcttattcttatactgccagtcttggctttgttaactcgtttgagttttggagaactaactctctataataaccatttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttgacgttagaattcaaatttgtatattatgaaaaagagagtataatgtatttgcaagaagtagctcaagtgtagttattgaaactattgatggagtatttgtttcttcattttaaaatactgttcagtttattcactgtttattaagacccatctttttctttagagcacagtggctctttgataatataaagggaaatatctcagtacctttgaacttctctaatttttaaataactgtgatggaatattttatttctcccaatgcatagaacaagtccaattgttttcatgttattctactctggagaccatttggaatgatattttagacaataatggaaatggggtttttgcttgcttgttttttaacaattatgaatcagacaataatgtgattatcttggcattgcaagtactgtgaggagctttgttttttatttggtatcccagcctcctttaatctttgcattgttgggaggtaggctgctctggtcccacctagcctgggcttagcaagcaacaactccttcctttggtatttctgtctttcagtattagacatgggtatgctaaataattttcagacttgtaaaagtgttacattatttgtatcccacagttgaggatatataatgataatttattcagaccaccaaagaatattcatcatcccaggttattctattattaacaaattttcttacaacttctctgtaagtaggtgtttggaggatataagtagggtgattaaaaagtgatcatggttattgtagccttctctgttagttttagttgttgaactcagcatgtatttacatggtccaattataccttttggggggggtatcattcagccctcccctaaacagtagtcttacatgtgattctgttagctctccaacaggtccactcaatctagtggcttataatttcaagattttatgggtgctttaagtcttcaaaaatgtcatacacaatgccattagatgtctgctggaactagattttattgtacaacatgatttcaccaagctagagtaaccactgggttatttgataataaattaatataagttttcagtgtttaaaggagagtacagcttcagaaagcagaaactacagggagttgatattccagaattccaagggaaaagcaccccaaaagaaaaatgatgtagtggacttaatgtaggctttggagtccaatagacatgattcagattctcacttcaacatatgctgtatgtggtaccttgagcaaactccttaacaaatctaaactttccttagctataaattggagattaaaccagttttgtagagagattataaggaattcacaaggatataatttttgtgcaaatcctagtatagtatctggcatatagtaagtactcaacaactgatagccacctaaactgatagccacctttactcattttctttcatccaacatgatctgttcccttctgataccaggaagaattctgcctgcagtatcattggctgcatgagctataagacattaattaaagatttagaagactacttttattccttccacttccttagccattctcttttcagaaagtcgtatgaatcatctttgaaagcattgctcatataaaaatacactttctggctttctgggtgtttcacctgggacagatctgtaacctcttaaatacatttacttaaatatttggatatcacatacctttttgaaatgctgatgaaatgcagaggtacccattgtcctaaaatgaatatacaaataatccaattttatatgtgatattaagaaattgacaaaaatgttgaaagcttctactcagggcttcagaaaattcaggttaccttggaaaaaactattcatacttggtaataaaacttactgcagcatcagtgacattcatgaatcttgaaggtcaattttgaggtactacttagatgcagtcatctgagattacaactagatgtcttaatcttttattaaccctttcatatttagcagaaggtttttatgagcaagtctgaccctttcatattctcctttctaatagattggctatgatagtctattcgcgcttttaaggctcatggattcagatatctctttaaaggcatgttgttgccagtagagttagagtctctagaagtctattgtcataagaccataaactttttaattcaaatgcgtttctaatttatctctgtattttccagtgccagtgtctgaaacatgataaatgcacatttaaagttgaacaaattagacaaatatgaatttcaatttgaaccttaacaaatgatggcttcctcatgggacagggggcattttggggacgatatagttttgcagtgcttctgtatcacagactctggattgttatgattttcagggtgttcttgtatcttagcaaagtcccattttcatttatagaagaggttcatcagaacgtcatcactggttatcccattacagtttttttgtactgtcaactctcttcttgagtgacactggatgatctctttacctggtcattgtgaattactatactgatctgtcttttctgttttgttgtgaagtaccaactctttttttttttttttttttttttttttttttgagatggagtttcactcttgtcgcccaggctggagtgcaatggcacaatcttggctcactgtaacctctgcctcccaagttcaaatgattcccctgcctcagcctcccaagcagctggaattacaggcgcccaccaccacgcctagctaacttttgtattttttattagagacagggtttcgccatgttggccaggcaggtcgcaaactactgacctcaggggatccaccagcctcagcctcccaaagtgctgggattataggcgtgaggcactgcacccggccccaactcttaaaggaaccattctacatggtcactgtagccaccttctctacttagaaacacatctctatacttaaaatttgtatatgtaattaatatacattatatatttgatgctgttttttattacagagtataaataaatagttcctttcttttgttctaagatagtgttaaaaatagatcagttccaggccaggcacggtggctcacgcctgtaatcccagcactttgggaggctgaggcgggtggatcacaaggtcaggagatcgataccatcctggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaaaaaaaaaaaaataggtcagttcctctcccacacaagtcagttaactctgtaatgccatgtgactcctgatggcaagcctgaaggtcagaggttatagccacccaaattatagagttgtgtaagtctttacaattacctaatatgcttttcttttttgtgtgttttaatataattgacaaactctaccccagagaggttaagtgacttaactaagtttgacataagttgtggccactgagttgacagacaagtcttgatcccagaccagtttttttctttcaatgaaatataactgcccatattttttaaaaaagcctccgcctcctaaactctggctcaattctgctgacttgatatattactttagatttagagaatcccaagggatagctctctggatattatgttaattaatagtctttgccccctctcctcttctattaggtaggaaaacattttctagagaatagaaagaagtcctctcataacctggtgttttcccctctcggttatgtattagataattagataaattggaccttataatctatctgttaagttcctgttatacctagattatatcttggttcttctgcttgaatctcaacatcacatatttgtccatttaaagtcctttcaaactgagctcttttgcaaacagcttcctatgcaggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttcttttcttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaa

SEQ ID NO: 1440 - DNA, 26587 bp, Homo sapiens
aaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtaaatcttagtcaattattttaatttgtatatatactagtcttttcatggtgacattatgaaaaattatacaatttctgaaagtttaagcatagaggatatttatagaatacaaaattttatgattgtacaaagtaccttgaagttgtttctgttaattctgagtatcttcaaaaagggaaattaataagggactgtaattttgtttcatattaagtgttttgtatgttctacaccaacaggaagatatcaaatcttaattgttgccttaatgttttttattttagcttaactttttagaaaaatattcagaattttctcttgcttgaaaataaattgaatagaacagagtaaattaattattattgactggatctcaaaccagattcttttatgatattgtttacttaagggtataattttaagaatctgactaaaaggttttttaagctgttcaaaaagttttcaggcaatgctacctaatacaaatcttcaaacgatatcctagtaaggaaattcagtcaaccatactattgtaagaattttatttatttttctgtacgtgtacattgttataaaatgtattgtccattgctctttctgtggtaatttgggattatattttgcttatgaatgtttattttattttcacttaattgtagatgatttaaaatccaataaggactttggaagatgcccccaaagcagcttgccgcccttaaatgttaagtgtgtcaaaatattaaaattttaataggtgttatttttaattgtaatttcaaaattcatttatatgttacatcagcacagagggatttaggcacctgaaatgattgaatttttaaaatttgtgattagatttaccagataaatcagttaacaccgttgttttttttttaaaccaagaacaatgaagctattcatacattttttttatttgaagtttgaataatcatttattcttagtttgcaaagacttcaatacagtttattacaaatacaagcaaaataaattgtggttattctgaaatttataggtcaatctaattaatgtgcatcaaacacttacatttattacagtcaccacgtccaaggcctgttcattctttatttttatttttatttttgagacagggtctcactttgtcacccaggttggaatgcagtggcgggattttggctcacttcaacctgggctcctgggctcaagtgatcttcctgcctcagcccggcaagtagctgggactgcaagcatgcaccaccacagcccgctaatttttttgtattttttatagagactaggtttcgccttgttgcccaggctggacttgaactcctgagctcagctcaggagatctacctgccttggcctcccatagtgttaggattccaggccactgcgcccagccaagttctgttcattcttatgggaggctatataattttgtcagatactttatttcatgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaaaaaaaaaaaaaaaaaaaaaattctaagagaataaccagtatttcagaacaaatgaaatttgactttttggagtttataatgtgtagctttttagaattcttcgtctttacccaacaaataatatggccatattattactacctctgtaagagagattatcactgaggtatctatagataccttgacagttttccaaatgcctatgtatgtagtatcacatgaccttacagtaaccctgtgtgttaaccagattgttttgttttataagtgagttaatttacatctcaaatacattaataactaataagcagcatacactcctaacaaaatgcatggcatgaaattaaccttttgccagttagcttcgatgagaaccatattgatcaagcatgcttaagttttgttatcttttattttttaaaggccgttttatagtttattctgataacttaaactttaatcattcatttatttgaagctattcatgtatttgatatattcatgtgccatactctaccttgttagtgtctgtcaataagtcgtaatttacttgaaattataagcccattttataataaggatttagtcttaatcaaagtcacaagtcattaaatagcatcagtgtttcattgcctttatcagtagtcactaatttcatcaccattttcttagtttaggccgtcatatatgaacagactttttttaaatttaggctttcatatatgaaaacacaggagaaaagtttgtatgtcgaattgtttacatctgttcaagaattagctgacaggtggatttttaggaagagctaatttaaatgtaaaaatctttccagtgacttcagcctgagataataactataatgataaaaataattacttgtactgacagtgtataccaaatattgttctaaacacttaatatgagttaccttatttaattctcacaaccctgtggaatattactttatcatctccattttacaagtgaaaaaacagggacatagcaatcatactacaactagtgcaagtcagagctgattttttaatctaggcattctggctctagctgatgcccttaaactctttgccatacttgccctcaaaaatcttcagaatataacaagaggaagagaattatttatttcatatatttaatgtatcagaacctattttatatatactttatacatattatttatttctcataaaatgtaaagtatttccatttgaagaatcagaaatggggaaactaaatgaggctccctaagttcacaaaactaataaaaatcagaatcaaaattaaggtagcagtctaaaaccaaagccagtattcttcaatattatgccgcctatctatagtagatagtcataagacatttattaaccagtatttatgtatgtcttatggtaagtgaaacatcttctgctctccagtcacaacctagttgaaaaaagtatacacatatattcaatgtagaatattttttcttaatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaagttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgacattagtgtgatatatgttacagtgtatgaactaatattgatatattgtcatgcagagtctatagtttacattaaggttcattctttgagttgtatattctgtgggttttgacaagtgtataatgacatgtatctagttgtagaatcacatgctataatttttctgccctaaaaattccctgtgccacagctatttatcactcattcccttccagtgaacacctggcacccaccggtctttccactgttttgcgttttgcagagtgtcatatagttggaatcatatagtacgtagccttttcagattggcttctttcacttagcaatttttatttaagactccttcatgtctttttggcttgacagctcatttctttttattgctgaataatattctattttatggttttatccacttctttacccattcacctggtaaaggacattttgctttcttccaccttttggcacttatgaaaagaaactgttacaaacttttagatgtagattttgtgtggacataagttttcaactcataaataccaagtaacatgattactgtatcctatgttaagggtgtgtttgctaggccagtgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaactgccaaactgtctttcatctggctgtacccattttgcatggcatccacaacaaatgagaattcctgttctccacatccctgctgacatttgctgttgtcagctctttggattttagcttttatttaaatagatgtgtagtgatatctcaatcattttaatttgcatttccctggtgacatatcatagtgagcatcctttcatagtcttattttccatttgtatatcttctttaatgagatgtttattcatatcttttgtccatattttaatcaggttgtttgatatcttactgttatgttttacataaacatagagatagaacagaccattgtctccttccttcctatctgtattccttcatatattttggataacagtcctttatcatttatatatgttgcagagattttctagtctgtagcttgtctttttcattctcttgacagtgtctttcacacagtagaagtttttaattttaatgaaattcaacttaataattttctttttcatggattgtacttgtggtattttatctaaaagtgcaccttcagacttagggtcaccaagatttttttcctgtgctattttctaggagatccatagttttgtgttttcctctgtagtccatttggtataaagactttgtctcaattgactgttctgcaggtggatatccagttgttccaatactattggggtaaagaccattatttctcctctgaattgtctttactcctttgttaaaagtcagttgactgtatttatgtgggatatttctgagtgttttattgtgtatcattgatgtatttgtcagttcttttgccaaaaccatgatgtattgattactgtagctttatagtatagtaagtcttgaagttgagtagtgtcagtcttccaactttgttctttttcttcattgctatcttggctattctgtgtctttgcatataaactatttctataaattttagaatcaatttgcctgtatctacaaaatagcctggtagaattttgattgaaattgtattgaatccatacatcaagttgagaagaactgacagcttgacaatattgagtcttcctatctatgaatgtgggatatgtatttaaatcttttgttaatcacagttttctactttttttcacgtagatctctatgtattttgttagaattatatgtatttcatttacattatgctaatataaatggtattctttttaactttcaaattccaagttttcattgctgatataaagaccattgacttttgcatattaatcttgcactctgaaagcctgccatgatcacttattccagtagagttttggttgattctttgggattttttataccaacaatcatgtcatctgctaacaaagacagttttatctctttcttccctatttatataactttaattttctttgaatttaatttatataactttgtcttattgcattagctaggacttcctgcataatgtcaggtaagagtactggcaagggatatcctttccttgctcccagtcttagtgtgaaaggatcttgtttctcactattatgtgttgtattaactgaatttttttaatacatgttctttatccagttgagggagttcttctttattcctaacttcctgagcatttttattagtgttggattttgactagtgcattttttgtatctgttgataagatcacatgatttttcttctttaccatgttgatgtaatagattacatcaattgattttcaaggctgtaccagtcttgcgtaggtgggataagttctacttcgtcgttgtatataattctgtacatttgtacattgctcaattcagtttgctagtgttttgttgagaatttttgcatatatgttaatgagagataattgcctgtagtttttctttcttgtaaagtttttatttctattagagtaatgctgtcctcacagaattagttaagaagtattccctccgcttctgttttctggaagagattgtggagagtttgtataatttcttcgtaaatgtttggtagtattcatcagtgagtctatctgggccttgtgctttctgttttaggaggttattaattattgattaattatttaaatacatatctttctttctttttttgagttggagttttgctatgttccctgggctggtcttgaactcataggctcaagtgatcctctcacctcagcctcctgagtagctgagataataggcatgcattatctgtttcttcttgtgtgacttttggtggtttgtgtctttcaaggaattggtttgctttatctagattatcaaattagtgagtgtacagtttatagtatttcttcattattcttttaatatccatgggatcagtaatgatggcccctcttcatttctgatatttattctctcactctcatctatcctggctagaggtagaggtttatcaattttattgaccttctgaaagattacaaaattggcttctggttccattgctgtttttctattgattttgtttttaatctattgatttctgctctaattttattttcctgtgcttcagatttaatttgattccatattctttcatctcttagcatctcagttatacttttttaaaaaacttttttaaatggttcctctagaatttgtaatacacattttttttagtatagtttacatggtgaaaccccgtctctacaaaaaatacaaaaattagccgtgcgtggtggcacacacctgtagtcccagcacacatctgtagtcccagctacttgggagactgaggcagaagaatcacttgaacccaggaggcagagattgcagtgagccgagattgtgccactgcactccagcctgagtgacagagggagactccgtctcaaaaaaaaaaaaaaaagaaaagaaaaaaaaaaggatatggggatatggctccctcccctcttccttcccttttttttccttttcccagtattgatgaaagacaggaagtgattttaaatgcagattttttcaaatcaaacttcactaatagaattaattctggatttttttttttttttttttaagacaggattttgctctgttgcccaggatggagtgcagtggcttgatcttggctcactgcagcctcaacctgctgggctcaggtgatccttccacgccaccaggcccggctaattttttgtatttttttgtagagacgagatttctccatgttgccccggctgttctcaaactggaatgttattttgaaagcagtagttttaatttgggcaaaatggggcaaagtttaacataattcaggtcttattttgtaataaagactgttaatatatgatgagatatagtagaacaacggcttatgtgacttcaaggatgctgttgtatgctctttttgtttgatacagaagctcagaattatatttccttctttaacatattttttgagaccaaagtaagtgtaagtggcattgattagatagtatttctttttctcttgcatttccatttactgagaaagtagtaaaaatggcacattgacatataactagcagatttttgttagtgtgcaagacattgaagaaagggagatttggggtttgttttggagtaatcttggggaaacactggaacgtccataaggtattgttctttatatctaagagatgaacgtgttcttaatcatgggattggcagcaactgtgaattttctctagtctctgtttttgttagtccatttgtaatagtgatgggtggatttacccctgcctttccattggtaattctgtagaagtaaaggcttaggaaaatactttctctttgtgagggtcctttgtcaaagactgaaaagactagagagtggcatttaattctgcagagtataggtcatggtacttagttcctatagataggagttagcagtatatccaaatactttattccttaagaaacgattttttagccagtgaatgcacttttaattggaaggtcttggttttctcaactgtttactcctaataattcagagcgtgataagggatattttggagaaatgtattcattttttatttaggtttaatcttttgggtaaagtaataaattgtatacatggagtatggtttaccaagggtttaaaattaatgtaagagtaattccagtttcctcatatatactgggaatatatagctcttttatccctttattttgagagaaggaagtatatttctgtactcaaattcaaatctcttttttctattaactcacagacttttttttttttcttacagttttctgtatcctcacccatcagggcatgagtaaatgtttaaggttaaggaagcagaaagtttttaagtcctagaaaaaaatataattgaaaaaaataaatttgaaagagtagatttgtgacatgaaagaaactatgactttatcaagtgttattaagataagcttagccttatggcgatttattgttctcttattagtaactcctactctcagcaatgctgatacaattaggttatgactgatctcttttgtaagcataatttaatttcacttccacccaggaagtgtttttcttatagtaaatgaaggagttttagaatatagatataagataattgttaactggagggatagaaggaaagcagagaattagataagttatttttgacaatccttgtctaggagactattggattgaaggccatgaaaaaagaaagaaaaatataattggccattaaatatttctagagacctgttttgctgggcatagaaaagcaagcccatgatgttttttatttttagtacctaatttttcttttatctttattgaaatcctattgttcttaattgaaagtccttcattatttttatctaatactgaaatataaaaattaaattcagaataatcaaaatgttaaaaatagttgagatgtcaaacctgaaatattctcattcaaaaataaaaaccaaaaattaataaggaggctctttggccattatcatttagtctccagggtaattggtgaaaagtaatcaagtaaaagtcatatgaataatagtagttctcattaatatgttctgggcactatactcagtccttaatatgcatttcctcagtaattcacataaaaccagatttgatatgcacttttactattttcattgttttataacaaaattgataggcaatggggaacccaggtttatctgacacccccccccatccgcccccagagctagagagaataacagcttctggtttctaagtacagagtcagctaacatattgtatgctttgttgcttcacaaaattcaatataataataatggccagaatggaaatctgtccagcctcttttccttttttctattctcatgtctttcagaactttcaacaagtttacatagcttttcatagttaccttaatgtttactggtagccagttccttttagttggctaaataaaaagcctttaaaacctaggttcaaaatctaaactctttatgagccagttggattaactcattttgtggtcagagcctctgtgcatttttgattgattacaagaggaactagtcatagctcaagagaatcgtcacatatttatcacaccattagcgttcactgtagtatggtaactgtttttagaattatgtcatgatctgaaaaagctgtaactattatgtcaacctgaggaaacttacctgtttttgtgggctttctgtaatagtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacgttatctttaatgttagcaaagtatgtgttttatatagtgttttctgtataaaaaactataatttctatttactaagttgaatctatatggaatagtccataaaataaaccttacataccaactagttggatgtagtagtgaaaatcattcatggatatttcactctagtttgatatataaatctcttggattttcaacatagagtggggaagaaatcctaattacagttctcttcccattttaatttctcctcttttttttttttttttttttttttttgctgtttttctcaactgtcagtggaattattgtcttcctgtctccatatttaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttctttcagcgatgaggagttttcattcatttaacgttggaagaatggtgttggttttgagattgaatcttttctaaacaaaatctgaaagatatggtactataggaaaactaataaaaaatttaatagcaaggcttaaatattttatttaaggctatttcatttatatcagcgtcacatcaaatatctcaataggataaactgttcttgaggcattcttggttggtattaggagtacattggaatagtacagtttagacacagaactggataaattacttaaaattctgtgaaataatctttgtgattttttttttagaaacaagaaagcaatgtaattgaaaactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaagccagctagctgacttttgcccttcaagggcttaattaaagatgcatgcaactatcttctttacacagaaatatggggatttatcattcctaccagtcgttcctcatgtagtggatgagaaaacgtctgcttatattgttataaaatcttttcctacattggctacatcatagatattagatatgggccatcttttgccctataaaatcttaaggttaaagatttagccacattttctacgatataaagctttatttatctgaaaagtctgacaattttgaaagcatgtcacaagtttacattaatgcactacctctatttactgttttagattactacaagggaagacataaattcaaagcaggttgctacagtgaaagcagacctggagtctgaatcttttcgaccaaacctaagtgatcccagtgaacttttactgccagatcaaattgaaaaggtatgacatgctcacatatgtgcatttctgagtgtgagtgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcgattaacttgttcaaggtcacacagggagaagtattaaagcttgattcctaacttggatagtctgtctccctagcctattatttaagagatattttaataatcaagctaatagtctatcaagtatttttgttaattcaatatggaaggcaaaagcattaagtaatctatgtttcttatctctgttctaatctgtgtctggttcagggtgattctttattttcctaatagacaattaatattttattctgagaaatgtgtaatacttttcaatcatcttagtatctttgagaataataatttctactgttaatttatttttatagcctatattatataggcaccattacattccagctggcattagtattctacataatgaacaacaagctatcaagtaaatactaacactttgttttctaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtatgaaacaccaactgcatagattgcttatcctttaagagcagtaacagtaacttttagcatatttatttgataaacattactttattagtgcattttattgtttaactgataattactgggtacttttaatatgcaaggcaatgttgagtattacagaggatagatatgagcatgatgattaagaattactgccttcaaagggattatagagtggtagaaaagaacatttgcacataccaacatctctaatggtggggaaaatggtaggtttcttagaacctagaaaaagtgaggaaataagaatgaggttcatgggaaaggtagaaattgacagaatcttgaataatgggtgaagttttgattaaagataattgtttgaaggtgatagccagaacaaaagcacaaataagagtaatattggtttgttcttcaaacagcaagttcaagtcagttgtaattggaaactaatgagaaggtaaaatagcaatattagaacaaaacactggtattactaacacttttagtgttttatgtgtcaggaacttgactaatcacttatgcattatgttatttaatcatgaaagccctatgagattgatactgttatctttatattaaagaatgagtcaactatgacataagctcatcaacttgcccaaggttacatacccaagaaaaagtatttgcaccaatgaaaatgaatgaactgctgctacatgccatggcataaatgaatgtcacaaacataatattgaattagaaatcaaacaccagagagtaactttcttatgatttcatttatagaaagttttatcagtgggccaaatgaatctatagtggtattaggctagtaactccttcaggtagttgagactattgatgagaggaagcacaaagagagcttctagaactagtagtgttctgtttcttggtctgaatgaatgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattcatcaattttctcattagggtactgtgtgtcttgtataagatcatgcacagggttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatcccaaaatttaaaaactaggaaaaaatctgtatttccattgaaaaaccaatatacttcatatttgacaataatgtaaattatatagcagctaaccatttttccctttttaagtatgattagattaaactataccagatttctattttttgcattttatttaaacatatatgatgaaataatgcttactggaataaatttgttagtcgtgtcattgaatatgccttttttatccttaggtttttggtgcgttagcatctgagccactgaaagtgagtgatggcttttatggtactggagagacctttgtttttacattctgtccggagtttgaggtaagaaccactatttcaatattttatttataaagagttgacataacatactgcccaaagcaatttatagattcagtgctattcccattaaactaccactgatattcttcacagaattaggaaaaactattttaaagttcatgtggaacccaaaaagagcccaaatagccaagagaatgctaagcataaagaacaaagctggaggcatcacgttacgtgacttcaaagtatactacaaggctacagtaaccaaaatagcatggtactggtataagaacagacacatagaccaatggaacagaatagagaactcagaaataagacctcacacctgtaaccatctgatctttgacaaacctgacaaaaataagcaatagggaaaggattccctatttaataaattgtgctgggagaactggctagctatgtgcagaaaattgaaactgaaccccttccgtaaaccatatacaaacattaactcaagatgggatagagacttaaatgtacaacccaaaattataaaaaccctagaagaaaatctaggcaataccatttaggacatagatacgggcaaagatttcatgacaacaatgccaaaagcagttgcaacagaagcaaaaattggcaaatgggatctaattaaagagcttctgtacagcaaaataaactatcatcagagtgaacagacagcctacagaataggagaaaatttttgcaatctatccatctgacaaaggtctaatatccagaatctacaaggaacttaagcaaatttgcaagaaaaaaaacaccattgaaaagtgggcaaagacacttttcaaaagaagacatacatgtggccaaaaaaacctgtgaaataaagctcaacatcactgatcattagagaaatgcatatcaaaaccacaatgaggtaccatctcactccagtcagaatggctattattaaaaagtcaaataacagatgctggcaaggttgcagagaaaaaggaatgttttattttgttgttgttgttgttgtttttgaggcagagtcttgctgtgtcgcccaggctggagtgcagtggcatgatctcagctcagtgcagcctttgccttccaggttcaagcaattctcctgcctcagcctcccaagtagctgggattacaggtgtacacaccatgcctggctaatttttgtatttttagtagagacggggttttgccatgttggccaggctggtctcgaactcctgacctcaggtgatccaccctcctcggcctcccagagtgctgggattacaggcgtgagccaccacgcccaactgaaaaaggaatgtttttaccctgttggtgggagtgtaaattagttcaactgttgtagaagacagtgtggcaattcctcaaagacctagaggcagaaataccacttgacccagcaaatcccattactgggtatttacccaaaggaatgtaagtcctcctaatataaagatacatgcacacaaatgttcattgtagcactattcacaatagcaaagacatggaatcaacctaaatgcccatcgatgatagactggataaagaaaatgtggtacatatacaccatggaatacaccatatacaccatgcaaactaatgcaggaacaggaaactaaacaccacatgttctcacttataagaaagagctgaatgatgagaacacatggacacatttcaggggaacaacacagaccttgtgtctgtcgcagggtgagggtgtggggagggagaggagagcatcagaaataatagctaatggatgctgggcttaatacctagttgatcggatgatctgtgcagcaaaccactgtggcacacgtttacctgtgtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcaccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattggagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaattaaatgttacataactatgaaaaacgagtgctaaaagaaagttttattgaaaactgtaatgaacacattttaaaaacttgataaaagtaagttgctagaaattgctactatgttaggtttaggtaaaacacccataaaaggttagaaaaagatatttaagaatattcatgtctagtttgctcttggatttctcaaatgattttaagttctcactgtttaaagaaattgaaactgaaaatcataaatacccattatggtcatggtttatttaagaactgtgatcagtaaatatatatgcaaagaaaaggccttggccctatgttaaaatattatccaattaacatacatttctgtttaatggtaaaagttaatggcatttgtgtccgattttttttcaactcatttacttctttctcaattttttctattaaccgtccaactcttggtgtctgtagagtcaggagaaagaagtatgtgtgaaaagttaacaaaattttgagaaattggaattgaaagttaagtgatagagtgtgtgctttcaaatttagtcatataaacactgaaacccaaaccaccagagccttctgtgcggagctttttgtggtgttcttattcttatactgccagtcttggctttgttaactcgtttgagttttggagaactaactctctataataaccatttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttgacgttagaattcaaatttgtatattatgaaaaagagagtataatgtatttgcaagaagtagctcaagtgtagttattgaaactattgatggagtatttgtttcttcattttaaaatactgttcagtttattcactgtttattaagacccatctttttctttagagcacagtggctctttgataatataaagggaaatatctcagtacctttgaacttctctaatttttaaataactgtgatggaatattttatttctcccaatgcatagaacaagtccaattgttttcatgttattctactctggagaccatttggaatgatattttagacaataatggaaatggggtttttgcttgcttgttttttaacaattatgaatcagacaataatgtgattatcttggcattgcaagtactgtgaggagctttgttttttatttggtatcccagcctcctttaatctttgcattgttgggaggtaggctgctctggtcccacctagcctgggcttagcaagcaacaactccttcctttggtatttctgtctttcagtattagacatgggtatgctaaataattttcagacttgtaaaagtgttacattatttgtatcccacagttgaggatatataatgataatttattcagaccaccaaagaatattcatcatcccaggttattctattattaacaaattttcttacaacttctctgtaagtaggtgtttggaggatataagtagggtgattaaaaagtgatcatggttattgtagccttctctgttagttttagttgttgaactcagcatgtatttacatggtccaattataccttttggggggggtatcattcagccctcccctaaacagtagtcttacatgtgattctgttagctctccaacaggtccactcaatctagtggcttataatttcaagattttatgggtgctttaagtcttcaaaaatgtcatacacaatgccattagatgtctgctggaactagattttattgtacaacatgatttcaccaagctagagtaaccactgggttatttgataataaattaatataagttttcagtgtttaaaggagagtacagcttcagaaagcagaaactacagggagttgatattccagaattccaagggaaaagcaccccaaaagaaaaatgatgtagtggacttaatgtaggctttggagtccaatagacatgattcagattctcacttcaacatatgctgtatgtggtaccttgagcaaactccttaacaaatctaaactttccttagctataaattggagattaaaccagttttgtagagagattataaggaattcacaaggatataatttttgtgcaaatcctagtatagtatctggcatatagtaagtactcaacaactgatagccacctaaactgatagccacctttactcattttctttcatccaacatgatctgttcccttctgataccaggaagaattctgcctgcagtatcattggctgcatgagctataagacattaattaaagatttagaagactacttttattccttccacttccttagccattctcttttcagaaagtcgtatgaatcatctttgaaagcattgctcatataaaaatacactttctggctttctgggtgtttcacctgggacagatctgtaacctcttaaatacatttacttaaatatttggatatcacatacctttttgaaatgctgatgaaatgcagaggtacccattgtcctaaaatgaatatacaaataatccaattttatatgtgatattaagaaattgacaaaaatgttgaaagcttctactcagggcttcagaaaattcaggttaccttggaaaaaactattcatacttggtaataaaacttactgcagcatcagtgacattcatgaatcttgaaggtcaattttgaggtactacttagatgcagtcatctgagattacaactagatgtcttaatcttttattaaccctttcatatttagcagaaggtttttatgagcaagtctgaccctttcatattctcctttctaatagattggctatgatagtctattcgcgcttttaaggctcatggattcagatatctctttaaaggcatgttgttgccagtagagttagagtctctagaagtctattgtcataagaccataaactttttaattcaaatgcgtttctaatttatctctgtattttccagtgccagtgtctgaaacatgataaatgcacatttaaagttgaacaaattagacaaatatgaatttcaatttgaaccttaacaaatgatggcttcctcatgggacagggggcattttggggacgatatagttttgcagtgcttctgtatcacagactctggattgttatgattttcagggtgttcttgtatcttagcaaagtcccattttcatttatagaagaggttcatcagaacgtcatcactggttatcccattacagtttttttgtactgtcaactctcttcttgagtgacactggatgatctctttacctggtcattgtgaattactatactgatctgtcttttctgttttgttgtgaagtaccaactctttttttttttttttttttttttttttttttgagatggagtttcactcttgtcgcccaggctggagtgcaatggcacaatcttggctcactgtaacctctgcctcccaagttcaaatgattcccctgcctcagcctcccaagcagctggaattacaggcgcccaccaccacgcctagctaacttttgtattttttattagagacagggtttcgccatgttggccaggcaggtcgcaaactactgacctcaggggatccaccagcctcagcctcccaaagtgctgggattataggcgtgaggcactgcacccggccccaactcttaaaggaaccattctacatggtcactgtagccaccttctctacttagaaacacatctctatacttaaaatttgtatatgtaattaatatacattatatatttgatgctgttttttattacagagtataaataaatagttcctttcttttgttctaagatagtgttaaaaatagatcagttccaggccaggcacggtggctcacgcctgtaatcccagcactttgggaggctgaggcgggtggatcacaaggtcaggagatcgataccatcctggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaaaaaaaaaaaaataggtcagttcctctcccacacaagtcagttaactctgtaatgccatgtgactcctgatggcaagcctgaaggtcagaggttatagccacccaaattatagagttgtgtaagtctttacaattacctaatatgcttttcttttttgtgtgttttaatataattgacaaactctaccccagagaggttaagtgacttaactaagtttgacataagttgtggccactgagttgacagacaagtcttgatcccagaccagtttttttctttcaatgaaatataactgcccatattttttaaaaaagcctccgcctcctaaactctggctcaattctgctgacttgatatattactttagatttagagaatcccaagggatagctctctggatattatgttaattaatagtctttgccccctctcctcttctattaggtaggaaaacattttctagagaatagaaagaagtcctctcataacctggtgttttcccctctcggttatgtattagataattagataaattggaccttataatctatctgttaagttcctgttatacctagattatatcttggttcttctgcttgaatctcaacatcacatatttgtccatttaaagtcctttcaaactgagctcttttgcaaacagcttcctatgcaggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttcttttcttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaa

SEQ ID NO: 1441 - DNA, 26587 bp, Homo sapiens; identical to SEQ ID NO: 1440

SEQ ID NO: 1442 - DNA, 94886 bp, Homo sapiens
atggtccgtccccgggcagagagagggacgccccctcctcctccccgcctcttgtgaggcgcgcggagccgcctcccctgggtcaggtctgatgggccggtgggcgcgctagtggtggccgccaccgccgaaaccgtcgacctcctgggccccagttccgcgtccagccccgcggcagcatggactacctgacgacgttcaccgagaagagtgggcgccttctgcggggcacggccaaccgcctgttggggttcgggggcggcggcgaagcccggcaggtgcgcttcgaagattacctgagggagccagcccagggggacctcgggtgcgggtccccgccccaccggcccccggcgccgtccagcccggagggacctggtgagcccacctttctttcgcctcccgcgcggccgacctgggctgagggctgtggggaggcggcggtcgtggcgccgggcgggggtcgctgcccggctctggcaggtgtgcctgggccggggcgggcaacgtggccggggtggcggccgccgggggcgaggaaggaaggactcgttcggctctggggagggaagactttcagctgcgtgccagctcttcctgctctgctcttcctgctttcctcacctagacttgattttctttccccgccaagtatttcaaggggacgatccattctctctttccctcccactgggaggtgaagactgaaccagttatgacgtccgtgttttcagtcttggattcttgaagagcgctgtgcctgctttggttttggtttgggtcagtctttccttaatatttctcagttgttaggattcacttcctaaccgaaaaataaaaagccagatacttctttgtaaaataaaacacttcattaacattggaagctagttgacattttgcgtcgtgtactttttgaacggctgcacgttgtcttgtggtggcagaacctagaaactttctcagttcctgtttattttgtgttgtgttggccgatttttttcaccacagtggctttgtaccattctttaaaacagtcatttgtagcgacatgatattgataacttaaagaatttttgaaagtgctgctgaacagttttagcataatgcatagggtaacttccagtgtccttggcttcgtttaacaggtagcagacatcctagccatgtctgatttttatttttgttaattgctttaatatttgagggttatgaaaataaatgagcattagagagtttagaaaatagagataggcacaaagtgtgtaaaatctgtttataactccacatcgtgccagtcattttattttaaattttatcttactttatttttgtagagatggagtctcgctgtgttgcccaggctggtcttaactcttggcctcaagtgatcctcctgcctaggccttcccaagtgctgggattacaggcctgaaccaccatgctgggccctgccagttgttttaaagcagtaaaacagtgaggacatttttgatctatgtgtgtaggtatgtaatttaagctttgaagaaatattaaagtctcattttagcatagccctttaaaataaattttccttactttacataaaatattttttatctttagaaatgctgtttatggaattaggaaatgaaaaggggaggggaatacttttgtttctgctctgaaggacgttaaccaaatgcagaatcctcttaaaggtgggaccaggcataggaaagggactttaaagtgttcaaatcaaggactttttaaaatgagttttcagtagcctaattgaaaacagttgatgtgtgaccagccttgaaatgggtggagaattcagaaatatgtggggtaacttaactaaaaaggaatatggttagtattttaataaatatggccaaacacgtgtatctgattcattcggtggcccgtgtctgtagttccagctactctgctcaggaggctggggcgggaagatcctttgagcccaggaggagaatccagactgggcagcagagagacacttatgtgtttatatatgtggagcacacagctatatctgacaccctccttcaaagtggcgcttctgaagtgatatgtattcctcttctgttgaagctgccttatgtattcattgcatattctttaatagtcatggtgcccccaaatctctgacacattagagaggcgttgtgaggtcaaagtatgaccacagtcatgtgggcaggtacgtcctagcattaacttcctgaaagaatttggacaagttacttagtgtctttgggcctatattttcttctttgtaaatgaggttggatttggtgatttcaaaattctctattctagagcattttcatttggagcagaattagtgaaaactagctgacttttgagaggcaacgtgtatatacacaagtgaaaaataaatgattcttcatatgtttccagctagcctttgtttaaaatgagaattctgtgctttgcagctgcttctcagatggattttggctctagggttgttctttgtgtttgtgtcctttagaatgagtgtctgtcagtctgtttgaaggatttcttctgctctttctactcttatttcagtttcttaatagctgcttaagtttcctgctatcattctttcttcagttctttaagaagccctgtgtattataggagtatttcttgttacagatactttcacacatgtaaattgactgcattccaggaaaccctttgttgttagtgatcttattcctcctttcatccactaagatgaaaaagtagaaccttgtttctgttccttctcacaacccaacatcggaggagttacgcatcaagaaggggtggagggagtcatgttcagcaatgatgttgataagatagtttcaccattgacagattaaggatagaccagataaaattttggtcaaatgtcagccagttgcggtggctcacgtcggtaatcccagcactttgggaggccgagacgggcggatcacctgaggtcaggagttcgagaccagcctagccaacacggtgaaaccctgtctctactaaaaatacaaaaattagctgggcgtggtggtgcgtgcctgtaatcccagctacccgggaggctgaggcaggagaatcgcttaaacccaggaggcaaggttgcagtgagatcgccctactgcactccagcctgggccacagaacgagactccatctcaaaaataaaacaaaaacaaaaattagccaggcatggtggcacactcctggaatcccagctactcaggagactgaggcaggagaattgcttgaacctgggaggtggaagttgccatgagccaagatcacaccactgcactccagcctgggtgacagagtaagattccatctcaaacaaacaaaccaaaaccaaaaaaaactttggtcaatgtttctgagtttaccctttctataaagaaaccacttactgaactgttaatgtctctccttcctttactcctctccaaggtggctgcttttgctcttaccagcttttagtgcttgctggctccatcattatagccctctcaggaaaaccataattgagacttagacatattaaggacattatcacaccattgatctagttaataacaattacaaaggaaacatcttaaaatacaatgcttgttcctgattaacgggtacattatgctttgattttaaaaaattgttttgaactttaaatatagctcttgtttgggggcataactataactcataatgtataatctttaaaagtactcacttcactagattatattgtaataaatatagataaattttactagtgtagactctcaacttactgtcgtataaacatgaaatcgtttttatcataagcgtcctattatatcaacctcattttcccacttggtgacaggattctttgagcacaactcagcccttttacattttcttttcatttatttttagcaattaaaactatctttcagttatttaagacttggtccatttatttaaaaatttcagtctcatattcaatttatatctccatttacctttctacctcagttcccattccaagttaggttggtagcggagaagaggtgtggtctagctctcacaaactcccctccaccccttcttgatgcattaactcctctgatgttgggatgtgggaaggaatagaagcaggggtccactttttcattttagtcctttttggccccttagtgggaggatgacaatggtggatagcagtagtagcagcagtgatggaacagttctgctaaaatggctactcctatgcagaagtgctgacttcagtagccaacagttctttcaactttgaatctgggacattaacatctggtaataccaaccatagaccttagttgcaaattgttgtactaggcacctaaaactgctctgcctcatagcatatatgttactggtatgtgtgtgtatatcaatagagttgatgaaaaatgaagttaagtgggaatgtattacatttttatgacttgaattatttgacatgtcaaggaaaaactatttaataataatatttttttaaatgattatccctgttgctgaagtttcattttaggtttacattaagcaaatcctatgtactgaatgtatgtaactgaaggagaagcgtttagaagcctgagattgatattcttgttactggttcacttttgataatcatggaaaatgtaaaccaagacatggaataataattataatagacaaaacatatagtgcttgctgtgtcttacgcacaagttaaccctcagcaacaaccctatgaggtaattaatagtagcattttcattttactggtgagggtactgaggttcattaatgatcctgtctagttgggaaaatagacattggacaaagaatttataactgtgttggttattgggcatggaatgtaaaatatattatgggagtatataagaagggtttctaacctaatattggggggtgtaaaatatcatgttttgcttggattgggggtaatgtctatttcagtaaatgggatgatgatgatgatgatgatgatgatgatgatgatgatacttgtagtaataacagaagtagtaatacaggttgagcatcccaaatcagaaagtccaaaatctgaaactttttgagggcctacatgatgctcaaaggaaatgctctttggagcattttggatgtttggatttgggatgctcaatcagtaatgcacatattccaaatccatcctatcctttaggaagattcaaaaaaatccaaaacactcctgttcccaagcatttcagataagtggtactcagcctatagcaagaatgatagctgtaatggggcaggctctgagcaaaagttttttatttaatcctaataaaaacctgatgacatagtactattattatcctattttccttttgaaaaatctgagccaaagaaagaagtgagaaattcagaatttatttgggtgttttcttagtatttgcaagagttacagtccttgagataggggaaaaatgtgagaagaattaaaattctatcatgtaaggtattaaagttaaattagttaagattgtaaaggatagaatggattgtcattgaaggttctttagagttagaaagatagtaaaatgacagagctggaaatgcaaaatccaatgagggtgtgagaaaaattaggtatatattaggttggaaattgccacctcagatgatgtgttaagagttagatgatggtttatcttgaacccaggaggaccaagtgcctctaaggcaggggtccccagccctggtccatggcctgttaggaaccaggatgcacagcgggaggtaagcagcaagcgagccagcattactgcctgagctctgcctcctgttagatcagtggggacattagattctcataggagtgtgaactttattgtgaactgcacatgcaaggtctaatccctgatgatctgaggtggaacagtttcattgagaagccatctctctccccatcccccaccccttgcccacatgtccataatccatagtcttccatgaagcctgtctctggtgccgtaaaggttggggaccactgctttaagagacctggagtgtaccagttgttacagtaactttttaaaacaaccaccaccaccacaaaacaaaaaactcacagtgttggtagaagataaccctagctggccccagttttagtctcttttcctaaagccggatgggaggaagagaatactctctacttgatcggcaacctcagtgggctctagtggtaactcccaactagttagcctttcttaatagtgtatcatttagttcagtggttctcaggcatgaggttgatttgcctgttttagaattgctgcttgtctcacaggatagctgataggaagttctgtattatctatgttgtagaacaaaactgcctctaaaataagctgatgattctcaaacttcagcatgcaacagaatcatctcctgaagggcttgttagaaaaatattgttgaatacctctcctagaatttgtgattctgtgtggctgagaatttgcatttctaacaagttcttaagtaatgctgatgctgctggtctggcaaccacacttttcttagtgggtaagtcttttatccatgggaaggttagaagtaaatatagaaatgatgaaatttattaaatgcttatattaatagttttgttttaagtctaggaataatcagtgtatttggtctttaaggtatttgttctgtttcatagaattaggcctataaaagtggccaacaaattagtcttaagagtataatttaaaatgcatacttgcgtaattgttttttgacttgggattttaagttgaaaggtgcaacaatttggctaaacttagaaaccactggaatgtttaagaacttaacatttattatatttaaaacttagtatagggtttttaatatttttctcaggaggtttacttgttagaagcaatgtgtttaaaatagaatatagtaaatttataaatgcagtttagtatagtaagtcctcctttgacatcatcaataggtttgtggaagttgcaccttttaagcaaaatgatgtgtaaagaaaccaattttaccataagctaattgatgtaaacaagagttaggttcctaccatatatttctggtcacaaaaacattagcaaacttgtaagtaaagacctaaaatacttccattattaaacattgaaataaatgtgaactatgcaaacattaaagaaagattaataaagacaagagaattatttactcagttattccagtcagagtcactgttggctggatcctgtcctgctcatggcacaaggtgggaaccagccctagacgggacaccattccacctcagggcacagtcacacacacacacacgcacacaaacacacacattcatactaggacagtttaaacacactaattaagctaatgtgcacatctttggatgtgggagggaactggagtacctggagaaaacctatacagatgtgggtagaatgtgtaaactccacacagacagtggccttgtctgggaattgattttttgttcttatcaaagttataacaaaacaatgataacaaaacgatgttattcaaggacctgtaatatatgtaagagaacttagttacccatgtttataacaggattatttagggatatttaattttccagtttgagttggtcagctatttaaagcaccttagaaagtgttaaaatttgctagattataaatagaatgcactttttatggtagaagacaagggaaagtaggtttttatatttttaacttcaagaaatctaacattaaaagtaaagtgactgcagatagtgtttttctgtgtgtgaaggcttatttcatggccactaggaaacttacattaggagactctttataaatgttgttcaataggtgatactagtacaaaaaggaatgtgttttagggtcaaatacatacattagagaaaggacaaaaattggcttttattttctagcagtaaatggaaagaaggaaatgtaatcagccataaatcacagtgtccctaggataaagataaacctgttgcttaggcagccaggagaaacacagttattccttatagtgagaatataacaaaaaaaaaactcatggaactctgtaataaagcaaaacaaaccaaaaagcttatttttatggtaagtacagacttcagtttcaaaaatctatttttaatttttttaaacccattaaatctttaatgtagttcaatggtgtagctctaaactgcaagttagtaaaagcacttctgtacaaggggaaaacaattaatccaaatatgcagttatctaacagtccatcttaactgagaggtaggttttacattttaaactatagattttagatagttacgactctctgttttggatttttttgagagtactactcaatagaattttttgaggtgatgaaaatggtctgtatctgtgatggccagtatggtagccactaggcaaatatggctattgagtatctgaattgcagctaatgcaaatgaggaactggattgagaaaattggattcaggattctgtatttgctctatctaatatggtagcaactagtgttaaaggaaaaattatttgataatacttcctaaagcacaataagacagactttattcaggaccattgcaatagggatagggactgtggcaatgagattttgtagttgaggagagagattgggctcaactccaaatacaaaatgggcaagtgggaatttctagccaaggagtagagtaaggatagatggatggacaattgctaagaggtaacgtcaggaataaggggtattatggtgaaactgacctaccaggattcttgctgaaggcaggccagagtaatcagacttcacctggacagtggaggatgagaaaactgatcagatacggaaggtaatcagatatccaggatcggggtgggggttcctgctacactgaccttaacatgattcttgctgaaactcggttttataaggaagtgaacagattggcataggagaaggttcagcagcctgactaaaatttggctatgcaaataatctttgtgactaggcacatgtagctattttaatgtaaattaatttaattaagtaaaactttaaattcagttttcagtctcactagagacatttcaagtactcacaagacagatggctagtggctaccatattatacaaggcagatataaaacatttttaccattgcagaaagttttattgggcagcattgatagcaatgagtcccaatgcagggtacacattagaattccctgggtagccatgaaaaaattttgatgccaagatctgattataatcaaagatttgatcttgaaatctctgtttaagatctccacttacagtttcttacggaattctaatatgtaactagggttaaaaaccactgacttaggatgtgaaggactctacatcattctgttttccttaatgatatttctctcaatcaaactcttgctgaatttagcaggttattatttatttatttttctttacaagtacttggggcatgcacctattttatgatgcaagttaataaaagaaatgcatgtttaagttttctgccaacctctggatagtattgagaccttaggaaagttgaggtgacttacaatgaaaagttcctaaaaggaagacatgtttgtatgctgagagaaagatgctgaagataaaatgactgtgtggcaaggtccttgtggaataaataaactactggaattatgatcattcttttttcacatgccacaattaagagccattaatattgtggaatatttgcttccagtcttttatacgaaattaatttttaaaataaacctgatatatactatatataaataagtcatatgttgcaaatactgaactttaaaaatcacctctaatccagtcacccagagatactgttaatatttgggtaggcattactgccaagtaatgtacatcacttctatgtgtatgtacatatagaaggatggatgggtggttagaaggagggagtgacagaatgaaagataatacttattcaccacaagaggttaattcctaaggggtgtgtctaaatttaagcaaattctaaaaaaaaaaaaaagaaaaaaaattacagatactgttattacaatcttgtttcagttttaggtgggatatatttaaccatgctttggtatgacattagcagtttcatttctcatttttctcctcctcacatcctaatatttactcattttactatttttacattgtccatgtttgtaacattcatacttagtttttcaaccacttttttataacttattattgttctatattctctagtaaccttttagaatgtcctccttgattctggagtttttgatacaattggcataatttcagtcttatagcactgagtaatgtttcagtagagaagtctcatgcaagccagccagattcttttccatttcccctagtagatgatttgctttttatgcatgaattgttgaataattttttaagctcccaagcataataatttaactaagagtagaaatgggaatagcctgactcatgtgcccacatgtgtctatgtggaataatcttttaggaattacacctttcttctggaatacatgttgatggagcagccactatatggaagatctctggttttgagatagaaaagagagctaagaagtacaattttggctccaaacacttccacctggaagacatatatggttcattgggcaaagcaagttggccatgtctgacatcaataggatggtgaggtatattttatattcctcaacaggaaggaatacaggcttagtaacaataatatagtctatcaccatgactaatttagaaaccattatattagtttgacagatttgaaaactgctggtgttaactgtcacaaatatgaagttatgtagggaagcccatttcttctgtcacttacgcagtctgcaggtctttgatctcttcagaagctctatttgtatgtctctcaaatgtgttgtgcgtgcaaatcaatagtaaatctgtaggtccggactgagcctcagatcttacattcacagtaagcttctgggtgatgtcaatgcagctggtccctggaacacacttttaaatagcaaggctctatagctctttaatatcatggatcttttcacttagaagagagccaactttaaggtctagatggaggaaaaggggcagtaaaaaggaacattaatgggtatgagaccaagaggagtgtgaaatactttcaaataaagggaaagaggaacatgcagaagaagtctcttggatgtttcacagagatcagataaaaaaaaagtggaaaagcccatcaaatttgccatttaatttattcattttagggtggggattgtgaactggggaagagaagatattacaatacattgtggattctgtaggagataatggagtaaagacagtaaaagtagatttctactttcaaaaattcaactgaaaagaagcagaaagatggagtagtatctagaaaaagatagatactagatttgagggaaaattgaggggttttgttttgtttttgttttgatcgtggataaggagtcaatagtgaaatgttgaaaatacaggtttttttccctagtatctcattattgagagaattattagaaaagctacaatcagcaatctgttttttttttagtttagaagatacttttaaagtgtttgaagttttagtatctatattactgtttttgaaaatactgacttgcagctcaatgttttaaatagtcaaactttttatacatagctattatcaatattgtaatattcagttattataggagtcttttattacattaaacctgatctcatagtacgttcattgatgatttccagactttctacagcatacctttccatttctttaccaaaatgatttttttaaaggttttatactgctctgttaattctctgcttgaaagtccttcaggagttctgagtctagtaatagcaagctaggtaattcagactatcctgctgagaacaatttaaaaagctggacacaaagcaaacattttattaagggtatcagaaagctaagtggtatgggtaggataggatctgaatgaggacaaaggtctaaggagggagaactccaatttgattgctttttaccccaggggtagtgttgattcctgaaacaggaactgagagaccaaaaggtgcatttgacaggctgtgggtataatggaaccgggccagagtgcaaggcctgtcacaggggatgggtggccctagtgatctcttctcactttggaccccaaaatgttgtacattagggagaaagataaactgaagtagctaggcctccctaggaagatacttcaacttcaaattatcaaaatttctgtaacttaattaataagatctggtattactagtgtcctcaggcacttgacagaagcaaacattaattctttctggagaattaccagtttctacatgtaaaaatgttttgtcagacgattttgcaaattttatgttctgcacacaaaataggcacatgacaagatatgtgacacaatagagaatagaaacaggcccacggtaactctagatattctagttatcagatttaaaatagctatgttgagaattttgacctgattaagaattttgtagaaagttacaaactatgagaaagaaaaatggatattctagaagtgaaaaatacaacccctctaattaggacctttgtagatggatttagcagcaaattagacaccgcagaggaaagaattccctaactgaaaggtaagtcaaaagggaatgttcagagtaaacaggaaagaggaaaatataggagaaggtaagttcaatacaagatacagtgagaagttctaatatgtatgtacatatacatatgaatcctgaaagtagatgagagatagaatgggcaaaagcattatttaaagagagaatggctggccaacatggggaaaccctgtctctactaaaaatataaaaatcaggcgtggtggtgcgtgcctgtagtcccagctatttgggaggctgaggcacaagaattgcttgaacctggcaggcagaggttatagtgagccaaaattgcacctctgcactccagcctgggtgacagagtgagactctgtctcaaaaaaaaaaaaaaaaaaagaatggctgaaaacgtccaaactaaagaaaaactttaattcagattcaagcatccctatcaacctctagtggaaaccacaccaaaggcaaaaaaaaaaaaaaggaaaaaatagtgtttctaccttcaatcatacagcattaagatggacattgatttctcaacagacacagtaaaaactaaaaaactgggaacctatagatttaaaatgttaaaagaaagtacctgccacctagaattctgtgacctgtgaaatttcccagagatacaataataatcataaatatgagagcaaaactaaatcaaccttgactatcttaaaaataatgttttttaaatacgcatgtattcagcgtgtaaaactgtttcatatatcttggcagtggcagacagtttttaacatccttgcattgtctgggaagaggataaaagtaccagttaatattaggctgtgagcatatgtttattgcagcactattcacaatagcaaagacttggaaccaacccgaatgtccatcagtgatagactggattaagaaaatgtggcacatatacaccgtggaatattatgcagccataaaaaatgatgagttcatgtcctttgcagggacatggatgaagctggaaaccatcattctcagcaaactatcacaaggacagaaaaccaaacactgcatgttctcactcataggtgggaattgaagaacgagaacacttggacacaggaaggggaacatcacacaccagggcctgtcgtggggtggggggaggggggagggatagcattaggagatatacctaattgtaaatgacgagttaatgagtgcagcacaccaacatggcacatggatacatatgtaacaaacctgcatgttgtgcacatgtaccctagaacttaaagtataataataataataataataataataataataataataataaaaggctgtgaggagtcagtaattcagactttttatctctgggatgaccactaaaagaattgtttaaaaaaatgtgtaactttcagatatgtggggaaaaaccggagttaataaatactgaatccaaggaaggcaacaaaggagagaagtctaaaagaacaggtagacagatagaaaatagaacaaatagtgctgggcacagtggctcatgcctgtaattccaacactttgggaggccaaagtgagtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagagagaaaagaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccctcctgccaccttgtaaagaaggtgccttgcttccccctttgctttctgctatgattgtaaatttcctgaggcctctccacccatgcagaactgtgagttagttaaacctctttcctttctaaattacccagtcttgggcaattctttatagcagtgtgagaacagactaatacagtaaattggaactacaaagtggggtactgctataaagatacccaaaaatgtggaagcgactttggaactgggtaacaggcagaggttggaacagtttggagggctcagaagaagacaggaagatgtgggaaagtttggaacttcctagaaacttgtcgaatggctttgaccaaaatgctgatagtgataatggtaaatgaagtccaggctgaggtggtctcagatggagatgaggaatttgttgggaactggaataaagttggctcttgctatgctttacaaagagactggtagcattttgcccctgccctagagatatatagaacgtgagagagatgaaatagggtatctagcagaagaaatttctaagcagcaaagtgttcaagaggtgacctgggtgaccgtaaaatcagtcagttttatggattcacaaagagatggtttggatttgaagcttatgtttaaatgggaagcagagctaaaaagtttggacaacttgcagcctgacaatgcaatagaaaagaaaaacctgtttctgaggagaaattcaagccagctgcagatacttacttaagtaacgaggagacaaatgttaatcaccaagacaatgggtaaaatgtttccagggcatgtcagagaccttcgtggttgcccttcccatcacaggcctggagacttaggaagaaaaaaatggtttcatgggccagacccagggccttgctgttctgtgcagtttcaggacacagtgccctgaatcccagctgtggctaaaaagggccaacatacagcccaggccatttatttagaggatacaagtcctaagccttggcggtttacgtgcggtggtgtgcctgtgggtgcccagaactcatgaattgaggtttgggaacctctgtctagatttcagaggatgtatgcaaacacctggatgtccagacagaagtttgctgtaggggtggagccctcttggagaacctttgctagggcagtgcagaagtgaaatgtggggtcagagcccccacctagagtctctactggggccctgcccagtggagctgtgagaagaggcctaccttcctccagacctcagaatggtaaatccactgacagcttgcactgtgcacctggaaaagttgtaggcactcaatgccagctagcgaaagcagctgggagaggggctgtaccctgccaagccacaggggtggaactgctcaaggccatgggagctcacctcttgcatcagtgtgacctggatgtgagacatggagtcaaaggagattattttgaaactttaagatttaatgactgccctgccagattttggacttgcgtgggacctgtagtccctttggtttgcctaatttctaccatttggaacagagacatttacccaatgtctgtacccacattgtgtcttggaagtaactaacttgcttttgattttacaggcttataggcagaaggaacttgccttgtctcgggtaagactttggacttggattttagggttaatgctggagtgaattaagactttgggagactgttgggaaggcatgattggctttgaaatgtgaaagggacatgaaatttgggaggggccaggggcagaatgatatggtttggctttgtgtccccacccaaatctcatcttgaaatattatccccatactctccctgagttaagggagaaaccaggtggaggtaattggatcatgggggtggtttccctaatgctgttcttgtgatagtgagttctcatgagatgtgatggttttataagtgtttggtagttcctcctgagttcattcttcctcatgctgccttgtgaaaaaggtgcctggttcccctttgccttccgctatgacttaagctgaggcctccccagccatgtggaactgtcagtcaattaaacctctttcctttctaaattatccagtcttgagcagttctttatagcagtgtgagaacagactaatacataaggatacagaaatgttgagagtagaaagaaaaagcagaaactaatgaaaagagaattggtacattaatattagacaaagaatactttatggaaacagtattctgagaaaaagtttaattttccaggaagatataattttcgatttgtatgagcctaataacatggtcccaatgtataaaaagcaaagtagggagacctactgggaaccaaataacccataatttagagtgagagatattaacaacctccattggtaacagaataatcagacaaaaacaaatcaatacaaatatacagaatttgactaacacagtccacaaacttgacctcatggatatgtaaatacatgtgtgtgcatgtatgcatacacatatataaaacactaaaccctgcagtgcagagtatacattattttcaagcatatatggggcatttacaaaatttatacatcttataagtttccctcttaacactatcttagctgtgtcccagagattctggtatgttatatctttgttcttattagttgcaaagaacttcttgatttctgccttaatttcattatttacccaaaagtcattcaggagcagattattcagtttccatgtaattgtatagttttgagtgaatttcttagtctaatttttctaatttgattttgctgtggtccaagagactgtttgctatgattttagtccttttgcatttgttgaggagtgttttacttctgaatacgtgatcagttttagagtatgtgccatgtgacaatgtatattctgttgtttttgggtggagagttctgtagagattaggtccatttgctccagtgctgagttctggtcttaaatatctttgttaattttctgtctcagtgatctgtctaatattgtcagtggggtgttaaagtctctgagtattatcgtttgggagtataagtctctttgtaggtctctaagaacttgctttatgaatctgagtgctcctgtgttgtgtgcatatatatatctaggatagttagatcttacgaattgaaccctttagcattatgtaatgcccttctttgtcttttttgatctttgttggtttaaagtcttagtttaaaactagatttaaatcctagttttgtcagaaactagaattgcaacctctgcttttttctgttttccatttgattggcggatttttctgcgtacctttattttgagcctatgtctgtcattgcatgtgagatggatctcttgaaggcagcatatcaatgttcttggtgtcttatccagcttgccactccgtcttttcattgggacatttagcccacttacatttaaggttagtattgttatgtgtggattttatcctgtcatgatgttagctggttattttgcaggcttgtgtatgtgatggttttataatgtccctggtctgtgtacttcattgtgtttttgtagtgtctggtaatggtctttcctttccatattttagggttcttttaaggcagttctgatgctaaccagtactcttggcatttgctcttatggaaaggatcttatttctccttcccttatatagcttagtttggccagatgtgaaattctgggttggaattttttttaagaatgatgaatattggccctcaatctcttctggcttgtagggtttcagctgagaggtctgctgttagtctgatggacttccctttgtaggtgacctggcctttttctctagctgctctcaaatgttgtgattatttgattgtactttcatattgatggaagaaaacaaatagtttattttatgtgctttggtatttagatctgtgaataaacattttaatattaattattaaaatttagaactgtttttataatatgtaattattgcataatattttataatttttaattagtaaagagaatattttccatttgtttttcaaactttaaagtgtagaaagttagtacattagttttcttgccctgaactgcattctgtggtgagcttttgaaaattacagagcaattgcaaacttgcaaacatgtttaatgaattattgggatattatgaaacacagatcgaaaagctattaggcaaagtaaatacaaactaacggttactcctaaaatcaattaaggaagggtatattattagttaaaggtaatctgtaattgtatattgcattgcttgagaagtttaaattgcaagtttaatttgctattcaaagaaatcatttaaaaattatttaaaacataaattattcaaaaataaatcgaattttattttaatacattttcagttgtttaaaataaaaataaattctttaaaacttattttatcttaaaatagttttaatgtttgcattttctcattagagaagcaaatttaaatataaactattcagtgtagaagaattagaatactttgataagcaaaaataatattctttataaaaattctaccatattgcattgccaccaggaatgcagaagaatatctcatttcctactgtcaaacagtatgtgaccaaacttcttttgagtttttaccaacccgataggtgtgaaatgatatttcagtatagtttaaatttgcatttatctaattatgagtgagattgaacaacattattacatgtttaaggacatttttacatcctcttgtgaattgtctgattatatcttttgtgcatattttcacctgcattattttttccctagtttttaagagttctttaaatatttaggatacaaaagtagaatatgtgtatgtatgcgcacgcgtgtgtgtgtgtgtgtatctctgcatactatttttcctagagttgtaatggatgaaccataattctttctctacttttctttatggaaaattaatggcagttcataatagttttggtagttcaaagtatagttcaagttgttgcttcagaacattactttattagatgcttgccatgtgtcaggcccctagttaggcactgaggaggctttgtggaagaaaggcaatgttttggaggttacaatttagtggaagggatttaaacccaaatattaacttaacactgtgtcagatgctgtgaaggagacataaagatgctatgtgactaataacagggacttgggttagctgggtgatcaggaaggttttaggatagttttttaaagcattgcagaggtaattgtcctttttggggattttgatattattattattttttagtgcttgtttagaaccattcacccgacagctgagatgattaggtcaacataaactcttgtatggtcaaaatgccatttaagtttagatagagggagaacaatgaaatagatattttctagattatatggtcttaggttgaaccataaattttctttgaaaactatagtttttaattttggtaaattttgagggtaaagtaaatgtagcattttgccatgtttactatcttatttaattttgtgatttatttagttttttagatttcattttaataatttttatgtttaggtaggagtggtgttttattaattcagtgttgttattacatgaagtatagatgaaaaggttaacactaatacaaaatttaaagggaagcagtttcgctaatcttgatgataatgaaacattcaaggaagtcttgataagcaaatgaaaaatattaataattggcattcaatctgaaagtaaatgttcaaatgtatgtttctatatgaaagcacaccttgatttacttcatggcatgttaatatgaaagttcataatttaatcccatagagaagactatttttcattatgacttgtagaaaaattttttcctgtgagaactaatgttacaatttcttatttggaaaataatgatatatatcttgaaagatgtattttaaaaatatataatgtatcttaaaatgtgttggtattataatcaggttaaatctgttgaaataaattgtaatttagtttttaatgacttcctttctgttgacaattatgttttgcgttgacttgcaattattctattggttcatactagttaagttcctaaagcaagcaagtaggaagttcagttccttttttttgacagttgcttgatttttacagcagagcatcccagggagtaagctgtattactagtaaattagacatctgcccaaagagctctattcagtagtccttgacattactctgaaagaaagatgaatttaataggaattttgcctttttttcccagacactggccaaaagaagaccctagacaagaaagatggaagacgaatgtcttttcagaaacctaaagggactattgagtatactgtaagttatttgctttcgaaaaagctatttttctttgtaagagtcttctttaagacattctctgtttatactataaataagacaagcattgttaattgccttatttttaaaaatctgtatttcactttggataattgttttattttttagttgttgtttttttctttaaagagaaattttactgagatataaaggtagttatcctagaaaatttaatttaatatagatgatagtttactgagagagttcccatgggccaataatttttattaggttaggcttttaggaaaatttttagttctttagaaatgtgatcttcattatattcgcagcagtgctagtgatagttataatggcagatgggatacataaaagaaaagttgatattaatcttccagtataaccttccacattaaatcatttgtatttatttatagctaactccctttagctctaaacattgagcttttttttttttttctgtattcttgaaatgaacttcaaatcttcctgcagtcagctggcttttcacatttctggttactctgggaaactgaagtgagaaatcagctttggtatatggtatgctgcatatttgattgaatgtaaagattgtttatttggataatgttaacgtgttgtaaagcacttttaactgagcttaattttgttattctgtgtttttctaacataactgtattaaggagaacagcaattttaaacattaatttagcatttgtatcattatgaaaccgtccagtcttggtttgactcttattttccatgcatctttaaaattgaacaaattatcaaaattctaatttatactctattttgatataccattcatatatagcggacagtgtgagattttaaatatttttaaaaggaatcagataatttaggatgaaataaaatttactaatatcaagataatctcacagcatattttaaactcaaattgcgtgtgtttgtaccttctctgcataattgagaaaataagttcaaataagttttttataggtaacctttaaaatttcttcgtctttacaattctgcagtgccaatatgaaaaatttagatatatacatgtttttatcatgtttattgtgtttcttcagcctaagaaatcatgtcactcataaattctagaaaaattcttggtaattatctttgattgccattttctcctccttcctctattttgtttctccagaactctaattttttattgaaactaattgtactacattttgctatcattatgctttgttgaccttgctattattttgattgtatcttctgtctgctttgctgggtgtttgcctcttcttaattcccaatgtgagtggtcccttgtttctttttgcttttctattgacattctattacttggagtgcttaagaactttataaactacgtggagtgagacccaaactttttttctatccctccctttctagttgcttgcatttcctactatcacttcatactaaacaaattatggaagcctcttaccaattcttcttcctccatccttccacaattcctgattttctcatttccgttccctttcagtttgttattcattcaggttgcagtctttagagtcagcatcagtttgctcattcacatttgcttccctgacctactgctactgctgtcaccacaactccattcaatccatgaatgtcttctcttgagtcttagttgaaatcttgtaccttaatttctttctttacatttttattactttaaaccttatctttgtttttctgcatcctttctctttcttgttccagtaatcctagccctgatgccagtaatatgagatgccacttgggctgttttgttaccttcatcatctcatttaatagaatcactgtgagaataaaatgtgttattattaattatgaaagtacttggtaaacttacagattttactgcaaaatatcatttgtttacagagaccttttatatatattatctcggtaacataggttttatatcagtacattgtgtagatggggaagtttgcatagaaggatgtaggcagaactagattattattgtattaacccaaatatttggcataaatttggttttataaaaccattaaggaaaatatgtatattattgttttacatacacaaacaaatgcacacgcacctgcttttcctgacttttgaaatcttctataacctaattctaaatgcctctttttttattttattttattttgttttctggagacagggtcttgctttgtcgcccaggctggggtgcagtggtgctatcacagctcactgcagcctcaacttcccaggctcaagtgatcctcccacctcagcttcctgagtagctgggactacaggcatgcatcaccacgcccagctaatttttgtattttttgtcaagatgggattttgccatgttgtccaagctggtcttggactcctgggctcaagtgatccacctgcctcagccttccaaaatgctggaattacaggcatgacccaccatgtctgacctctgaatgcctctttatcgtttttagagacttaactccatgtaatcaccttcccaaaaatttgtgcttcatgagtctactctggatggtttaggaggaagaggacagtatcccacaaatatgttatgcttttctgtctcttaactatgtcagttctgttatcttcactttgaaagttcattcctttctctctacttttcaaattcccaacccttcttcaaggcccagctttaaatcatttcttttctgtagtcttttctggaaaatttggattacatggtgcttttattcatactcaaaacttctattgcattcattattccattttaaattgttcatcttttgcataaccttttctatcttagtttccaactagattgtaaattccttgtgcaaaatgacttttagttgcacttatttgtgttttcttcagagctctctctttttttttttttttttttttgagacagagtctcgccctgtcgcccagactggagtgcagtggcgcaatctcggctcactgcaagctcggcctcctgggttcacgccattctcctgcctcagcctcccgagtagctgggactacaggcgccgccaccacactctgctcatttttttttttttttaatagagacggggtttcaccgtgttagccaggatgttctcgatctcctgacctcgtgatccacctgcctcggcctctcaaagtgctgggattacaggtgtgagccaccgtgcccggccttctttagagcgctcttaatgccttgtgtaatggggactttaagtggttatattatattggccaagtgacattttcttttagggtaattgatgaaatctcattatttatgatttctacacatatgatcatggaaacgtacgaatgattcagaactaaataactcaactttagttcaaatatttttctaatttatatgtgcaatgacagaatatatgcataaagatcattttgagtttaatacaggtgtactttgcaaaaatgaaattagtatgttgctagaagtcacatatattttagaaactattcaaaggaatagtgtattattttaaaacctttgtaaaatgaaaataatcagtttttgacttttaaattatgttttgtattttgaaattacttgaagtagagacctacatgtaaatgtattgtgatgaagcctttactctgtattgtaatagattaagagcatttgctaacaaaacacagtgtttcttgacagttattttcaaagatgacaataccagttgttaatcaaatgtaagctggtccctagatatattaatgctcattaaatattatagtttagtttttctgttttaaacattgaaataatttattttttcttttaaacaggttgaatcaagggattctttgaatagcatagccctgaagtttgatacaacacctaacgaacttgttcaattaaataagttattctcccgagcagttgttactggacaggtagtatcttttttttaatgtgctgatgtttagaaacattaaacagaaaggcagaaagtatttattgtactgtagttaataatatagaaaatttgagaataattttatatgtgcttttaacaaatcatattggccatgtaagagaaaattaactgttttatgtctgtattagtttcttttttaatacatattgaaaataattgtagatttttctttttaaatatagttacaaagagctttttaaaatattcagaacaatatatgcatatgataaaaaattactttatcaaagtaaggcatccctccatctcaaactttcagtttcttttccagaagcaaccagttggcagtttgcatttctttcaggaataatctagcctacttttgttgttgttgttgtgttttaatttaactttgattcttggaaagtgttgtatttaatcacagttctagttcagactttttcacgcgtgcatggtattacattgtattgatatatcatacttatttaaagcattagactatttctactcttttgctaaggtcaatagtgctgtagtaaacatgcctgtacacatctgtttttctttaaatgtaagtatttctgtagggtgaattcttagaagtaaagttactatatcagaggatatgtgcactttaaattttgctagctattgccaaattgtcctttaggagtgacacctctatagtgtatgacaattaatgtttcctcaccctattccagccgtatatattatcaaatgtgtctaaactgattttaaaggttcttttttaaaaatgtttttatattcttataatttgaaaatttttatgtttttctgtttaattggtaattgttaatagtgcttgcttatagaacaccatctaattattaacacttcattttaactaaatctttgtgtgaatgttttcttacaggttctgtatgttcctgatcctgaatatgtctccagtgttgagagctctccatctctaagccccgtaagtcctctgtcaccaacatcatctgaggctgaatttgataagaccactgtaagtatctctgctttgcaaagatggcgatgaagaaatctcactttgtctacattgactgtcttgttttttacattccattttgactatggttagaatgaaatatttcctttttattttgttgcttaagtttgtaaatcccagctttaaaaataagacattcttatgaaaccatatagcttaaattgacttacctttgtaggtggtggttgtgggccaaaaatattcatcaactcttattttttaaagaacatatataatttaacttacaaaggaatcttacccaaaaaacatgacattatcacagtagaggaagttcatgtccaatttgatgtttatttcatctataaataaatgagtatatagtacttagaactcttgagtttaattttgacacattgccttttaaaaaataatttatcatcttagtcatccaagaattgacatagtagattaatttatctagcatttctaaggaatgagtgttctaataacttacattttacaaatgaacttcagggaactaaacttcatttaataattttgattaaaatcttctgaaaggaattatatattatatatttctttgcctttcatagaataaattacatgatattattaataactatttttctccttgcctgggaacttttttctgcatgtgtgtgtgtttgtgtgtgtgagaaagagagagagaaatgaggcctttttcatttatttgatggatatcttctttatataattatggcaatactatgctttagaatgcagtcacatgaaaggaatatattacatttgttgtcatcattgataagaataaaagtcaggttttaatggtaggtattacttaccaaatgacacaatacctttttgaacatagccatgccattttcccatgggacttacaaagagatgtactcataaggggcaatgacaaagtaactacgtagccttaggttaatttagcctgtgtttcaaaccctaaagcagaatgatgaaaatctaagctgtagcatcatgcctgactagaaacctgtggggtctcttcctgttcctcggctttaacctaaatctgcctgtctactggctttcttggaaggtataagatcaaagaaaacaaaatgttgaaagttaagggagcaacaaggccaggcctcaacctgtgtgaaaatgtaccccttcttacttttgccatttgactgaaagagatggagaggataaagttatgtgaatgatcttttaatcctcagtgacttagctactgtcaaagatggaccaaaaaacttcctgtaatttggccagtgatatgagtaaattctttgtccctgggatagattaaaaaaaaaaaaaagaggtgagagattccttaaagaactaaaagtacacctaccatttgatccagcaatctcactactaggtatctaccccgaggaaaagaagtcattatataaaaaagatacttgcacatgcgtatatagcagcataatttgcaattgcaaaaatagggaaccaccccaaatgcccatcaatcaacaagtggataaggaaaatgtggtatatatataccgtggaatactactcagtcataaaaaggaatgaaagaatggcatttgcagcaacctggatggaattggagactcttattctaagtgaagtaactcaggaatggaaaactaaacatcgcacgtactcacccataagtgggagctaagctatgaggatgcaaaggcataagaatgatatagtggactttggggactcaggcaaaagggtgggagcagggtgagaagtaaaggattacacattgggtacagtgtacactgcttaggtgatgggtgcaccaaaatctcagaaatcaccactaaagaacttactcctgtaaccagacacacctgctccctgaaaacatattgaaatggaaaataattaaaaaaaaaaaaaaaagaggtaagagaagagtttgtaaacttctctttacatggaatgatactctttacctgccatcaaagagattatgggcaatagttagaaataattcttacaacagttgattgtgtaaattttagttgtattttttttacctaggattatattcattaccaggctccaggataatatttctatgactttctgcatatctcaagtgcctatatttctatatttctaattattgggttttatgtctcccatgctgtataaatcccttagaaataaggatattatgttttattagatatagtttacattttcattacactaattaaaataatgtctattagtattgttattatatgtttttcccagaaattgtcagtttatattaccagcaaccactgataaattttttgaatgtccagcttagtagtggtttactatgaagctaaaaatatgttcctggctttgtcggcataaagactttcattggtaataattcgttttcacttaaaaatattgcattttgagaatttccatggaaaactattttttctttatttttcacttttttttgttcacatatggaggaagaaatatagaaggagatagaaccaaagtaatggtaaaaatcataaaaatagctaaaatgtagtattgcaacaggtataattctaagcactttaaaagtattatttatttcttatctcaaatttatgaggtaggcacttggcctgggtttctgtgtttgtccctccagacttactctgtattctctagtgtcctttgggtggtagactgcatcagtgcactctctcttgcccttttgcttctgttggtggttttctttctggagcagttgcagaagataagggggaaggaaagagagaataagatggggacatatttattctcctagctccttccctgtaaggttactccagagtgaccacattcttcagcatctcatcttatcttttgtcagccctttccacagagccatctctaaatttaggtatctgtttctcccccttacctctttagggatagaggagtcttctgttattgttcaccctgggtttttgtacaccatatgtacctttgtaaatagttccataattaaatcctcttaaaattattcagtttctaccgggcatagtggctcacgctggtaatcccagcactttgggaggccgaggcaggcagatcacttgaggtcaggagttcaagattagagcggccaacatggtgaaacccatctttactaaaaatacaaaaattagccgggtgtggtggcgggcacttgtaattccagccactcaggaggctgaggtgggagaatcacgtgaacccaggagtcgggggttgcagtgagccacgccactgcccttcagcctgggttacagagtgagactctgtctcaaaaaaaaaaaaaagctcagtttgatgtgccatctgttttttctagtacctgaccaataagtattgtatccattttatagaggaggaaacagaggaagagaagttaattattttgtgtttaaggtcactcagctagtagctaagctaagattctaacccagatgggcttggttcggagcccatattttttattactactttatagctggaaaatgataactcagaaacactactcttgcccaataaataattggacccaaagagttaagtaatatttaatcattataaaagtcgatatagtaatagctaccatttcgcactatcatcttcctaagattctttaaatctctcattttttgaataaatatagaaacctgcttttgttttgtacacctttggtttttctcctttgtactgtaagttcacccattatgctaatgccattttagggtaaaactgttaatgtgttatattcaggatgaagttcagtggaaaaatgtttaaaataagtaatatgaaaaaacgaaataattttaaagtacttatgtttatattaatatactctattgaagggtgggatatgcagatagtcatattctctttaagataaaacatggtataatactctaatcaatctaaaatatgataaaaatagaatattaataacacttgaattggatacacatgatgataagacaatataattttgaaaaaaaaatacttttaagagattctgaggaaggcctaggaagtcctaaaggaggaaagaggaaaaagtataaaatagcaatagaatgtaggcatattaaatcttcctttttaaggataggctgtgattatactgctacagtagctattgtttttttacttaaagagtgcttactatgtatttactgtgttcatttcagaattttaatctttaacactttaataacattttaattactttagacttttaattaatctttaaccccatgaggtaggtacaataatcatgatctgtatttttaaaaatgaggaaagtaaggcatagagagaagaatgatggttagtaagtggtagaactgagactgaaaacctggcagtcaaggtctagattctgtgttgtgttcttaactactttttgtactgcctaagtaatgaaatgatgactactagcaagtgcaggtactctataactgagacatatgatctaaattaaatatatgtgtcacaatttataggaactaggaagtttgtagtaaagaactgtgtggaagtaatgcatgaaatttttgcttggccaaagcaaaaataaaaatgtagaagatttagaaatgttctttaattacctatattagtttcctagtattatcataacaaagggtgacaaattgggtgggttacaacaaaagaaatttattaccatacagttttggaggctggaagtctgaattcagactattggtacgaccatgctccttttgaaacttgtagaggagaatcatttcttgcctcttctaactggtgtttgccaagtatcattggcattccttatcttgtaaatatatcaccactttctgccttccttgtgacaagtggccatctacttcctgtatgtatgtcttcacatggtggtctcttctttatataaggaaaacagtcagattaagggcccaccctactcatgtatgaccttaccttaaattaataattacatctgaaaaatcctattttcaaataaggtcacattctgagatactggaggttagggctttaacattatcattttgggggagacagtcaaaccataacattgcctcataaaattataattatagagaatttatattatggagctttatttatattctagaattttatattttttgtctttgaaggaaaggggaaatttagaaaactttctaattctagtcaagtaagattttctaagagatgtttagttaattttcttcatttaagatatgttgaagggttaagttaatttctcatagggttttgggaagcttgtgaatatttgtaaaatattgtgaaaacttttttaaaaacgtctcttttttaatcatgatagtcacataattaattggcatcttgaagtggtatgcctgtatacctgaaaatagacattaattacaagtaatagcagacatgcaagaaattaaaacaattttagttaggaatatcaaagtagtttgaaaaggttaaatatcgcctgtgcttcaggaattgctttcacatatgacatcctttaacaattcacaaacataacctctcttttctctctgtgcatatatagaatatatattttttaacttaaaattaaagacactaatatctatcatatacaatattatatgttatatataaaacatgttttatctcttttatagaatatataaatcgtaattttttctaaattatgattttaacttcaatgcttttagacttcaatgttaatataaatatatacaacttatgtgatatataacttatatattaaatgtaagcttatgtattataataaaactataaatatcaataccactcaaatgtgtaaataacacataaatcatatatactacattcatattattacatataatttagctttgatgcttttaaacctattttaaataacaacttagtaaggaattgttttttaatatgtactttttaatagattatactgtaattatacctcggtcttatattcttagaacaaaattttatggttagtatctgaaaaattaaactttataataggacttagtgtttgcgaagattttaggaaacaaatattttatatagaagaaatccctgtatttttaacatcacaagaaatgggtaaattactagatgagagtttttttttttttcctagattccagatggaaacattatttccataattagaattaaaaattgatcccgatattttaattttattattttattctgtatttgattttaaacattcttaagttcttggtcccaggaagtagagattattgaacataatttatagacagtaaatggcaatcatcgtatatattggattgaaagaaaaatacagcatacactgcttcaaaagtaaatgttttctttaaaggatatatagtatatacgttgcatgaagtaaatacaaatgttggtatttctgtgcctgtatggattttcctcctcaatcttcctttgccctacctatgtgttactagagaacatttctacaaattttcaatcgcaaaagaggaaaaatacaataaagccaaggcaagaagggaagtggacagtttggagttgctaattcatttatggtaatggtttataataacatacaaatcatattgtataatatattctacaaaaaaagataactctaggtgattattaaactttttgtaaatcatttgccctagcaatgctttgcttttttacatttgaatatttggggcaataatgaggctagatagatagatatagatgtttatatttctatatttttaaggaccttctctggtggctaaaacaaaattatgcagggaagcatcagcaagccatcaaatgagctgcaaaaccacctcattaataatcacagtttaaaaatagcattcaaaaccatctacatagagatactaatactttgaatagtgtacatttatgtaagttacggtgaggtctggtaattcctctgaacaactttgatcttttttgaaagtaatctccttttttgtgctttgctttgagcatttgctaatctcatattctttttaaaagaattacattgacaaattggtattgctatagatactgagttcagactttcaggtaacctcagagatcatatattgttcaaaaaggcatatcttcatttaaggaaagcatatgacaatgtgcacatatatatacatatatatatatatatatatatacacacacatatatttatatttgtgtgtgactaatgcggttaactcagttttgggggaattgaggaatcacaaaatttgttgatagctttttgccagtttgcaggggaccctcttatagctctgcatcagctatttttttcttagcatatttttgagttgtttggtagaagatttgaaagggaagcgatacaatattacagttaagctcactggtttgtgtgttgataacataggtttgcatcttagctccttactcatttgtcaagttattgaacttggctaagcttaagttcaacaaaaaaaaaccaagaagcgtatatatgtgtgtgtgtgtctatatatatacacacacacacacacacatatatatatacacatatatatataactatacctctagtttgtttttaaaaaatgttttaataccatgttgtttccatttgtttttccttataattctctattttattttgaccattccaaaacattctgagaagctggttcataggcttcactgtaagaatggtcagtagcaccaaaaaagttaagaaacttgtgatctagtggaatgggatttatcaactgtagctcgagatttaaaaggctattccagtgaatgggttctgctgtatgcttaggtactaaggtaagctttccacctttttactgctcccagcacctgatggatattatattatatggtcttatcagagtcagtggtttaattcaggagcatctgagtgtgtgtgcacgtgtgtgtatgtgttgggtgtgggtacaagagatgtagtgttcactgttctccagattattttattttttaaatttatagatatgtgtatctccctattaaaaatcactataaatgtaagtttaacctgtgtttgtgatctttattgaatatgaaaatagtgccacttttgtcctataatttgtacgtaaaaatatttcgggctgacttccagaatgcggtgaaatgaaacaacacttattggggaaagctattcatttgactttttaatagtgtgctcatttttattttgttttctgcttttttttttctttcctttaaaaaaaaaaaaaagaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaaggtaaagaatgacactttagagaagacctttaatcatgctttagttattactaatgtatgatagtttggcatttacattttaagtcatcaatgtcagaaaatgcttgaatattatagaaaggtactagtgatactattattttgggttagtatggatgttgcttataacttagagtctggtgatctgttgtaattgttaaaagtaatggaatataaataaattcactaaggcacagctaagttgctgttggtaggatatttcaaaagtgtgaataaaatgactgctgccaggtactgtgtggagtgtgaacttctgtataactagtatagcacacaaataggaagatatctagtatttattgagtaccttctatatgccagagagtatttgaggtatcttaattattttatcaattcaaaacaatcttgtgaaataggcagtcatatttcttttccacagggaaaaacaaaacaggaagggttcataggaaaggttaataggtccaagatctctctataatggccagaattcaaacctagtcagaatcttttttttttttttttttttttgagatgaagtttcgctcttatcagccaggctggagtgcaatggcgtgatctcggctcactgcaacctctgcctcctgggttcaagcaattctcctgcctgagcctcctgagtagctgggattataggcactcgccaccacatctggctaactttttgtatttttagtagagacagggtttcaccatgttggtcaggctggtcttaaactcctaacctcaggtgatccacttgcctcggcctcccaaagtgctgggattacaggtgtgagccaccgcacccagcccagaatctattttgtctgcttcactttgttgcttttctaagcaaaaacttctaatctgaaaagagaatatagtaaagtaatagagttggaaaataaactccagattttgctcaaaaaatgtctataacatgatactgcctttagaattcacacatgagaactatttctttgaagtataattcataaatttatgagtatttgaaacacataataagcatttagtggtatgcattttgccctaaatattgttttaaatgttgtgttttcattttcatttactttaaaatattttctcttgatttcttctttgacccatttgagagtgttttatttttctagataactgtcttttactaatttctaattcgattctgtgtgatcagagaacacactactatttgaaggctttatttagacctgttttatggtctagaatatcgtatgttttaataaatgtaatgtgtgcactgtaagagacacattatatttgtgttgggtggaatattccacaagtgtcaatcaaatcaaattgagtgatagtgtcctgtatttctgattttctgtctgtcagttgttgatagaagaattttgaactatctcactgttattgtggatttatctgtttttgcctttcagttttatttatctgtttttgccatacattatatatttatatatatatttatatatatatttaatatatataaatatatttttatatatatttgatatataaatatatttatatatatatttgatatataaatatgtttttatatatatttgatatataaatatgtttatatatatttgatatataaatatgtttatatatatttgatatataaatgtttatatatatttgatatataaatatatgtttatatatatttgatatataaatatatgtttatatatatttgatatataaatatatgtttatatatttaatatataaatatatgtttatatatttaatatataaatatatttttatatatttatatatatatttatatattaatatatatatttaatagataaatacatatatatttaatagataaatacatatatatttaatagataaatacatttatatatataatatatatatttaatatataaatacatttatatataatatatatatttaatagataaatatatttatctatttacatatttatatatatttatatatatataaatataaaatatttatatatatttacatgtatattataatatatatctttaatatgtcacattctcactttaagtagcattatatatgccactttacatatagtacacacaccttacaacagtatacttttatttcccccttccagcctttgtgttcttatcgtaacacctcttatttctacatgttataaacacaattcattgttattatttttgctttaaaaagttaatttaaaataatttttaaaataagggtaaagtctattatatttatccacttacttattccctacacttgtcattccttttttatagttgcagatttccatttgtatcatttttccttttatataaggacttctaaatttcttacagtgtaggtcagctagtgataaattctttcagtgtttatttgccttgaaaaagtctgtttttccttattttattaaatgttactatcatgtttatgtatattttcttttttttttttttctccgagacagagtctcactctgttgcccaggctggagtgcggtggcctgatctcagctcactgcaacttccgcctcccaggttcaagcaattctcctgcctcagcctcctgagtagctgggactacaggcacatgccaccacgtctggctaatttttgtatttttttagtagagagggggttttaccatgttggccaggctggtctcgaactgctgacctcgtgatccgcctgcttcagcctcccaaagtgctggggttacaggcgtgagctaccgcacccggcacgtttatgtacattttcaaaattatatgtgtgtttataaaaaaggatccctaacttttaaattttatgccactttatctttttttggtccattgaattttttttaattaatatactttcatttttagagcagttttaaatggacggaagaattgagcagaaattagaattcatatttatactctccccctttccccagtttcccttattaacatcttgcttttgtgtgctatatttgtttcaatcaatgaagcagtattcaggcaccaaggaaagcccataagattctctcttgtacattctgtgggctataacaaatgtatagtgacatttatctatcattacagtattaccagattagtttcattgggctgaaaatcctctatgcaccacctgttcatccctccttccctttctttccctgaactcctgataattaatggtcgtcttactctctctgtagttttgcctttttttagagtgtcatatagttggaatcatagagtatgattgaatgaattcatattggcttctttcacttagcaatgtgtgtttaagattcctccatgtcttttgcggattgacaccttaattctttttactaatattactgaatattccactgagtggatgtactgtagtttatccattccactattaaatgacatcttgatcactcttaagttttggcacttgtaaatgaagctactttaaacattcatgtgcaggttttgtgtggtaagttttcatctcaggtaaaatatcaagaatcatgattactggatggtatggtaagaccattgttagcttagtaagaaactgaagaactctcctccaaaggacctgtgctattttgtatccaataagcaatgggaatccctattccacagcctcaccagcatttgatgttttcagtgttttagacttcagccgttctaatagatccgtagtggtaatatctcactgtgttaattagaaattctctaatggcatattatattaagcgtcttttttttttcctattcagaaatgacaaattctttaaatcgacaaactcatcttcctcaagccccagaccatggtaggcagccctccctctccgtcccctcaccccaccccttagccacagtgaagggaatggaaaatgagaagccatgagggcctctgccagggaaggctgccccagatgtgtggtgagcacagtcagtgcagctgtggctggggcagcagctgccacaggctcctccctataaattaagttcctgcagccacagctgtgggagaagcatacttgtagaagcaaggccagtccagcatcagaaggcagaggcagcatcactgactcccagccatggaatgaacggagggcacagagctcagagacagaacaggccagggggaaaaaggagagacagaacaggccagggcatggcggtgagggactgaggcccctaaattttgatcccaggggaaaagaagaggccagttggtccagttttgatgggtatggggaagggaatgtattagtaagcacgggggagaggctgccaacaggcacctcagaggtgataggacaggctgaacccctcaccctgacagaagggagcttaagagctctggggctctctgggaatgtcactgctaaaatatatatctacatgtatattaaccactcgtgggagggcaggggcaaggcctggggtgggatcaaaggatctggtgtggcatccagtagccagtcatgcctgcctgagatgccccccatctgtagcccgatcacgttcttgccctcttgcagctggttatccgagaagttccgaggattctccttggatttcttagggaaccagttgggatccccagagaagagcccatcatcccaggctactgccaacccacccagattcctcagcgtccgctgcacacaggccatgttctttccttcccagaggtccacagtttggaagatgtcagtggtgttaatgccatagcgctcagctgcttgcaggaactgagagatcttctccatctgcttgaaggccatggtggaggcctggatcttctttactgggacctgccccttggggtacagtgcattattgagctcacataacaccgtgccatccttgagccagttctggaagttctcgcgtccaggctgggaccggcccacatcctttcggcactgggtggtgatccactggatcaggatctgctccagatctgcatcatactgtttctcaatcttctgctgcacctcctggctcaggccataatgcaggtcccctgttggccattccaatgggtggcggtggctgcggggagcgttcaaacgggctggagagcggcacactcactcaaggcaatggctgcagctgccgagcttcttcttacatgcttattttctacccagatatcctcttcattttcaaaggatattttcactagacagaattttcagttgatgaggttttatttcttttcagaactttaaaaatttactccattgttttctggcttgtgtttttctaaagtgaagtcttgcattatttttatgtttggtgttctgttaaaaaatgtgtctatctttggttgcacttaagatgttctatttatcactgattttgagcaattttattaggatgtgccctggtatatttttttctatttgttttgctgggggttcctttagcttggttctgtaggtttatagttcatgccaaatttggaaaatatttgaccagatttcttccaatattttttgcctcccatcctctctttcctcttctttgggaactccaattctgcatattttaggctacttaacattgggtctcacagctccctcatactccattcacttttttccttctcttttcattttggataattttaattgcttgtttttaaattcaccaattttttttctgccatggctaatctactcttaatcctatccagcatatttcatctcacacattgcaatttttctccctgtaagttcatactgggtcccttatattttccatatccatactgtgtataatcttctatattgttgaatatggttataataattgttttaacgtctttttttttgtactctgttacttctgggtctgtttgcgtttattgatttttctctttaatgtggttcatttttttctgtttatttacatgcctggtaatttttgattggctaccagacatcatgaattttatgtaattggatactgaatatttttgtattcctacatatattcttgcactttttatctgggacacagttatttcttgatcctattgtggcttttatttctttgatgatcacttggtaatggcttgttcataagttttgttaggaccagaatagcctttagtgtgtagctaatttttctccttactaagacaataatacacttgtaagtattctgaggctttgtaaatacaagatttttttttgctttaatgtttagtgagaacacgaactattcttactgtgtgggcgctgactattgattcttctgctcctttcaagtactctcttcttatcgttggatagctgcgatacatgtaggtggtaatcagtactcagttcaaagctggaagggaaccctttgtagacctctaaagctttctcactggacagtgctcatttctgggttgtttgtttgttttgcttgttttttctctgcctgtggactggaaactttctccactcagtatgcttcggtaatcaaagagctgatcttatgtgtttctccttattcaggtatcattgcctagcattccggtgtctgaaaatattatgtcacatattttgttcgtgtaagtttggtgtgtgtatgcatgtgtgtgtttattgtagttttaggcagcattagttcttgactagaagcagaagttcatttgatatctgaataaaaattttatttaaagatcaaagcaaagataaggtcattggcaggattaggaatgatctgcagcctagtgtttttggaacgtaatcccttgttataggctggctctgtgcattctgctgcacaaaaggagataagcaggaagtggtgctttctcatggaagtcgttttttcttttttcatcttcctacaagttgattatacaaaagattatttatgtaacaattatggaaacttattaacaataactataatggctaagttattgtggatgtaagactgaaaaaatatcagtacaagcttttctctttgctaggatggattcccaattataatgattttatctcttagtatttgcagaaatattgtaatgtaagtggtaatttttcttttgcagatagactttattttttttactttattttctaatagaaataatttctctttagaagattagtcaggtaattgcacgtaaggaaatggaagttgttaatacaaaagaataatctgtgcttaaagtttctgaagttcatgtggattaagtagatactttaattgaaaacgtcttgctcataatagtcttaatataatcctgataatatgtaggagttatgaaatattttaaaaataatgagatgggagtgctttggtataagcttatgattttcaacttgatcaaatgaatttgagaatttactttttcaagacattttcatgaattttatgttgaagaaatgtttctcttggcaaactcttgatttatggagaatgatgtctaacagattaccgcagaaagccccagctgtatgggaactttgagtgtgtagcagagggaaagaaacttaaagaatatatcagtgtgtctttttagtaatagcacataagggagattcctggaaagtaacattagcagattgatcagtctagtgggtaggacttcaaactctttctaatccaaaaagtagactcatggttttgagatgcttttcaaatgatttgtatagttacagtactaggattaaggtattaaggtatatagagaattaaaagcattatcagtatactgaggcttttctgtcatacatagctagttatcactgtctttgtgaaaatcttcctaaaagataaaatgtagtattatgctagtgaaccaaataattggttaaaactaatgcaaaagtgaaatttatgaaatggagagtaacctgaagtgtttcagagaatttagagcttgattttttttttatttctagttgattgcttggtttcctttctcaaataagtttacagaagatgggagagagaaagttatgaaagatcagaaacctttaaagttgtttttttttaatatcaaatatactctatccttgattatctacatcttggattatcctagacaatgtaaatgttctctacaatgtactttaccatctctcattgacttgagttggtatgtgacccaggaatacaaactgatgtgtatggatctcattaaaatattaattgaaagagaaataggctgtagtttatataaagttactccttatttaggtggtccacgtcctcaactaaaagaggtgctattcagagtttcatatggattccctctccctcaccaaactgcacacacacatatactcttctctccaatattgtgtgcattaactgtatgtgatcttgaacatccgcagtaactttttttcacttgtgattggatgaccattttctgtagatttactttttattttatcatttttaaaagcaatatctgccataacttaatttttatattcttaaagttgaaccaggtgaattcacagagctgaatatggacttgggaggaggatgtgatgccaaatcaatcaggatttgagtttttctttttctttggataagaagctatttagtttatttttaaaattctttctggctcttcatttttacagttacaggatatatagtggactgaaaatttgaaaatgaaattaaggaatgttgcacccttggagtgattatggattgtgacttggatacagaggaattatatatagcataaagcatgaactagctggacttcaaatcctagctgtttaggacaagtttccaggtgtttctcaccattagtttctctatcagtaaaatggaaatggttttacccatctcagagctatgattgtgaagatcaaataagcaatatgcatataaagcatggtacatataaagtattcaataaatattcatgttagtatgatcagctgcctgtggaccctagtttgctcatttataaagtaagaaggttaaacttttaagatttgtatcactatttatttatttatttgttttatttttttgagatggagtctcactctgttgcccaggctggagtgcagtggtgtgatttcagctcactgcaacctctgcctcatgggttcaagcgatttgcatgcctaagcctcccaagtagctgggattacaggcacatgccaccaggcccagctagtttgtgtttttcagtagagatggggtttcaccatgttggccaggaactcctggcctcaagtgatccacccactttggcctcccaaagtgctgggattacaggcgtaagccaccgtgcctgccctgtatcactatttatataaatatatttaaaattttatagcttttcatggtgagttaaaagtatatatacactatatactttagatgtcatataatctacttaattttacagatgaagaaataagcccagagactccttgcccaaggtcacaaatctaggtagtagtagagtcaagtggaaacagattttttaaagagatgttttaaagatattatactcttttccttttataatattatcaacattatttattgagtctgcactgtatacatgacactgtatttggtacttgtagtgagggaataacacaggaagcagtatgcaaattaacataaaaggtggcgcttcttaccttactgaagttacctttctgatatgaggtaactcagtattttactcagtttgcacattttatttccttacttgattgtctttggggaaatatgatattctacctctcctaaagaggagaatttactgggaaaacttgggttttaataaaaatggtttcatgagaatgccacagttcctgagtgtactatttttatatatggcctaacatcagaagaaaattagtaaaaatagctagataatttttgaagtatcaaccttgaggattaaatgttactttcttttttcaccttagggcacagtcagtggtgtgctgctagttacaccaaataatataatgtttgatccacataaaaatgaccctttggttcaagagaatggctgtgaggaatatggcatcatgtgtccaatggaagaggtgatgtcagctgcaatgtacaaagaaattttggatagcaaaataaaggaatctttacccatgtaagagtgatatttatattcctttgcaactttattgtatctagatagttgacccttgtctaataccttaactatttttactagttttcttatagctgccttttattttgtcaataatgaaacgaaaatatatgcattattgagaagattattcttaatttgcacctgggatagttatgaattatcttagatttgtatttgtgtatgtggtcagagaaccagatatttgaaaagtaacctatagtgcccatttaattcagtgtttaccagcctttttattcagacacagcttccagtcttctaaattacccctgtgagcaatcactgttgggataattttcaaatttcccttggaagtgactgaagagctgtgatttgagagaggccacatgagcaaagagctgacattgctgtgggcaagacagcttttttttttttaattgattgatttatatgtttgcaatcttctctcccagtataaaatacagtgtaaagtacagggaagaaaacccacaacttgctcaaatataaagagttaactttggaatatactggtcagaggatttgtgtgatatgttaagatagctgtgagactacagtttggacacagcttttgaaagtaatatgcttgtccaaagtaatggccagaaagaaaaggaggaatgggaaataaaaggagaaaaagataaaagataggtataaaaagaaaggaaggagaagtagcaaggaaggaaattgatatgtactaggaaataacctcctcattccttcatacatgactaccaacattttaaaattgtcttcactttaactgatactgatatttatatccctgtattagcccacaggaatgatagctgttttaaaattaacccttgtggggcagagcaacttacaaaggaaaaaagggacaaattatttttgtttctgaggaagactaaatgaattggtagaatatctgtgacagaataaaatcctttgctcaaaagtctccactgtaccttccacccaacagatattattttgacttggtagactaatctttagagctgcagataattcctagaaggtgttagtatcctctgtattagttatatttgtagatcatcatccaaggccagtttcagcaaataaggattattgggaggtggataatgggatgagacaaaggtaaaagagtgaaggattacattcaaagaagaggaaggatatatacatatatggagagagagagagagagagtcattggtgagattctgttgtcctccttttctttctttttctttttctttctttcttcttctttttttttttttttttttttttttttttttgagatggagtctcgctctatcacccaggctggaatgcaatagcacgatctgcaacatccacctcctgggttcaagcggttctcctgccttagccttccgagtagctgagaatacagacacctgccaccacatctggctaatttttgtatttttagtagagacggggtttcatcatgttggccaggttggtctcgaacccctgacctcaagtgatacactggcgtaggcctgccaaagtgctgagattataggtgtgagccacgatgcctggctttgtccttttccatttgcaatatggtactttggggttctcttattctgaacaatccatcactgttctacaaggatgctgtatagctcttccctttcaaatcactgttttgtcattcattgtcagctggaaagtgtcacctggatttaaatatttaaagatatttcttcagaaagaaatatctttaaattctgccttatggattgattaaaaacaatatttggcacaaaattagataaataaaacaaatgtatgccaaaaatgaggtataagatttgattgcttttcttctgtcttatgctccttgggaggttgatttcaaaggtattattatggtattacattcaacagtagtaacatcattgacataaatgtttagcctttcagcatattaaatctgaagagtatagcacttttctaaatatatatcctgtcacgtttgttatgtttatctcttacctaagggtcttctaattctttaaatgtacagataaaatttctcaaaacttttgcccggttccaacaccctatagatgcagtatgagtgcatcaccagtagatgacactattgtatatttaataacaaactagattcttgtttttttaagatgaatcagatacaaaggcagcagagatattgacttcaactaattaatacttcaaaaatttatccatcctagttatagaaattatgcatacttgttgcagaaaaattggaaaatactgaaaagcggaacaagacaaagagttacccagcttcaccattcagagatagccaattatttttgtgttgacttactttacaatctttccttttcagcatattttacatggttctcaaactatgtatgtataaatgttaatgcttttttcattaagaactcatataattttcatttatcacagacttcttgtaaccatcattttaaattagcaacttacatttcatggtatagaggtttacactccctctttccagaacttaacttttgaacattagtgtttacatatacaaatgtcattaaatctgaaagtctagacccagttatgaaccattcatttgtctagtatctaaacttttcacctgaacaagttctcttagaggtattaaagagtatagttgttagcctgaagattttctctatatacttttgcttgagttttattcagattggttttaagccttacatttgagccatatattttaatttaagctctatttgaatgtaaataagcactgtgtgtgtgtgtatatctatggaaatcagtttatttttactttattgggagatttaaaattttaattaaacatttctctgtgtttattttccatattccatcagtgagtaaattttagtttagaattacagctttacccagggtttatgtcatcaagttcccttcaagtggattacttgcaaggaaatcttactttgatatttcctaaatattaagcaattgatataaaagtttgacttaattacttgatttatagaattacttggtctataaggttaattatttggtcatattgaataaatcagattttttatattctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagtaagtgttatagagtaaatgaagttagttcatccaattgtatggtgtctccgtctttcctcactgactcaaaagccgctgtaccttagggcaacctgaaggataagtgagtgacccttgaccggtgattctctggggacaagtatatacagtctccagtgtctactgtcttttcttatcccacaggtggattgtacacataatgagcatcattgctacccaccatgtttaaacattcttggctcactacatcgtatcattaaacaatttatttcttgagaaattgcacaaaagctgtataatacctttgatcactccattttctcttaaaaagtttttggtgtgttaccattaaaaatgtcttttttcatatataacattttaattgccaaagttgtaatcccatcttttataaaatgtacagttaaacctaaaagtgtacttacagaattcttccacgtatcgagaagtttcatcatcatcatctaattattttcttttaaaaacctgccctcaggacaaataaaaacactattttatctgtcagttttctggtactgtttacttctgaaaattacactattttcagtcttttatttctaatatactgtgcttctgttaataaattatgggttaaatggggtataacaactaacttagctaacatttctgatattctattagaatgtttatcccagactagtccattcacatgtgaacttttctttcattttttaaattcaaagatttttgttttgctgtaatacataaaataaaatttaccatttaactttttaaaattatggtaaaatgtaacgtaaatatattatttgaagcatttttatatctacaatgcagtggcattagtacattcacattgttatgcagatcatcactactgtccatttccagagcttttttcatcttctaaaactgaaactctgtaccccttaaacaataagttggccaggcatggtggctcactcctgtaatcctatcactttgggaggctgaggcaggcagattgcttgaacctaggagttggagaacagcttgggcaccatggcaaaaccctgtttctacaaaaaaaaattacaaaaattcgtcagacatggtgatggtgcacacctgtaggcccaactactcgggagactaagatgggagaattgattgaacccaggaggtcgaggctgctatgagccatgatcatgccactgcactccagcctgagcaacagagcaagatgctgtctcaaacaaaaaaataaaaaacaaaaaccagtaacttgcttttctcccttcctcatagcttttggcaaccaacattctactttgtttctgaatttaactactctagatacttcatgtgagtggagtcatacaatatttatccattgatgtttggcttatttcacttgacataatgccttcaaagttcatttattctgtaatatgtgtcagaatttcctatctttttaaggctgaataatattccattgtatgtgtgtacattttgtctgttcatttgttgctggacattttggttgtttcaaccttttggctattgtgaataatgctgctttgaacattagtgtacaaatatctgtttgaatccctcctttgagttttttttgggtatattcccagagtggaattctggatcatgtggtaactctatgtttaatttcttgaggaacctccgtactgttttccatagtggctgcaccattttaccttccctgcggcagtacacaagatttgggtcagtttttaaaataccgaattttcttttcatcatgcagttgagatatcctgaagacctaagggctgtgttcagtagatattaaaataattcatatattaatacttgaaccaagttctataaaagatttaatatttttcttctgtaatatttttttaattcaaaactaatgcatgttcagtaaagaacatttggcaaacataggaagattctagaaaatttataaaaatcttctggaattcatcacccagagatgatcattgttaacattcaatatatctgtctttcttatagaacaaaatcatatgtgttaatttgttatttacatcaaatcaagattatactatactgttgtatcctgcttttttatgtcatgaaccttttcctatgtgattacagttctttgaaaacatggctttaaaggccctaaaatttatttaaccatttgcttattaagacatccagttgttattaacgatctgtattgttaagacattttaaagaatgctgcccagcattcttcaaaacatcaaagacagaaaatgcatctgatagttatcttatattttgaagatctttgactgcatctttgactacatctgatagttaccttatattataaaacctttgaaaaagataaaataatctgtttaagctgatgatgtggtggaccaattttgttgtgggggttgggggtttaatggggttaggggaggttattataaccaaatattaaaaggacaaaaattgatagatgtttttaaacagtcatctctaaactgttaccatttggtttcttctttttttggaataattagttttaagtaattttaagttacttaatattctgtaatagagaaatattcaaactttctgatctttatgactttataataaaattatgtaataaatataaaagtgtctagtccaattatgagaagaatggtgaaagctcatcgttttaaccacatgaaaatagtggggttcccatagattatctaccttgtgtaatactgcacagaaaaagccatgatgagtacccaggtctcctgactataagtgctatttcctccagtgtgctgccttggtaagctaatcaatgtctgggttcctaaattcacctatatattcagaccctcagtatactctatcagcacctctggttgaaagagttagaactaattcgttcttaattaactgtccaaacaggtggcagaatctaacatattattgactgttttattacaattttgtatacatgtaaaagcattagaaacttcattaaatttttgtctgaaacaaccatgttaagtatacctttaaaacttctacagttatttagatgtcattcaaaaagactgatagagaatatgtagaaaattatatatatattatgtgtgtgtatatatatatgattgctttagtatgggtgttgaaaatgtaacaatgtttctgaaacttttactttttttcttaatgtccttagacataatttttattcattaacttggctcttttgttaagtttagtcatgttgtatctgtgactttacctttgaaggaaaaaaaatataaattaagaaaatgtactttagcaccactaaagtgaggttttattctgtaactatttgtcagaattttgaaggtaaagttaactaaactacctaaacttggtgtgtgagaattgaataaacactgtttgcatctcaattctaggttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggtaaaaaacccatacgacaccttgagagcattattgagattctttgaactaaaattattttgtgtgtcaaaataccaatgataaactattgaaacatagtttatgattaaaagcagacaataagtctatttgaaaccattttgcccctactttataatttgccccatttttaattgcattcccttttgtagtttattatttaaaaatgtgaacaaatatccaatttgggtagtaaagagacttaagataccttggagcaagaagattcatcaaaatattatttgatatagctccttcctgaaggcagctaatggtgtataattcctttatattaaaaattcttcaaatattcattaaatatcttctatatacgtgacactaaattagctactaaaaggatgtagtggtcttcacaatatttgtgtgtaccctttgcacaattagatttttcatcataagttttaagcggttgtaaaagatgtctattgtactatcttgtcaatttttacattttaagtaaatagtgttacttatacccagtagaactgaaacattataacaactttccctgtactattattcacttaaaattactttaacagttagacattgcatcattactttttctctttaaacttctatttccataataccacctcacacaaactcattacaacgtactatatttttatccccattatagttctttgcaacaaactacatatacttaacacatttacatatctgtgtgtgtatattgaaattgcatttattttaacattttctgtgacttttgtaaaaacagtaaagggtttaaggttttaggctacctgcaagccaacaacttagtctgcctccatttggtgcatgctgggagaaagcacaaacatctgtacaacagcagtaatcagaacatcagcaattgtgtgatttctctgtacctcctttcctacaaaggatgtgaaaaaggccaagtgacagctgcacatacctggggttattttacagaagaggaaccataagtttagggaacctgaatttttataacagacagtaagcatggttaccctttgctagacagtaagatactatctctacttctaagataatgctacactaacatacttgaaaagatactgctgagcaaaggtattacacataaaaagtaaaatatcataggaaatgcctgtcttaaggagatagatagacctttcctatatccattgatagattaatatgtttcattgaaaggatgagataggactcagcatcagttctgcctctcccttttatttttctttataagtactgagaagctttgttcatagaaaagtcagtgagactgaagagagtttcattttaataatgtcattcaattatttaaacttgtttctatataattccaaaaattaatcatttttgtcacaatatttttagtgatcatcagtggacaactccattgaaaactccttcagttttgcggaaatcaattaatgagaaacaacctgacatacagaaggacttattacccagtctttataatcatttcctgtctcaacaccaatcttgggcagcctaaaagtttttatactgtagggcatatcccattgtaaattctgagtaggtgaagatatgcccttcttttataaattagaaaaagtgctttagtgaaagcagataacaggaaatctgtaaaatatcttgaccatactgtttttaggcagattattatgagcaaagagtaacatatggaaattggagatacgcgaattgattcccttagcaccatcttacacgtttgtgtacctcttggaaaatctttatatgttgctttggaagactacagcttttaggcataaaatgataatgctcttttcccttttcccactccaccatatatagagtaagtacaatgtgtgtcttccacaacattggcttaatcttaaaatatgatttgcataattgatgaatacctgaaagggacagagcctgatattcaaacgttccagtgatgttgaaatcactacaatgagaaatgtaactatatttagttaaaatggacataaaaatttagtttttctcattattcttggttttaatgtttacatggaattccctattttaatattcattcttttatcttggttaatattcattacaaattagtattattaggattctgatctttattgtagacataaaacttaggaaaactgctgcatagatagtgagaaattgataaaaaggtaagatgttacattgaaagataaaatgtagcaccttttaaatatgttagctgccacgtaaagaatggcaattttaaaaatcattatattgaaaatataatttctagaaccatggttattaactggtatatgttagctgaaagttatataatcaattttcaaaaacatgttaattaaaaccaataaaacgtagatatttgaaatgtgtgtgtgactctcaaatacatttatcagggaatgtaacaactggctttagtgtagtaaacaaaacattgaaaaggggaacctgagatttctaagattagatcatctgtctctcaacactgtatgttcctagtatcatttaaaatttaaggacattacatttctattaacttggaaaattgtatataatgtctcaaaataggccattaataaattgtttacttgtattttagatcattagattattgtaggaatgaggtcaaagttgtgtatctaatttccttttccatcactagtgtctttaaagaagaaaagctttataatatacaacatctgaactagtcaaacacatgccaaggaaaatcttaatttggttttctaaagaacaacctgacagaatatagccaaataaaatgtttaagttaatgccttcctgatagtagaccttttatattaatataaaacaatatattttgtgtatattttaagtcttcaagatttatcaagatattttacaaatataattttttaattctggcagcacagaatactaggtatattaatagtcacttctcctaacaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtaaggagaaaaatatgaagattttagtcatctttttagtttgtatgaatttatagctttatggtagtacaaagtataagtgatgtttccacaaaagaggaatttttttaaaggtcaggttcactatccgtgtttatttgtggttattgaatgaatctgaatagtgactttaatactatatttgtcattctgcttttgctttaaaatactagaaaacccactagcaataaaatgacttttattgagtgtcttatagaatatttagtttaggaaagattaacattatggcaaagaaggaaataattttaattttgctgttatattaattttcataaaacatcgatttcacatctgatttgttttaatttcatctcctccatggaggaggtacggcagtcatttaacacatctgtgcatagtatttgcatagcatctatacaaattactactcctttctatgtttcagacctaagcattatcttgacttaaatttttcaataataattttaaggaaataagcaggtgctaattttataaagtagtagaaattttatatgctcagatttactgaacttgtttaaatggtcaaagttatactaacaaactttttgtaactcctcttagatatatcttaagattacatattaccttttacatgctttgtcttataaggttggtagggtggcaatatctgttggtgttgcctagattagtctcttcttgatgcattagaaaatgtagagcagatgctaaaatgttataataaatgtaatcaaatttttttattcattgggtgttaatgtttgtggctgttaatgtgatatgaatgtatcttgcatgcacttaacatgtatagtaattgaaggtatacatggcttgtcttttgtttaaaatgcaaactgatttggaatgtgtctaatgtcattctgtgtagtatatacagcatcagtttctactgtgactccaatataagggagggaaagaagaacatatcgaccatgtattttgggttattttaatacttaaaccaacattatcaatcttcataccagctttattcataatggccccaaattggaaagtctcattagcaggagaatggatgaatacatttttgaatacttacagaattccaaataacaataaaaaagatctactggtacaggcaatgacatggatgaattttacaaataatatgttgagtaaaagaagcctgacacaaatgaacatatactatgtaatttcatttacacgaagttcaaaagggcaaaactagtcagaaatccatcacactacttgatactgggctgtgacagggtggctcagggacaggagggaactttattgcgttctggggatgttctatatgttactctcagtggtggttacttgggtgattacatatgtaaaatatatataatatatataatacgtatataatatatatatgtatcttatatatatatatattatatacatctatgtccctgagctgtgtttttaagattagctttagaaggtacttaaaatagcccaggtgatcaaagatacgtacctaactaaggcagcaacagttgaaggtagagtggaaggtgatgaaataaagctagaagaaaaggtattagctagctaattacacaggattcagtgacaacctggtaaccataaagttatctccagcttgggtggcacggtggatggcagaattgtcagtcatgaacgggaattgagagctttctctccattggggttggagtacttaactttggaaataagagactattgactattttgattcaaaggaactgtctcagtttctgtgcaagactctgcagggtataatttctaaaggaaaaataaatctcctcaccagtcctttgaccggaattggtgcagttcaaaagaaaatggaagagaaaaaaataattttggaaactccttgctacattgtctgaaaatattaccgcagtatccagtatagcagcactagccatatgtggctattgagtacttgaaattcatgtaatgccactaagggactgcatttttagttttaattattaattaaaaaccgatacttggttccattattggacaatttttaaatatattaggaataacttagatatatgatctactttttcaactgtaaatttcatgaaatctaaatatgatctaaatcagtctaaatctaattaaggtcaagtatttcctatgaaaatttagtgcctgaattgagatgtgctgtagtgtaaaatattctacttcctatagccactagccacatgtaaccattgagcatttaaaatgtggccaatctcaattgaaatgagctgtagtataaaatacacactggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggtgggtgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaatacacactggattttaatgacttagaatggaaagaaaaaagaatgtaaacatcttgtttgtttatactgattaatattgaagtgataatattttgaatacattaggttaaataaactatattaatacaattaatttcacttttttaatgtggtgtctagaaaatttacaattgtaatgtatcttacattatattgctcttgtgcagtgcaggtctatgcctcatggatactaagtgcctaaaaaaatgtttgttaaactagggaggccgagggtaacaaataaaaaatgttaaactagggtggatcacgaggtcaggagtttgagaccagcctggccaatatggtaaaaccctgtctctactaaaaatacaaaaattagctggacgtggtagcacacgcctgtagtcccagttgctcgggaggctgaggcaggagaatcacttgaacctgggaggcggagattgcagtgagccaagatcacaccactgcactccagcctgggcaacagagtgagactccatctcaaaaaaaataaataaataaaataaaaatgtttgttaaactaatgagtactcatttaagtgaaagagtaattttaaatgttaacatgatttattttaaaacaggaagaatttggctaaagcccttatataaaacagtagtacttcagaatgtgccgtgatgttttttatttttttgttctacaaaggaatggagaataggtgtcctagaatttaggatgaacttgttatggctaccaacttgggcatcagttagatttaaactaacacctctactcactgttattctgctttagtgatacttaaaaaagatctttattatccctgactgttactcaagcagaaatatattgctagccagaaatgtatacattgactggggaagtttgtatatgataaatttggtaaacttattgtttgcttttttctccctttccctatgtaagtgtcataaggcagggatttgtcaatttcatacactattatatcttcagaactaagaattgtataggcatatagttcattctcaatatttattaatggataaacttgggcgtagattaaaattaaggtataaagcttctaatctttcaagattgctctatttcctgaaataagttcttacatcagttgtagtaaatattttcataaagccatagattctggacattttaactaatagtccacagtctgtcatttacatttttttttgttctgtttaaacatattcagtgaaagggaatttgttacctcaaagggcaatactttacattttaggacagctctgttagaaagttatttgttacaataagcttaaggaaacatatctttgtaaattggattcatttatctttattctgtcttccaatgcaagtcaataacaacaagaaacattttctatttactgcgatagtgtgaaaatgtttgtcttcccttttaatcttgtttcagaattattttttccagtacttcaactgtttaactttatgaactctattcagatcttattcatatcagtaccctaaaatatgttaaaagagttcataaactatggcaccccaaattactaaaatgtacacttgggatagcaggaaaaattccgtaatatttttaaaaattttaatttccaaatatgaacattgaagaccagtcctattgaagacagacagaaacatatatttactaagaaaaagaaaatttagccaaattttaaggtggtcaggagtaaaagttcctaatgataaatcagttcctaagtatttggataaaggatctgagaaatactattcttactgctcacgatgtgtaaaggactgaatttcctctttttgtagtgttactttgtatgccacatgataaagagtactttggtgtgggtcgggcgtggtggctcacgcctgtaatcccagcactttgggaggccgagacaggtggatcacgaggtcaggagatcgagaccatcctggctaacatggtgaaaccccgtctctactaaaaatacaaaaaattagccgggcgtggtggcgggcgcttcttgttgtagctactcgggaggctgaggcaggagaatggcgtgaacctgggaggtggagcgtgcagtgagccaagatcatgccactgcactgcagcctgggcgacagagcgagactccacctcaaaaaaaaaaaaaaggagctatgcctgaattaattgcgtcaacatggctgctattgataagaaagcatgtttttaaacaatcaaggcacaaaatgattaaggaaacctttcttcatagtgaaccaaacttatgtttttggtgtgatacccaaataaaagaaatatgcattatgagtcttgcttttggggatctgataaccttatttgataactgagaaggaactacttattacagtctttcccctgatttctgccggtattcaacacaggaagtcaataagtatatccagtgttgtgaggatactgtttgatgtggggctttgcagttctgtgataaatattactttctgttttttgatacagattttttatgccttttcactgaaaagggaagtgctctaatggcattttaacaaattgtcaggcaagtcctgaggtgaagatgaggcagaatgcctattgacatctgctatttcgtgatgatcgcacttttgttcaataaatatacaaaaataaaagattaatagtaaaacaaattcacatgtgccattcagcttcatcagcttatttcttctgtgtccctccttttctccaattgttcatagttattcaaatgtcataaaaatatttagaatacatgtaatatgtacagtatgtatttttacaatttgttttttgagtcatgatccaactaagttctcaaatgctgcagttagttaaaatatctcttaagtctctctaaatgtaggttcctcctccattgctttgctttgcttttttatttcagtttttaagaaatcagattttttttctgtagaatgtcacacagtctggaatatgctgtttgcatccccatagtgtctgttaacatgttattctaccacttgaatgattgatagatctagagcaatacacttaagtatagattatcatctttattttacagataatttctttgtatttttttatttattttattttttttgagatggagtctccgtctgtcgctcaggctggagtgcagtggcgtcatcttggctcactgcaagctccgcctcctggattcacgccattctcctgcctcagcttcccgagcagctgggactacaggcgcccgccaccacgcccggctaatttttttgtatttttagtagagacggagtttcatcgtgttagctaggatggtctcaatctcctgccctcatgatccgcctgccttggcctcccaaagtgctgggattacaggcgtgagccaccgtgtctggcccagataatttctttaagctggttttttatttggctaaaattctcttagtggttaatctctaattcagagcctataccttttccaccataccaagtactcaactttggcggaacctttgcatcatgatggggagctttcaaacatatcattgccaaggtcacaaatcagaccaattaaatcagaataattggggctaggacctagttatcagtgttgtttaaagctacctaggtagttacattgtgcagtcaaggtgcgaaaactagtataccaccatgccacaacttcaggtgttgtgttaaacatatacaatattaagactgtggaagactctttagactatattgattataatatagatcagcttttgagttcctgtcatgcaagttatatgaaatacttttcatattcctttcatctgggctgctgcatcaaaaacataaatttggttcactatggaaaaaggtttgtttaatcattttgtgccttgatttttaagaaaacatattttctcctcagtaacagccatgcagatacaattgatgttgtcatagctcccttacataccacaggacttccatcatgttgtgtactcagagatactacaaggagaggaagatcaaaaaacataccaggctgtaagtcaatgatctttgaactttgtcttcttcaactttgtccatcaaataccctttaaaatttaatatatttggcaagtgcctgaggatccagtagtatagcttaaaggagtgaccaccacaataagctcagattcatgtaaaacttttcattcagctttataatttatttgttgtaatataaagatgaatttggaatttcttatcatgaagtcaaaatggtaatactgtaagttgaatcgcttttatcctgccatcatttatcatgagacattacatgctggacaatatcagcatccaccccaagtaccaacttcaagaggctgtatactagaattttctgaaagtcaaggattcattgtgtcacatgttcagtatgccagtcttgctgcttgaccacacaggcctcaaaggtggagctttttatgctaacattgctttttggttcctttcctttggattgacttttccagtccttttgggataaaagctggcagagaaagctttccaaaatttttcatctctaattttataccacatgtacttcagtatctttcatactacaaacctaattaaagtatccagttctcctaggatgataaataaaaacagctaagaaactggttttattaaatcaactttacttgatttatttagtctcccacacatttacttgattaaattttaagaacgaatttactaagattatgtgttgatagggtgtgtaacagtatttttcattcttaaaatgattcgtatttgaataaaattgctctggcttccctcttgcttctcacctttgccaaaatactgataaaaagacattctgtacagttttggggttttgaaacaacctgtatctttttaggtacatgacattagtcacattttctcaataattgaagtttagattatttaagtataaatgtaaatatgttaactacttactatataaacctctatactattattcaaaatatgttagaatctgcctttcagcttagtttttaaaataatttatagtctttccattttgactttagtatttagtgctgtcccttttagttatataagtgtaaaatatgtaacccgttcttagcattgtaggccataacatttatcacattatgtcattgttggatttggtttttcactactatgtggtgattgccttgtggagccagttctgttttcacagctatcattaagtagagttatggtcaggatcattcattaggtttcccagaaaacttctacaaccgtggttattgctgcaacttttaagaaacaccttatcaggagacttcccttgtttggttaatatcttatttcctaagctgacaggcagtgagtattctggtgatcattttattaaacatatgttttctattattattaaggtacaagtaacaccaaaattaaaactgagttaatatgttaaacgcacaaaaccctcatgatctcttctcagtctagccagcaaaatccacatagaattaattttgtccaaaagtgaaggaattctttgtgtataaagtcactacattgagaaatcacatttctcagataaagggaatttttttaagtattctttttttttaatactgatcgaataatcaaataatattacaaattataactccagaagaaatttaataaatctaaaaaagaaatcagaaggattaaacacttaattagaatttattagttgataggtactgactttcataatacggtcatgcagcacataatgacattttggttggtcccctgagattataatggagctgtctcttagtgatgtcataacatcatagtacaatgcattaccctctctatgtttagatatattttgatacacaaatccttatcactgtgttacagtcacctatagtattcagtacagtaacgtgctatatggtatgacctagaagtaataggccataccgtataacctggttatatggtaggctattccatttaggtttgtgtaagtacacactgtgatgttcacaaaacgaaattgcttaaagatgcatttctcagaacatatccctgtcattatgtgatatatgactatatttctatgttgagaacctgtatagttacaaatgaaacttttagactgtttatgttttcttttattagcatttggcacccaggttttatgcctaatatggtctgttttgactactgattatgttatcttaaagttgttatcgaccttaggagagttttgaactagtgttttgctttccctgttaaaaatattcttcaattgctagcccaaagttatgagctataacatttccattaaaaatctttatctaggccaggcgtggtggctcacacctgtaatcccagcattttgggaggtcaaggcaagcagattacctgaggtcaggagttcgagaccagcctggccaatatggtgaaatcccatctctattaaaaatacaaaaattaggccaggtgcggtggctcatgcgtgtaatcccagcactttgggaggccgaggcaggtggatcatgaggtcaggagatcgagaccatcctcgctaacacggtgaaaccccgtctctactaaaaatataaaataaaatacaatagccaggtgtggtggtggatgcctgtagtcccagctactcaggaggctgaggcaggagaatggcatgaacccaggaggcgaaccttgcagtgagccgagatcgtgccactgcactccagcctgggcgacagagcaagcctctgtctcaaaaaaaaaaaaaaaaatacaaaaattagccgggcgtggtggcgcacacctgtgatcccagctactcaggactctgaggcaggataatcacttgaacccaggaggcggaggttacagtgagcagagatcatgtcattgtactccagcctgggcaacagagcaatactccatctcaaaacaaaaaacaaacaaacaaaaaacctctaatatagactgtcagaagaggatttatgggtgacagactagtttatgattttaaatattaaaattctaaaatattactttatttttaaatttattattattttttgagaaagggtcttgctgtgttgcccaggctggaatgcaatggcacactcacagctcactgcatcctcgaactcctgggctcaagaggtcctcctgcctcatcctcctcagtagatgggactacaggtatgtgccacctcatccagctaattttttttttttagagatagagtcttgctgtgttgcccacgctggtctcaatcttctaggctcaagtaatcctcctgcctcagcctcccaaagcactgggattacagccacctcacctggcataaaataataaatagtgagtagggtaaattatatattatagcttctatcataccattcccaactcaaataggaagagatataaggtaatttaataacttcagttcgaataaagtaaaggaaaaggattattaaattgaatatctgaattatgagaacagattatgttcaacttgtaaactggtagtgttttcaaaagtgctttgttttatatcccatcatgttataataataacaattgacatctgcttcaaattcttggatatctaggcaaatttaaatgacttagcaatatgtattataaatactacaaaaacagaaagggcaagaaggagacttactgagctcattttatgtttgcctgacactgtatttataaatttggatgacttcgagaaacagaaaaccacactcagaatagcttaaacctgttgtttctcgaagtgtagttcccagaccatcagcagcagcagcacctgggaatttgttagaaatgcaaattctcagaccccatttgagtctgattaattagaaaccatttttggagcccagcattctggtataacaaatactccaggtgatattgatgccggctaaaacttgaaagccactgatttaggtctctaatgactagttctgtccagagatgagagccagcctcctcagaaacacatggctggaaggatacctgagcaaaatcaaggccacttcaggaaggagttgtaagggtggatattgaataggcaaccaacagaatagactatgccatgcttggtggtttttggttttgtttttaatatctcatttaaacctcattttggaacacacgtcatatttgttattttagaaaatgtagctggaagttatgacaagctttcaaaatgctgcttccaccaccaccaccaccaaattatataatattgctgatggttgttaggagagtctgtgatggaggggtggagtgtgaccacaatgcactgtatgtagaagagaactttcctggtgtgaagataatgatggtgttcctatgagggactgtgggagagattttagggtaaatgtagtggggctgaatgagaggaataggggaaatggttggtatgtgggggaggtagggtgttactgtggggtgtgctgtgccctgtgtgagtgcatgctggaatgtggaggaaggagatgggagtgggggtttggttgggatgcagtattgcgtgttagaaaggtagtgtgtgtgtgaaaaggtggcatcatgtgtgcatacaacaaagtgaagtggaaggagctgctttaccttaaaatggaagaaattttcaaatgtatcatcatgatattgatattctgattaaaactgaattctagatagttttagtttatatgtatttgtagtttatatttaatctttaaaaaattcacttctttgcttatattcaaaatatcactggttagtgaagtatatgtaggcatagtgaatataactaccttttcaagaaattagatgttagaaaatgcaatttaaaaacagactgtgtaacaggcagagggattttcaggtcactttgaatatttgtgtaggatttatttgtagcatattggcttggtttttacacagtcattctgtaaaattttagggtggaagagtccacaaaaggcatcttattgcttaaaaaatgttcacataaaagatacaatcttatagtactgttagctgtaagtaaggaacataattttatgactatatgaacaaataacaaaatgttcattcaaatcattcatgtgctttaagagactctggaaattatatttactacttttttgttactgggttacttttagtatattcatgtactgatgtttggaaatataggctctgtgtctttaaacttttgagccctttctttgcacatttgggtacagtgcaaccaaacttaagcatgggaaattctctcttccctccccagctttacagcctccactcaggactatcattgctatggatactacttagtgattagctctctctcttgtcaatcaaatctttgtctctagcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtaaatcttagtcaattattttaatttgtatatatactagtcttttcatggtgacattatgaaaaattatacaatttctgaaagtttaagcatagaggatatttatagaatacaaaattttatgattgtacaaagtaccttgaagttgtttctgttaattctgagtatcttcaaaaagggaaattaataagggactgtaattttgtttcatattaagtgttttgtatgttctacaccaacaggaagatatcaaatcttaattgttgccttaatgttttttattttagcttaactttttagaaaaatattcagaattttctcttgcttgaaaataaattgaatagaacagagtaaattaattattattgactggatctcaaaccagattcttttatgatattgtttacttaagggtataattttaagaatctgactaaaaggttttttaagctgttcaaaaagttttcaggcaatgctacctaatacaaatcttcaaacgatatcctagtaaggaaattcagtcaaccatactattgtaagaattttatttatttttctgtacgtgtacattgttataaaatgtattgtccattgctctttctgtggtaatttgggattatattttgcttatgaatgtttattttattttcacttaattgtagatgatttaaaatccaataaggactttggaagatgcccccaaagcagcttgccgcccttaaatgttaagtgtgtcaaaatattaaaattttaataggtgttatttttaattgtaatttcaaaattcatttatatgttacatcagcacagagggatttaggcacctgaaatgattgaatttttaaaatttgtgattagatttaccagataaatcagttaacaccgttgttttttttttaaaccaagaacaatgaagctattcatacattttttttatttgaagtttgaataatcatttattcttagtttgcaaagacttcaatacagtttattacaaatacaagcaaaataaattgtggttattctgaaatttataggtcaatctaattaatgtgcatcaaacacttacatttattacagtcaccacgtccaaggcctgttcattctttatttttatttttatttttgagacagggtctcactttgtcacccaggttggaatgcagtggcgggattttggctcacttcaacctgggctcctgggctcaagtgatcttcctgcctcagcccggcaagtagctgggactgcaagcatgcaccaccacagcccgctaatttttttgtattttttatagagactaggtttcgccttgttgcccaggctggacttgaactcctgagctcagctcaggagatctacctgccttggcctcccatagtgttaggattccaggccactgcgcccagccaagttctgttcattcttatgggaggctatataattttgtcagatactttatttcatgcctgagcaagaatgcttcctactcattggtcattagctctgcccatacatatatgttatttaattgaaccctcacagtaaccctgaaagtttagtagaattatttcccattttgaagactagttgaagcatggagtggtcactgaactaagttgtcatgtagtacagagacagcttgaccctagcacatattgtagttcaccaggatgactttgaagtttttctgaaatagaacaatatgatgtgttttgttgtgtagacaagctgaagtcccagttttctagttgttttctttgttttaaagcagagattctaggagctgtagggcaggcagctcttaagaaaattgggatgaaaaggattagcagttcttttacctgctttgtagattgagagccctgtaagattttgcctgacaaggggctcttatgcttctaaactggaaaaaaaaaaaaaaaaaaaaaaaattctaagagaataaccagtatttcagaacaaatgaaatttgactttttggagtttataatgtgtagctttttagaattcttcgtctttacccaacaaataatatggccatattattactacctctgtaagagagattatcactgaggtatctatagataccttgacagttttccaaatgcctatgtatgtagtatcacatgaccttacagtaaccctgtgtgttaaccagattgttttgttttataagtgagttaatttacatctcaaatacattaataactaataagcagcatacactcctaacaaaatgcatggcatgaaattaaccttttgccagttagcttcgatgagaaccatattgatcaagcatgcttaagttttgttatcttttattttttaaaggccgttttatagtttattctgataacttaaactttaatcattcatttatttgaagctattcatgtatttgatatattcatgtgccatactctaccttgttagtgtctgtcaataagtcgtaatttacttgaaattataagcccattttataataaggatttagtcttaatcaaagtcacaagtcattaaatagcatcagtgtttcattgcctttatcagtagtcactaatttcatcaccattttcttagtttaggccgtcatatatgaacagactttttttaaatttaggctttcatatatgaaaacacaggagaaaagtttgtatgtcgaattgtttacatctgttcaagaattagctgacaggtggatttttaggaagagctaatttaaatgtaaaaatctttccagtgacttcagcctgagataataactataatgataaaaataattacttgtactgacagtgtataccaaatattgttctaaacacttaatatgagttaccttatttaattctcacaaccctgtggaatattactttatcatctccattttacaagtgaaaaaacagggacatagcaatcatactacaactagtgcaagtcagagctgattttttaatctaggcattctggctctagctgatgcccttaaactctttgccatacttgccctcaaaaatcttcagaatataacaagaggaagagaattatttatttcatatatttaatgtatcagaacctattttatatatactttatacatattatttatttctcataaaatgtaaagtatttccatttgaagaatcagaaatggggaaactaaatgaggctccctaagttcacaaaactaataaaaatcagaatcaaaattaaggtagcagtctaaaaccaaagccagtattcttcaatattatgccgcctatctatagtagatagtcataagacatttattaaccagtatttatgtatgtcttatggtaagtgaaacatcttctgctctccagtcacaacctagttgaaaaaagtatacacatatattcaatgtagaatattttttcttaatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaagttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgacattagtgtgatatatgttacagtgtatgaactaatattgatatattgtcatgcagagtctatagtttacattaaggttcattctttgagttgtatattctgtgggttttgacaagtgtataatgacatgtatctagttgtagaatcacatgctataatttttctgccctaaaaattccctgtgccacagctatttatcactcattcccttccagtgaacacctggcacccaccggtctttccactgttttgcgttttgcagagtgtcatatagttggaatcatatagtacgtagccttttcagattggcttctttcacttagcaatttttatttaagactccttcatgtctttttggcttgacagctcatttctttttattgctgaataatattctattttatggttttatccacttctttacccattcacctggtaaaggacattttgctttcttccaccttttggcacttatgaaaagaaactgttacaaacttttagatgtagattttgtgtggacataagttttcaactcataaataccaagtaacatgattactgtatcctatgttaagggtgtgtttgctaggccagtgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaactgccaaactgtctttcatctggctgtacccattttgcatggcatccacaacaaatgagaattcctgttctccacatccctgctgacatttgctgttgtcagctctttggattttagcttttatttaaatagatgtgtagtgatatctcaatcattttaatttgcatttccctggtgacatatcatagtgagcatcctttcatagtcttattttccatttgtatatcttctttaatgagatgtttattcatatcttttgtccatattttaatcaggttgtttgatatcttactgttatgttttacataaacatagagatagaacagaccattgtctccttccttcctatctgtattccttcatatattttggataacagtcctttatcatttatatatgttgcagagattttctagtctgtagcttgtctttttcattctcttgacagtgtctttcacacagtagaagtttttaattttaatgaaattcaacttaataattttctttttcatggattgtacttgtggtattttatctaaaagtgcaccttcagacttagggtcaccaagatttttttcctgtgctattttctaggagatccatagttttgtgttttcctctgtagtccatttggtataaagactttgtctcaattgactgttctgcaggtggatatccagttgttccaatactattggggtaaagaccattatttctcctctgaattgtctttactcctttgttaaaagtcagttgactgtatttatgtgggatatttctgagtgttttattgtgtatcattgatgtatttgtcagttcttttgccaaaaccatgatgtattgattactgtagctttatagtatagtaagtcttgaagttgagtagtgtcagtcttccaactttgttctttttcttcattgctatcttggctattctgtgtctttgcatataaactatttctataaattttagaatcaatttgcctgtatctacaaaatagcctggtagaattttgattgaaattgtattgaatccatacatcaagttgagaagaactgacagcttgacaatattgagtcttcctatctatgaatgtgggatatgtatttaaatcttttgttaatcacagttttctactttttttcacgtagatctctatgtattttgttagaattatatgtatttcatttacattatgctaatataaatggtattctttttaactttcaaattccaagttttcattgctgatataaagaccattgacttttgcatattaatcttgcactctgaaagcctgccatgatcacttattccagtagagttttggttgattctttgggattttttataccaacaatcatgtcatctgctaacaaagacagttttatctctttcttccctatttatataactttaattttctttgaatttaatttatataactttgtcttattgcattagctaggacttcctgcataatgtcaggtaagagtactggcaagggatatcctttccttgctcccagtcttagtgtgaaaggatcttgtttctcactattatgtgttgtattaactgaatttttttaatacatgttctttatccagttgagggagttcttctttattcctaacttcctgagcatttttattagtgttggattttgactagtgcattttttgtatctgttgataagatcacatgatttttcttctttaccatgttgatgtaatagattacatcaattgattttcaaggctgtaccagtcttgcgtaggtgggataagttctacttcgtcgttgtatataattctgtacatttgtacattgctcaattcagtttgctagtgttttgttgagaatttttgcatatatgttaatgagagataattgcctgtagtttttctttcttgtaaagtttttatttctattagagtaatgctgtcctcacagaattagttaagaagtattccctccgcttctgttttctggaagagattgtggagagtttgtataatttcttcgtaaatgtttggtagtattcatcagtgagtctatctgggccttgtgctttctgttttaggaggttattaattattgattaattatttaaatacatatctttctttctttttttgagttggagttttgctatgttccctgggctggtcttgaactcataggctcaagtgatcctctcacctcagcctcctgagtagctgagataataggcatgcattatctgtttcttcttgtgtgacttttggtggtttgtgtctttcaaggaattggtttgctttatctagattatcaaattagtgagtgtacagtttatagtatttcttcattattcttttaatatccatgggatcagtaatgatggcccctcttcatttctgatatttattctctcactctcatctatcctggctagaggtagaggtttatcaattttattgaccttctgaaagattacaaaattggcttctggttccattgctgtttttctattgattttgtttttaatctattgatttctgctctaattttattttcctgtgcttcagatttaatttgattccatattctttcatctcttagcatctcagttatacttttttaaaaaacttttttaaatggttcctctagaatttgtaatacacattttttttagtatagtttacatggtgaaaccccgtctctacaaaaaatacaaaaattagccgtgcgtggtggcacacacctgtagtcccagcacacatctgtagtcccagctacttgggagactgaggcagaagaatcacttgaacccaggaggcagagattgcagtgagccgagattgtgccactgcactccagcctgagtgacagagggagactccgtctcaaaaaaaaaaaaaaaagaaaagaaaaaaaaaaggatatggggatatggctccctcccctcttccttcccttttttttccttttcccagtattgatgaaagacaggaagtgattttaaatgcagattttttcaaatcaaacttcactaatagaattaattctggatttttttttttttttttttaagacaggattttgctctgttgcccaggatggagtgcagtggcttgatcttggctcactgcagcctcaacctgctgggctcaggtgatccttccacgccaccaggcccggctaattttttgtatttttttgtagagacgagatttctccatgttgccccggctgttctcaaactggaatgttattttgaaagcagtagttttaatttgggcaaaatggggcaaagtttaacataattcaggtcttattttgtaataaagactgttaatatatgatgagatatagtagaacaacggcttatgtgacttcaaggatgctgttgtatgctctttttgtttgatacagaagctcagaattatatttccttctttaacatattttttgagaccaaagtaagtgtaagtggcattgattagatagtatttctttttctcttgcatttccatttactgagaaagtagtaaaaatggcacattgacatataactagcagatttttgttagtgtgcaagacattgaagaaagggagatttggggtttgttttggagtaatcttggggaaacactggaacgtccataaggtattgttctttatatctaagagatgaacgtgttcttaatcatgggattggcagcaactgtgaattttctctagtctctgtttttgttagtccatttgtaatagtgatgggtggatttacccctgcctttccattggtaattctgtagaagtaaaggcttaggaaaatactttctctttgtgagggtcctttgtcaaagactgaaaagactagagagtggcatttaattctgcagagtataggtcatggtacttagttcctatagataggagttagcagtatatccaaatactttattccttaagaaacgattttttagccagtgaatgcacttttaattggaaggtcttggttttctcaactgtttactcctaataattcagagcgtgataagggatattttggagaaatgtattcattttttatttaggtttaatcttttgggtaaagtaataaattgtatacatggagtatggtttaccaagggtttaaaattaatgtaagagtaattccagtttcctcatatatactgggaatatatagctcttttatccctttattttgagagaaggaagtatatttctgtactcaaattcaaatctcttttttctattaactcacagacttttttttttttcttacagttttctgtatcctcacccatcagggcatgagtaaatgtttaaggttaaggaagcagaaagtttttaagtcctagaaaaaaatataattgaaaaaaataaatttgaaagagtagatttgtgacatgaaagaaactatgactttatcaagtgttattaagataagcttagccttatggcgatttattgttctcttattagtaactcctactctcagcaatgctgatacaattaggttatgactgatctcttttgtaagcataatttaatttcacttccacccaggaagtgtttttcttatagtaaatgaaggagttttagaatatagatataagataattgttaactggagggatagaaggaaagcagagaattagataagttatttttgacaatccttgtctaggagactattggattgaaggccatgaaaaaagaaagaaaaatataattggccattaaatatttctagagacctgttttgctgggcatagaaaagcaagcccatgatgttttttatttttagtacctaatttttcttttatctttattgaaatcctattgttcttaattgaaagtccttcattatttttatctaatactgaaatataaaaattaaattcagaataatcaaaatgttaaaaatagttgagatgtcaaacctgaaatattctcattcaaaaataaaaaccaaaaattaataaggaggctctttggccattatcatttagtctccagggtaattggtgaaaagtaatcaagtaaaagtcatatgaataatagtagttctcattaatatgttctgggcactatactcagtccttaatatgcatttcctcagtaattcacataaaaccagatttgatatgcacttttactattttcattgttttataacaaaattgataggcaatggggaacccaggtttatctgacacccccccccatccgcccccagagctagagagaataacagcttctggtttctaagtacagagtcagctaacatattgtatgctttgttgcttcacaaaattcaatataataataatggccagaatggaaatctgtccagcctcttttccttttttctattctcatgtctttcagaactttcaacaagtttacatagcttttcatagttaccttaatgtttactggtagccagttccttttagttggctaaataaaaagcctttaaaacctaggttcaaaatctaaactctttatgagccagttggattaactcattttgtggtcagagcctctgtgcatttttgattgattacaagaggaactagtcatagctcaagagaatcgtcacatatttatcacaccattagcgttcactgtagtatggtaactgtttttagaattatgtcatgatctgaaaaagctgtaactattatgtcaacctgaggaaacttacctgtttttgtgggctttctgtaatagtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacgttatctttaatgttagcaaagtatgtgttttatatagtgttttctgtataaaaaactataatttctatttactaagttgaatctatatggaatagtccataaaataaaccttacataccaactagttggatgtagtagtgaaaatcattcatggatatttcactctagtttgatatataaatctcttggattttcaacatagagtggggaagaaatcctaattacagttctcttcccattttaatttctcctcttttttttttttttttttttttttttgctgtttttctcaactgtcagtggaattattgtcttcctgtctccatatttaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttctttcagcgatgaggagttttcattcatttaacgttggaagaatggtgttggttttgagattgaatcttttctaaacaaaatctgaaagatatggtactataggaaaactaataaaaaatttaatagcaaggcttaaatattttatttaaggctatttcatttatatcagcgtcacatcaaatatctcaataggataaactgttcttgaggcattcttggttggtattaggagtacattggaatagtacagtttagacacagaactggataaattacttaaaattctgtgaaataatctttgtgattttttttttagaaacaagaaagcaatgtaattgaaaactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattctattttaaatagcatacacacacacacacacacacacacacacacacacacacacacacagcgcaagccagctagctgacttttgcccttcaagggcttaattaaagatgcatgcaactatcttctttacacagaaatatggggatttatcattcctaccagtcgttcctcatgtagtggatgagaaaacgtctgcttatattgttataaaatcttttcctacattggctacatcatagatattagatatgggccatcttttgccctataaaatcttaaggttaaagatttagccacattttctacgatataaagctttatttatctgaaaagtctgacaattttgaaagcatgtcacaagtttacattaatgcactacctctatttactgttttagattactacaagggaagacataaattcaaagcaggttgctacagtgaaagcagacctggagtctgaatcttttcgaccaaacctaagtgatcccagtgaacttttactgccagatcaaattgaaaaggtatgacatgctcacatatgtgcatttctgagtgtgagtgtgtacccatgagagtaaaacagcctctttttagttgtttctgaagcaacagcgttaatgctattactattccactccagtgaaaagaaagagtaagcaaaacatagcaactagtgttaattaagatgttaggagatttaggtaagcagacactaaaagccaatatttgttttattgttgtgtgcttgttacttgctttatgtggattatttcatgtagttgttacaacagctgtagaaattggatgctcttattatgcacattttttattaagttaaaaaatcgggagcacagagcgattaacttgttcaaggtcacacagggagaagtattaaagcttgattcctaacttggatagtctgtctccctagcctattatttaagagatattttaataatcaagctaatagtctatcaagtatttttgttaattcaatatggaaggcaaaagcattaagtaatctatgtttcttatctctgttctaatctgtgtctggttcagggtgattctttattttcctaatagacaattaatattttattctgagaaatgtgtaatacttttcaatcatcttagtatctttgagaataataatttctactgttaatttatttttatagcctatattatataggcaccattacattccagctggcattagtattctacataatgaacaacaagctatcaagtaaatactaacactttgttttctaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtatgaaacaccaactgcatagattgcttatcctttaagagcagtaacagtaacttttagcatatttatttgataaacattactttattagtgcattttattgtttaactgataattactgggtacttttaatatgcaaggcaatgttgagtattacagaggatagatatgagcatgatgattaagaattactgccttcaaagggattatagagtggtagaaaagaacatttgcacataccaacatctctaatggtggggaaaatggtaggtttcttagaacctagaaaaagtgaggaaataagaatgaggttcatgggaaaggtagaaattgacagaatcttgaataatgggtgaagttttgattaaagataattgtttgaaggtgatagccagaacaaaagcacaaataagagtaatattggtttgttcttcaaacagcaagttcaagtcagttgtaattggaaactaatgagaaggtaaaatagcaatattagaacaaaacactggtattactaacacttttagtgttttatgtgtcaggaacttgactaatcacttatgcattatgttatttaatcatgaaagccctatgagattgatactgttatctttatattaaagaatgagtcaactatgacataagctcatcaacttgcccaaggttacatacccaagaaaaagtatttgcaccaatgaaaatgaatgaactgctgctacatgccatggcataaatgaatgtcacaaacataatattgaattagaaatcaaacaccagagagtaactttcttatgatttcatttatagaaagttttatcagtgggccaaatgaatctatagtggtattaggctagtaactccttcaggtagttgagactattgatgagaggaagcacaaagagagcttctagaactagtagtgttctgtttcttggtctgaatgaatgttgcatgggactttgccatgtgatagttctaaactgagctatgtgtttatgttttgtgtacttttctataatgtatatgtaaaataacctttcaataaggaaatattttcaaaattaagactataaagatagaatgtcaggatagacagtgactgtacagattatctgtcagactctctgcactcccatttctgatgtggaaacttcagcccataacactgaaattacttggtcaatctcttattcatcaattttctcattagggtactgtgtgtcttgtataagatcatgcacagggttaaaggacaaaacaattcacacataacacctgccctcatggaatttactgtataatgataaagaaaaaatatcatattttaaaagtgatagaatgtttccctatactgaaggacttattttattaagcaccgcaatcccatagcatcatgttatccatatcatacatacattgtacatataagtcgtcctgaaatgtgttaaccactttttaagattgtctgcttaattactttaaataaaatcccaaaatttaaaaactaggaaaaaatctgtatttccattgaaaaaccaatatacttcatatttgacaataatgtaaattatatagcagctaaccatttttccctttttaagtatgattagattaaactataccagatttctattttttgcattttatttaaacatatatgatgaaataatgcttactggaataaatttgttagtcgtgtcattgaatatgccttttttatccttaggtttttggtgcgttagcatctgagccactgaaagtgagtgatggcttttatggtactggagagacctttgtttttacattctgtccggagtttgaggtaagaaccactatttcaatattttatttataaagagttgacataacatactgcccaaagcaatttatagattcagtgctattcccattaaactaccactgatattcttcacagaattaggaaaaactattttaaagttcatgtggaacccaaaaagagcccaaatagccaagagaatgctaagcataaagaacaaagctggaggcatcacgttacgtgacttcaaagtatactacaaggctacagtaaccaaaatagcatggtactggtataagaacagacacatagaccaatggaacagaatagagaactcagaaataagacctcacacctgtaaccatctgatctttgacaaacctgacaaaaataagcaatagggaaaggattccctatttaataaattgtgctgggagaactggctagctatgtgcagaaaattgaaactgaaccccttccgtaaaccatatacaaacattaactcaagatgggatagagacttaaatgtacaacccaaaattataaaaaccctagaagaaaatctaggcaataccatttaggacatagatacgggcaaagatttcatgacaacaatgccaaaagcagttgcaacagaagcaaaaattggcaaatgggatctaattaaagagcttctgtacagcaaaataaactatcatcagagtgaacagacagcctacagaataggagaaaatttttgcaatctatccatctgacaaaggtctaatatccagaatctacaaggaacttaagcaaatttgcaagaaaaaaaacaccattgaaaagtgggcaaagacacttttcaaaagaagacatacatgtggccaaaaaaacctgtgaaataaagctcaacatcactgatcattagagaaatgcatatcaaaaccacaatgaggtaccatctcactccagtcagaatggctattattaaaaagtcaaataacagatgctggcaaggttgcagagaaaaaggaatgttttattttgttgttgttgttgttgtttttgaggcagagtcttgctgtgtcgcccaggctggagtgcagtggcatgatctcagctcagtgcagcctttgccttccaggttcaagcaattctcctgcctcagcctcccaagtagctgggattacaggtgtacacaccatgcctggctaatttttgtatttttagtagagacggggttttgccatgttggccaggctggtctcgaactcctgacctcaggtgatccaccctcctcggcctcccagagtgctgggattacaggcgtgagccaccacgcccaactgaaaaaggaatgtttttaccctgttggtgggagtgtaaattagttcaactgttgtagaagacagtgtggcaattcctcaaagacctagaggcagaaataccacttgacccagcaaatcccattactgggtatttacccaaaggaatgtaagtcctcctaatataaagatacatgcacacaaatgttcattgtagcactattcacaatagcaaagacatggaatcaacctaaatgcccatcgatgatagactggataaagaaaatgtggtacatatacaccatggaatacaccatatacaccatgcaaactaatgcaggaacaggaaactaaacaccacatgttctcacttataagaaagagctgaatgatgagaacacatggacacatttcaggggaacaacacagaccttgtgtctgtcgcagggtgagggtgtggggagggagaggagagcatcagaaataatagctaatggatgctgggcttaatacctagttgatcggatgatctgtgcagcaaaccactgtggcacacgtttacctgtgtaacaaacctgtgcatcctgcacatgtactcctgaacttaaaagttaaaggaaaaaaaagagaaagagatggcataaatgaaaaaaccatgcactttggagtcatgcaagttgcatctgtcccctatctttgccttttactccctggtaacttttctttgaccattttgaacttcaactttcctgtagatagaatgaggaatcataaaatatggcatgatcatttaataattaaatgaggatcatttatatataatacttgggatggcaccaaacacaaattatggacttagtaaagaatatacattatcattactattctgtttacaaattgtcattgtgaaatttccagaaacatttaatgactaagcttaatgatgtaagtcatgaaagcataaaaaataaattatttggatttaaataacaagttattgactggtttctttttctttacctgtgtggctttactgtggcttgactaacacaaattgaatacattctcatgccaataaaatctaaaatgtaaaggtataaatgaattttagtgaatgtgtgactattcttaaaacattgagtgcaatattagtatctcgggcacattggagtgtggcatgtaaaaccttcattttaatctcaagaaaaggaatcaacaccattggttataaaaataaatgaagaaaataggaacgatttggtaacacaataaaaattcttttagcaaatttgtacttaactagctcaccagaataaccaatgcttttcattccttccataaaatatgtcaactgatagcaacagctacttgaaagcttgtagttattacagattttctaagcatcagtggtgcctattctcaaactttttatgttactgctacctgataagtgtaataatgtagtcaattaaatgttacataactatgaaaaacgagtgctaaaagaaagttttattgaaaactgtaatgaacacattttaaaaacttgataaaagtaagttgctagaaattgctactatgttaggtttaggtaaaacacccataaaaggttagaaaaagatatttaagaatattcatgtctagtttgctcttggatttctcaaatgattttaagttctcactgtttaaagaaattgaaactgaaaatcataaatacccattatggtcatggtttatttaagaactgtgatcagtaaatatatatgcaaagaaaaggccttggccctatgttaaaatattatccaattaacatacatttctgtttaatggtaaaagttaatggcatttgtgtccgattttttttcaactcatttacttctttctcaattttttctattaaccgtccaactcttggtgtctgtagagtcaggagaaagaagtatgtgtgaaaagttaacaaaattttgagaaattggaattgaaagttaagtgatagagtgtgtgctttcaaatttagtcatataaacactgaaacccaaaccaccagagccttctgtgcggagctttttgtggtgttcttattcttatactgccagtcttggctttgttaactcgtttgagttttggagaactaactctctataataaccatttcatctatatatttaaagctttttttaaatttatataggtctttaagtggacaggagataatatgttttttatcaaaggagacatggattcactagctttcggtggtggagggtaagtctcttgaacatttcactatgagatttttgaagaactttaaaaatgcatttggattatttataaattcagttgtctttagaaagtgttgacgttagaattcaaatttgtatattatgaaaaagagagtataatgtatttgcaagaagtagctcaagtgtagttattgaaactattgatggagtatttgtttcttcattttaaaatactgttcagtttattcactgtttattaagacccatctttttctttagagcacagtggctctttgataatataaagggaaatatctcagtacctttgaacttctctaatttttaaataactgtgatggaatattttatttctcccaatgcatagaacaagtccaattgttttcatgttattctactctggagaccatttggaatgatattttagacaataatggaaatggggtttttgcttgcttgttttttaacaattatgaatcagacaataatgtgattatcttggcattgcaagtactgtgaggagctttgttttttatttggtatcccagcctcctttaatctttgcattgttgggaggtaggctgctctggtcccacctagcctgggcttagcaagcaacaactccttcctttggtatttctgtctttcagtattagacatgggtatgctaaataattttcagacttgtaaaagtgttacattatttgtatcccacagttgaggatatataatgataatttattcagaccaccaaagaatattcatcatcccaggttattctattattaacaaattttcttacaacttctctgtaagtaggtgtttggaggatataagtagggtgattaaaaagtgatcatggttattgtagccttctctgttagttttagttgttgaactcagcatgtatttacatggtccaattataccttttggggggggtatcattcagccctcccctaaacagtagtcttacatgtgattctgttagctctccaacaggtccactcaatctagtggcttataatttcaagattttatgggtgctttaagtcttcaaaaatgtcatacacaatgccattagatgtctgctggaactagattttattgtacaacatgatttcaccaagctagagtaaccactgggttatttgataataaattaatataagttttcagtgtttaaaggagagtacagcttcagaaagcagaaactacagggagttgatattccagaattccaagggaaaagcaccccaaaagaaaaatgatgtagtggacttaatgtaggctttggagtccaatagacatgattcagattctcacttcaacatatgctgtatgtggtaccttgagcaaactccttaacaaatctaaactttccttagctataaattggagattaaaccagttttgtagagagattataaggaattcacaaggatataatttttgtgcaaatcctagtatagtatctggcatatagtaagtactcaacaactgatagccacctaaactgatagccacctttactcattttctttcatccaacatgatctgttcccttctgataccaggaagaattctgcctgcagtatcattggctgcatgagctataagacattaattaaagatttagaagactacttttattccttccacttccttagccattctcttttcagaaagtcgtatgaatcatctttgaaagcattgctcatataaaaatacactttctggctttctgggtgtttcacctgggacagatctgtaacctcttaaatacatttacttaaatatttggatatcacatacctttttgaaatgctgatgaaatgcagaggtacccattgtcctaaaatgaatatacaaataatccaattttatatgtgatattaagaaattgacaaaaatgttgaaagcttctactcagggcttcagaaaattcaggttaccttggaaaaaactattcatacttggtaataaaacttactgcagcatcagtgacattcatgaatcttgaaggtcaattttgaggtactacttagatgcagtcatctgagattacaactagatgtcttaatcttttattaaccctttcatatttagcagaaggtttttatgagcaagtctgaccctttcatattctcctttctaatagattggctatgatagtctattcgcgcttttaaggctcatggattcagatatctctttaaaggcatgttgttgccagtagagttagagtctctagaagtctattgtcataagaccataaactttttaattcaaatgcgtttctaatttatctctgtattttccagtgccagtgtctgaaacatgataaatgcacatttaaagttgaacaaattagacaaatatgaatttcaatttgaaccttaacaaatgatggcttcctcatgggacagggggcattttggggacgatatagttttgcagtgcttctgtatcacagactctggattgttatgattttcagggtgttcttgtatcttagcaaagtcccattttcatttatagaagaggttcatcagaacgtcatcactggttatcccattacagtttttttgtactgtcaactctcttcttgagtgacactggatgatctctttacctggtcattgtgaattactatactgatctgtcttttctgttttgttgtgaagtaccaactctttttttttttttttttttttttttttttttgagatggagtttcactcttgtcgcccaggctggagtgcaatggcacaatcttggctcactgtaacctctgcctcccaagttcaaatgattcccctgcctcagcctcccaagcagctggaattacaggcgcccaccaccacgcctagctaacttttgtattttttattagagacagggtttcgccatgttggccaggcaggtcgcaaactactgacctcaggggatccaccagcctcagcctcccaaagtgctgggattataggcgtgaggcactgcacccggccccaactcttaaaggaaccattctacatggtcactgtagccaccttctctacttagaaacacatctctatacttaaaatttgtatatgtaattaatatacattatatatttgatgctgttttttattacagagtataaataaatagttcctttcttttgttctaagatagtgttaaaaatagatcagttccaggccaggcacggtggctcacgcctgtaatcccagcactttgggaggctgaggcgggtggatcacaaggtcaggagatcgataccatcctggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaaaaaaaaaaaaataggtcagttcctctcccacacaagtcagttaactctgtaatgccatgtgactcctgatggcaagcctgaaggtcagaggttatagccacccaaattatagagttgtgtaagtctttacaattacctaatatgcttttcttttttgtgtgttttaatataattgacaaactctaccccagagaggttaagtgacttaactaagtttgacataagttgtggccactgagttgacagacaagtcttgatcccagaccagtttttttctttcaatgaaatataactgcccatattttttaaaaaagcctccgcctcctaaactctggctcaattctgctgacttgatatattactttagatttagagaatcccaagggatagctctctggatattatgttaattaatagtctttgccccctctcctcttctattaggtaggaaaacattttctagagaatagaaagaagtcctctcataacctggtgttttcccctctcggttatgtattagataattagataaattggaccttataatctatctgttaagttcctgttatacctagattatatcttggttcttctgcttgaatctcaacatcacatatttgtccatttaaagtcctttcaaactgagctcttttgcaaacagcttcctatgcaggaaaccagagttatttactaggtccttaacatgaatccccaaattttattttagatgatactgaatttttgtgcctttgcgaaagtcatgttaaatatgttaaaaccataccgaaaagataaacacacacatacacaaaaaaaaaaccatactaaaaaaaatacccaaagaaaaactcataataccaggcaaaaaattacagcgtagtacctgtctcaaaagctaatcctatataaagttcattatagaggacactgttcctggtctgtatcataaataatttttttcttttcttttcttttcttttttttttttttttttgagacagagtttcactcttgtcgcgcaggctggagtgcaatggtgcaatcttggctcattgcaacctccgcctcctgggttcaagtgcttctcctgcctctgcctcccgagtagctgggattacaggcatgtgccaccgcgcctggctaattttttttgtattttttagtagagacagggtttctccatgttggtcaggctggtcttgaactcccgacctcaggtgatccgctggcctcggcctcccaaagtgctgggattacaggcatgagccaccacacccggcccataaataattttttaatggaataggagtaaaacaaaattgtgtcagtgtggaaaggagtagggaaggatttgagaaaattaataactttagggttgttaggtattcaaagtctcatttaaattgttttataacttaaggcataaatattaacagattattatttatgtattgcagaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtgtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaa

SEQ ID NO: 1443 - DNA, 64741 bp, Homo sapiens
tcccgcccgcgccctgcccaccccggccgcgcgcaccacaacgcccccgccccgccgcccggaaccagctgagcgcagctggacccagcagccgctgtctccagtgccgcagcagcaggtaggggaggcgcgcggccccggccccgggcatctgggggtcccgggctgatttgagtccttcctctcccttccttcccggtcctatctcgcccgcgcctggagctcggcccggccgcgggggcatcgctggaaaagggcttcctcgctcacttttcccgtcttccaagggaccaaagagtgtggatgggagttgggggatggggagacgccggagcaggagaggagaggggccaggcctccaccccgtgattccactgtgctgctagcacctgagctaataacctcgaccccgcccccgggatgggggaactggcccggggtcacccctgcacttgggttgtctgacccgggcatgcaggggaccaccagctacggtctgggcggtgactctgctggggagtccactcagaggacccttgcctcctggacgatacctgtgcctgctctcctctccagctgcttcctctttctggggactgttagaaagttcttccttacactgtctgaaatcttcaggcgcctgctacctgtaggtgctggcttctccccggccctgcagtgttcccttccctgactcacacggaagcttcttctggagttgaagacagtgattggaaccccttctccctgagcccccatgtcttctggggtccagccccccagaacctaaataacagcaacttccctctggtccagtgcaggctggctggtctgggcagtgcccagggggaagccccagtccttggaaggctgggggctgggggtgtgggtgagcaggagacattggctttcttcctagctccttgtctgcccagacatctgtcgctttatcctgtcttcacaccctcctcagagcatggaagggagctttaaaacacccagaactcattctgggctgtcctgagggtaattggactttgtggaaggcggggcctctggggaggtgcctttcgcttttgtttggcatctggggacttttcaaacacttaatcctgtgtgtcctgttctcccaggaccacatttctgaccagggcaccaggacctctcaccgctctgccgtttacagcgaccatagcttgctagaatcttaccccatctccatttcctccatttcacagttgagaaaagtcaaggacccagagagtttatgatgggctaattgtcacacagtgaggcagggtagggctgagacccaattccggtctgccgtttgcggactccttgctgggagggactctagcctccttcttgggtgttccgtttactaaagggacaagcattccctgtacatacacacttgggggtgctggttggtgtttcttggggctgttaagggggagaggcttggaaacagaggaggaaggatgggggtgggaacggtcggctttcagctcctttgaaactccatttttctttctggggccatgctatttataaatgccagggaaattgtaaacagccaggggagcttgggttggcactcggtgagttacacagcagcaaagaaggtttctgtgtgaatcaggggaggaaagtttactccagaattttccacagtccttttattagggactaacatgagcctggaaacaggctgctcccaggaggggtggctgcagggtttgccccgcatggcatttccttcctccccgcctccctcctttcagcacttctctgggcctgtgttctgtgccttgccctgcgaggggccaaagagccttggaagaggacagagctctctgtcctcaagatgcttgccatctatactgtttgacacttttgtgccatattaagagtgacttcagcctgcaagaggagtgactaattttgtctaggtgagccagacctcagaatgaataatcatttaccaggagaaacaggagttgggggaaaagacattctgggaagcaggaaccactagtgcaaaggcactgagattttctgagccatccatgtggctagagtggaggatgggagaagggcggggtggtgggaggttgagaatctaaatgaaaatggaactagattataagctaagggtttggacctcatcctgaaggcaatgaagagctgagaaagggttttgacagagcagtgatttttaaaaactcgttattctgaatggctgatgtaggggatgcattgaacgaggctgatctggaggcaggaaggccctgaggaggctgttgcatgattcaagtgaagtagattgcaggtctgaactagagcagtggccactgggatgggtcagagcagcagattctggaagcccagctgaaggtctcagaacctgctataaatttcatctaaaagcagacaacaggctagacctactggagaaggttgctaaggtattcagcattgtaacttttttttctttttcatgagttttaaaacaaacaaaaattgttaaagaatccctccaagcccgcctctttccccagaggtcgccactgttaacaatggtgtgtgcactcctgccaaacacgttgattggatgccttcacttttagccatccagtgacagtgggtcactttcccctactccatgtgaatagtttgggtcatttgtgatgtgggtcatagagatgatttctgcttggtctatggtacgttgctgagacactgagctctggttttctttaagaaaacttttacatcctgtgtctgcggcctctgggtgtgtatatttgcttatcagagaccacaggtgtgagagaagttagaagcactgacttggaaatggacccccagtcttggttctttgggtgaccttgggcaaatcctatctctctgagcctctggttcctcatgtgtaaaatggagagatgttggtttgcatgataataataaaaagctatcttttaactgggcatggtggctcacacctgcagttccagcattttgggaggccgagttgggttgatggcttaagccaggagtttgagaccagcctggtcaacatggtgaaaccctgtctctactgaaaatacgtgctgggatgctcctgtaatcctagctacttgggaggctgaggtatgagaattgcttaaaccctggagacggaggttacagtaagctgaaatcacgccactgcactccagcctggatgacagaacaatactgtctcaaaacaaaaaaagaaaagacaaaaaaagctatcttttaatataccaagcactggaacattaattactttattgattccttgcaaccattcctctgaggtagatactagtatcttcttttacagatgaggaaactgagtccgaggctgaataacatgccccgggttgtgtggctattgggtgatggtgcaaggattccagaggtctgacgacagagccatagctattaatgacagcactaaacattctcttgaaaattctttctagtcctggtattaggagaactggtaagggagtttgttatgcttttatgaggggtgggtgtcggtgtgcagagcttggagagctcagccctgcagcagagaggcctggaggggcctcccggggctgtttgtaaactcatgctttcctgtgccatccgcaggaccctcagtgcaggtcaatctcccctccatttcagggaatccaggctccaaaaggacacaggacttgcccagcaaggtcatgtggtgaggtgagagcccagccaggactggtccccccttttcatcaatcaagcttatgctctggaaatctatctggcgaagccaggaaaactggacactctcctgctccttggttattccctgagaaaatgccagcagaagcagagaaaagcacgtcccaggggttatgcattttggggaggaagggaaaaaaagagaccagtgtttaggcagccgggggatgttaagtaaaaatatctcctcgctttcaacggagtgagcgtgtgtcatatttcagcctgatgtggtttgtgaagttggagaccacaggcaggctcagttcctgctgctggccagcttccccttccctctgtccctcccctgccatatgcctgctctcgtctgccctgcctgggaccacatcagcaatttaagaatagggcagagaaaagcagtgggtgttgtgggcaagggtaggcagctgaaggcctgggcttgggtcctggctttgccagtgacaaagtactgggtgacttgggctaatgcatgcctttctctgggccccagtgtccattctgcactgtagggtggacagcataatgtcagccttcccagctctgatggcctctgagttggagggctttgtgctccccacatgtacttgggtccggcatgtctgagacacaaagtgagcccgcagtggtgcaactggtgattcagctactgttcttgaatttaatcttttcggactgaattgattgccccattttgcagataagggagttgaggcctaggatttgttgatgtatcccattccctgctctacaagcaacaataataagggccaccatatgtaacacacttactatgtatgttcaccttttgctttcactatctgctttaatcttttaacagatctacgaggggagagatagtgactccattttacagatgaggaaactgaggctcagtttagaaaaatgaaaggacttacgttctcttctttgagtctcacaatagtcctggggttgtcattatgtgacccattttaccagtgaggaaactcaggcctggagacgtgagctcctttgcccaggggtccccagggcccacacacagcctgtcaggttccttcccaggccctcctgctcctccctcctcccttgcttgctctgcctcatggggagcctcttcacctcttgcattcagtgcctgggttaagggatgagaacagttttcttcctgggctataaagtatccctgaaattgactcttcccaagagtgatccagaaaggctttaagccatggagcctcgcagggaactccagtgaaggggtcgcaccagtgggagtggattcgtttattctgctgagctggctaagcaaacagtcctgttattttccaacctcaataagaatatcatcagagccaagcttatttgccaagcaaagtatatatattctacatatgtgagccttcagggtggggcttggcccttaatttccctgctacagagactgtggctgagctgggttttggtgggtactaagtaaatactagttaacttgttgggtgtgtgttgatgatgtgggtggcatatgtacttttttctccccacctccaaggaccttttccccccacccttattatttctattacacttgtgatagaaaatttaggaaataaaaaagtatatatataaaaaagaagtgttcataactaaccagagaaaatcactgccaacacctgggtgcccttccttcctgatattttcagtgcatttttttttacccccacacaattatcctatatttataattgtctgttctgactttctgttttttctcaacattatatcgtaagtatttttctcatgttattaaggattctttttaaatttaatttttaaaagttttaaaagcatactatacctaagtagataaatgtttattctaatttaaatcttttattccaatagtcctagggattaaaaaatgaaataatgctttttatttattaacaaaaaggctgagagaaacaggatttgcccaagatcacccccaaagaaccaagactggggctccccagggctgtagtttgcatccataaatacagagagaataatgtttataatcttgggtataaaaacttctggtgaaaaggttgatcaaatgctagctgtatttctcccccttccatggctttctactgagtctctctctcctacaggaccctactttgctccataattaagcagcaaagtatttcaagagctgttcagattctagaaactcatagcagatgaaatcgacagataagtcagatatcgaatatagacattaaaagatctgggcactaggctgtaccctgttattgtcagtggctctttagtccttaaacaagggtcttgcctcctactttttttttgttatggtagaaataaatgcccacccgagttttcatcactcactattattctatctttggtgtgcctgtaccatgttcccttaacaatcctcaattatgaaacatttaggcagtttataaacaatactgcaatgaacaacctagtgcatactttttttgtgtgttcttcttttattatttcctagaagtgagccctagaaatggagttcctgagtcaaaatgacacattttatagctttttcttgttaaaaaaaaaattcagtgacacttgtgaaaacacggtaaggaagtctttattcaggaacattgccttgggcatagggaccactgcaacagggtcctacagtgagggagagagtttgggctcaactcctaatacagcatgggcgagtgggaattgatagctgcagagcagggtaggggtcagcggatggaaaattactaagaggaagctcaggaataagggatattcttgctaaaccgacctaacaaaattattgatgaagacaaaccagggtgattcaaacatcagtgggggcatggtggaggatgaggagcctgatcagatatcaaggatgaggggttctggctaaacagacttagcaggattcttttgctaaaactggattttacaaggaagtgcacaggtaggcctaggagaaggttcagaagcctggctaaagtttggccaagcaaataatctgtgtcatgctaaattttgccaaatttctgctcataaaggttacagtagtccttattcctaccagccatccgtgagaatggcagcattcttcaggagcatctgaagctggttataaaaagctcagctgtccttttatagaatagagtacagcgaccattttcctgaaacgttacatttcattcattcatttggcaaatacacttgcacaattcagcagcaataaagcataacaagttaagatcccaggccgaagaagtggagagaacttggttctccttctggtttatgttttgcacttgccctaagaccttgaggacatcacctcactgagtttcatttttctcagctatacagttagggcttcaatacccacttcacagaattctacaaagtacctaacacaatgcttggccagtgcaatcatgtggatgctgggaatttgtattatctcatctgactccaaagagccctggaaaggaagcaggtagggacagatccttcccatttcatggactcagagaagaaacggccatgtttcttggtgtcctgagcttcacttcaggaactggtagtccaaaggaactgtatcgttcagaacggaggtaaaacaggcttttgtgggctagcctgtatccatccccctcccacctcccctcccaccacagtacctgtttctcttggaaggcaagttcccagttccagtggcagccagaattctttctatgctcttttagaaggtgggagatgcctgcctagactgttcagtggtcttaaaaaagagaccataaaattcatggttgcataaaatatagttttcatagatttaaattgcattttaaatgcactaaggcttcatctttgagcttttcagaaatgtgggatttcagactccatctttagggttgccttatttagcaaataaaaaacagtgtgccagttaagcatgagtatggcccttggaatgtttggggcataattataccaagacatcttattgtctttctgacatttagatttaactgggcatctcatgttttatctggcaaccctacccaccttgggtctactgaatccaaatctggattttcacaagatccccatggaattcgtgtgcgaattcaagtgtgagaagcattgcattgggagccttgccatcaaagccctgaatgaatcctttttgtaacaaatctgttggtaaaatataatgcactatttataaagagcctgattattcccaaatcaaccatttgcacacatctgtgtgttcatgtgttaggttttcttaatacaggctacccttgcactgttgtcagttgaagggaagaattccttgctttggtaagaagccctagcccctctcaaggacctattttcctcatctgtaaaatgggctacatccttagcatccgtgccagcctgtggtgaccagctgaggtggccccaaggggatgcatggctagagcccacgccaggtccctcctcagcctcctcacaaaggaccgaatgacttggctctgtgatcccatcccccagagactttggtgtgactgtggtgacccttggcatagcgcacccccccgactgcctcctcatctcaaaactttccaaaccatgacttttatagcagggctttaggaatcgcctggctctaccctctcacttcatggctacagatacttgtgccctgagagagcaagtgaatttcccaaagccaacagcaagccctctgattgctgctctaccaaaccaaaatgatttcagttctcatgaaacctaaggcctgactaaggaagattaagaaacctggtggtggtcgggtcctgtagtggggtgggaggaggggggagggatagtattaggagatatacctaatgtaaatgacgagttaatgagtgcagcacaccaacatggcacatgtatacatatgtaacaaacctgcaggttgtgcacatgtaccctagaacttaaagtataataaaaaaaaaagaaagaaagaaacctggtggtggtcatacgcctagtttgtcttggttgtgtggtcttgggtaagtcatttctctctctaacctattccctgcccccacccctccataatatggggaatacacattttcctgttcccctaggtctcctttctacctggttaaggttttattttaagatccagtggtagatcttggtctgtcaattggtcctagagtggaatgctttatgaaatcactggtacatgtgttaggtcagagacttaataccatgacatcatgaaagatgtctttagaccctttctctcctcattgctaacaaagattttatgaactgtgtttcagctggacaaaaaagatgttctagagcattctaagatcgcctggggcttttgttaaaatgcagattctggttccacaagtctggggtggggcctgaggctctgcatttctagtgatgctgatgtagctggtccagggatcacactttcagttgcaagatttgaaaacaatctgttattagtgtagaatcaatacttatgagataagggacttaagaggcaagtcccttgttcagggctaaagacccagtgacagtaatagggtctagcctggagcccagatcttttaatgtcttgtctttgacatctgacttatctgtctattttatctgcagctatgagtttctagaatctgaacagcccttaaaatactttgctgcttaattatgtagcaaagtaggttcttctttaggaaagagagtgactcagtagaaagccattggaagggggagaaatacagctagcatttgatcaaccctttcaccagaagtttttatacttgagattataaacattctttctgtatttatggatgcaaactacagtcctggggaggccccagtctgtttttgtatgcctctgagctaagaatggttttatagttttaaagtgttgttaaaaaacaacaataacaaacaaacaaggaagaatatgcaacagagagggtgtgtagcctatggagcctaaaatatttacggtctggcccttttacagaaaaagtttgctgacccatgatctagagtacccaaagatttgcatgttcttttttttttttttctagtcagcaagaggcccagccttatagctttgaaatatagtgaggtcaagacgtaggggaggcagcctgcgttggtgggaactgcccagacatcttagctgtgtgaccctgagcacattacttcacctctctgagcttgtgtcctagcttcacaaaatgaggacaaagattgctgcctggtagagttattgcaatgatgagacatgcctgtagagtttaacgcttggaaggtgcacagaaaatgataactattgttattaggggtggccatttgaacgcttatggcattaatggacagatatcatgttactcccatcaggtctgaaggccctcccaatgaactgggagcagtcttttaggagagaaaaatactctgctccagtatccccccatcccacctccagagcagaaagctcctttttagccagctagacagacagggttccatggtggcttgcagactttcatcgggcgagctctctccccaaagactggcctttccacagctgagactattagaaggcgtcttctgttcctatgtcctaggatgtgattcagcaaacaggcacgtagtgagagccccaggctgggattgtgagtgctggaatgaaacccttctctttatggctccatctggagtgtgtgggtggtggactagaatcagtggttttgctgaccttgtttttaagctgctgcagccttaaggtccaaaatggaaaacagaccaacttggagttagctggggctaattctaaacctggctgagtttgaaaactcagctcctggggtgtgtctgaatctcagggagagtgtaatgcttttcttgcccatagatggcagcatctgcactctttgccggctctgtgaatgtgtgtgtgcacgtgcacgtatgtgttacacacgtgtgcacgcatgggagtcatagtttcttactttggtaaatcttgagctgcggtggtcccagccctaggccaggctctgggatacatgggagcaattggggaggctgacttgcaaatagactattacagtagagtgtgaccgggcagattagggggtgtggaggtctgtacggagactacacggaggactcaggaacagagtgccattgcatctggctggagcctggtggggtatagtggaagacaggaagccatgagggccaaggctcaaggagttgaaggggacaggtcatgaagaatgtggagagatttgttaaggatcttggactttatctggggccatagtggagccatggtaggtctgggcagaggagtggcatggtctgggcttgctctaaggaggatgcattgtaggagggagaggttgcaggaggatcagttaggaaggttctgcagtcatgcaggcaagaggtgatggggctatggacccagatgttggcattggggtggggagaaggggggacactctggatgcagtcaggggttgaactagcaagacatggtgatacactggaggggagagtgacagagcaaaaggggtgagtggtgtgttgaggagggtgagggcctggtgtctggactggtccaccgggtggatggtggatggtggatggtagtgctgtttgccgagatgaggtgcagtaggggaggagcacattgtacttgggaacaaatgcagcaccaccatgtgcatctgaggatgagagtgcaatttggggtgtgtagaaagaaggggggctggattcgaaaggctcatcctcacacagagttgacagagtgcgggaggtcattagtcatttgcagaaacaacagaacccaactctgctttggtctgtcccttggaaccaggaagtttctgccatagtctttgagaaagacccacagaggtgggcaccaggtcctgcagcccagataagtgtctggcctctgacctctctggttttgggtaccgtgactccacttccgtggctgtgtcccgtgtcagtcacaatgcacaagtcatcaggactgtctgaaccatttactgtcagcctgagaacagggcttgtttgtgtcttaatcccaggagcctgcacggccctgccatcttcgggatcttggactctcccctcggcttagggaagctggtttaggcagagaaattttccagtgtgggcaggagccagtttgctcagcttccctctgaatgtagatgactggaattcttagtggcgaagaacggtgaagatccaagttgtccctgagaggcgggaggactgagctgcatactccacgatgagctgatgtgggatggtccttcatccactcatctagcatatgtccactggcactgccatttgcagggcacatgccatgctgaagctttagaggtgaagcagacagaatccttgcctccaaggagcttacagcctagagggagagaaagtcctatcaccagacactgataatgcagtcttgctcagcagtagtgcattagaacaataatagactgatgctgaggtacagagctgcgaatatgacatatcaacagggtgggtccccaaatcgcacatgtgcaggatgagaaagatacaatttgcaggcaaaagacttagaaatttaattattaataatcagggtaataattagagtaaacacatgccttgtgcaaaaccctgaacatgttttatctcatggtaggttctaatattatccctctttgaacagcaaaggcaactgagactccgagaagtgatgtagcttgctcaagttacacagttaagtgagggcccagtttatataacttcagagtactaacgtacagctctgaagttgactgtaaactgaattcagccatgcaatagggctgccttaaatgcaaatgggattttaggctcaattaatagaagcatgatatctctaatgaaggaggtgagagtcctgcttgccctgtcctggatagagcttgactgattgtctaattctgggtcttgtgctgtcagtagggacaggtttcatctggagcagatcagggaacagggtgagcgaaccggaaaccctggtctcaggaagagctggaggaaagggggtgcacaatttgtagaagacttgaggggcccaggatcactgtcttcaaatctccaaagagccatcaggaaagagggggacagacctgttctggctgacccaaaaggaggcagagctaataccagcaggtacaaggcataagaagagagagattttagtgcatccttaggacaattcttttacgcagccaaaccctccagcagcaggtcttgcagccttggcaggtagtgagtgcggtgttgctggatgtgtgcaagtactgattgtgtgacccctggtggaggggaggaaaggggttgaaacatcaaatggggatttgaccagatgaccttgaactccccctgaggctgacattctgtgccctttgtttacaggtagtgctcatagctctctttgtccagtgcttcggccttggtcccagcgccttcccacggagcagcactcttcaccctgcacagccttgttaggtaggtagagcaatacagacacctgtcgtcctcttaaaccccgccctggctgcccagggaagcctggaggggacttcagtggtggaagcagccgctgtagccacagtggattcagtgggagtccctgaggtcttcctaataaggctcagagtgcgtctctgctcctttcctgtccttgagagggaggtcaggcgagagtgatcttgtagggaggaggccgggactgggctcggtgcccggatgcctggctcccaccctggctgtgctggttgcttgctatgtgactttaggagagttgctttccctctcaaggccttggttgctattctgtagaagagcagagtccccataaagaggaggtgcaggaattcttcccagaggctttggagaggtgagaaaaatgggggtccatttgccaagtctctggacttgttgaccagaggaggagcacctgaggtgtgtgagtcatggggaagcggatgagtcatgcccgctggggccagctggcagggtggggcccacctgactatcagattcacaggtgacctgctgaagtaggtggggaggtggggggaggagtgcagagtcctgggctggaagccaggagactggctcacctcccagcttcagcctcggtttctccacctgtaggatgggtgccttggtctccccctacccacctaacaaagctgctgtgtggacccaacgagcttgtagatgccaaagggctttgtgaccagtgagacaggaaggatcactactagggggaatcgcccagcttccaacacccaaacagaagtgaatttctaatgagcaattgtgcaagaacccaggaaaacacccctccaacccacgccatcccttttctgccaaaaggagaaggggatgaatgaatacaggacttacgcgtctgctgtggcccagctggcttccagatggtgacatgagccacccacagccggagctgttcctctttcccaaagctcaggtgaaagggctttttggtggtccccaggatgttgtgccccaaaagccagggattcccaaaaggtctgccgggcccagaaagctgactcaccccatcagcggctatccaaaggttctgctgacaaagaggtagccctagtgctgccctaataggaggacttgagggccgggtcttggctctgatgcatctgcctttgagactgagccctgataactccaaaagccaagttgcctcaatgtaatctgtcaacaaaaagaatgttatgctctgttgatgcttttggtgactatgacacaggggccctgtcttccgcagaccctgcagggccaggctggcatagacccagctgagcaaccgtcgcctgagagctttgcttattcatccctctttactcctctgccccctgcaatgtaccagccctgtgcccacctccacggaaccttggttcaatcagggaggccccagtgacctcctcgatgtccaatccagtgctctttcctcaggactccatgtgccagtctctagtgcagttccagaaactccctccttttgcttctgggaggctgcactgtctggtttatttcctcttctctttttagttagggccctgtttttcctcctgacttttttagttagggccctggttttttcagttagggcccctcctctctttttagttagggccctgtttttcctcctgtcttttttagttagggccctggttttctttttctttctttctttctttttctttttttttttttttagacggagtcttgctgtggtgcccaggctggagtgcagtggcacgatctcagctcactgcaacctcctcctcccaggtacaagtgattctcctgcctcagcctcttgagtagctgggactacaggcatgtgccaccatacccggctaatgtttgtgtttttagtagagacagggttttaccatgttggccaggctggtctcaaagtcctgacctcaagtgatctgcctgccttggcctcccaaagtgctgggattacaggtgtgagccatgacgcctggcccagggccctgcttttcctgcctcagtgttccctaggattctgcccaccttcttgtcttgatttatgtatataggttcattcattcattcattcattcattcattcattcatatattcattcatttgagagatatttaggctctgagctgggtgttgaagaatcagcaaaaaacaagactttcccattcctcataggtcttcagtagatcattatttacactgaagattaattcttgctgtgaaggaaacgatcaggttatgggagcgtttgggattgggtgggagtggtgaggtcttatctggacagatcagggaagcctcccctaaaaagtgagacctgaagagggagagggaggtggctgagtgagcagggaatggaggagccccctaggcagagaggcgacctgggtaaggctttagtgagggggagtccttgaggaactgaaagaagtgagggaggctggccagggaggggggcgtggcaagaggagggcctgggggccaggcagcacctaggttatgtgggcccttgagtttggattttatgctagacctctgggaaccattggaagttttaaagcaggagggtgacttgcccagatttcattatcagaacccttgaaagggacagacacaaggaccatcctgataagccatgagggtgcaatttttggttcttccacatcagggtatcctgatgctgtgccttggtacggggcttgtcattgggcagtcctgggaaatgtgcactttcccaggattctctcagctctttgcattttttagtttacccggccagtccttgctaagctgctgcagtggagagggaggtgaagcagacaccaccgggccctctgagatccactctaatccaagacggagacagtggaagttaacgcccagagtgctctgtgataagtgccaaggggctcagggagacaaagagtgcttttccttacttgagagtcaaagaaggctgagaagggggagttgggcattccaggcaagaaggcaccgtaggcacaggcttggccgctggaagagcccactgcgcctgggggctagtgagcaggagtgtgagggttgaggtggggagctggttagagaggttttgaatgctgggtttctatcctctgggtaccagggagccatggacaggtcctcagctgaggagtgacttgatccatgggatttcagaacaattagtccatggcaggcagagcggagggtggatcagaggacagcagcactgggagctggttggagagaatgagtaccattgctgaagccttgtcactccccccaccgcacacacacagcaacatcctcaacgcccctttctgttccatacctctgttcggttatccccgaattggccggccagcctgagctgtccagagccctttcacagcagcactggggtgtgttaaaccctgggctccagaggcaaacaggtctgggcctgaaacatcaccgtagccctgacttgctctgtgcccttggacaagtcccttactcttctcagcctcagtttccacatctgtgaaatgggggtgataatggagttggtgatgattaaacaatggggaaatcaagtccttagcacatgtctggtgtataacgatggctgtgttagctttgtgtccttgttgattgtaatggcccagtccatgttgtaatctgcccctcagggagttcttgtctttggacataaatctgaattctcaactagaaacaagatgtccccagcagccccaaaggaagcctctagtgggacactgaggggattggacatgctgttacccactgggacccggcacagggctgggcacacagaagcctggactgggttttatttgttcctttatccccagcactcagcacaaggctggtacagcatggccaggtggctgggttctcaaaaatactaaacaaaaaaatgaaattaaaaaaaaattattaatcttggacatcatcccccagcacctttattttacagctgaggaatctggggcccagagaggaacagtggctcatccaaggccactcagctcctcagtggcaggccctgaacctgttcatttctccctgctcacatgtttattacaattctaatttttgaaatcctggtaagttaaaaatggcatcatgtcccacctccctaatttacctttggggaaactggggcccagagaatggtagtgactccttcaggtcctcagagagggagaagcaggaaaagggcctcctctccacaaagcatacccccactaatcagcagtaggcaggcaggttcttccccccaaaattgacggccttgtgcttaaggaagcaaagtggagtgtgaacaatagtttcctgaggaagtgttgggttttaattgtgttgaggagaagaaccatttccggaactgtgtgtgcctgtgatgcctgcggagttggcttggcacagctatttccagactaatcctgagtcctatttataggctgagatgattaggttggcctgtgtcaggagaggcccacatagctccccccagcctcgcgatggccgaggaagaagccctcaggggcaattctgacccatgggtgagtagcacgggatctggggtggtccccgaagccagctcagaggagggacgccagggagacccgagggaaagtcccgctcctgactcctagttcaacaccagccaggccccctgcagagatgaaaccagttccaattctattctctccctgcttaaaaatcctcagtgtgtccggtcaggccaggactccgtagcagtcagaccccttctccccgaggtatccactgtctcaaccccagccatgcttctccaaactgtttacgcttccttgtgcaggccacacccccaagcctttgcgtctgttgttcccaccttcccaaaagggaaactccatttatcctccaaggctctgccccaatgcccctcctccgtggctctgttgggccatgggtgctccctcctttgtgctcccagggcccacaactgcttgaatgactattggtgttcctgtttgtgtgccctctgggccgggaagtcagagaaagaaaggagacaatttgtgattgaacagccactgtggccatcattctccttacctgtctgatgagagctgatcttcatgccactgtgtacagtaggtattttttaaaggtgtgtagaagtgagagtcagacttcggacttcagagtcagacagccctgaattcctaatggtgtaaccttgggctgaacctctctgagcttttgttcctccgtctataaaaggagacaatgccagccatgggttttggggaggattcaacaagacaatgcttataaagtacttatcatcacaatgggcttctatgagcataggaggtgttatttgcagatggggacgttcattccggggacgtccctatctagggccccacacaagggagtggctgagactccaagtcttggagcctccgactccaccctgtgttctccctcccctccctctcttggccccctgggcctattctcttccccagatcagggaaagctttgtttggcgattgtttttcctaagaagtttcctctgtggggcctctgggtgactcagccctgagtcaccgggaggctgaggacagggggaggagtgggagggaggcggagggaatggagagacgagaagaggaaagggctctaattctagccctggctctcccactgtttgatcaactaggtctgaccaggcccctctcctgcctagcctcagtttccccaaatgtgaaaggaagatgtgggcccagtcctggctgagcctcagaatcagaggttcccgggccccaccctagacctacagactcagaggctaggggtggggcctgggaatctattgtttcctgagctccttgggtgatcctgctgcacacctggtccacagaggtgttagggaactgctcggctcaaactggctcccagctgggcctcagagcagctcggcctctgattgaacttcactgacccacagggagcgcccttctcttgcagaatgctttggcagaatagtacacaggaagcgtgtgggctttttttttcttttttttttaaaaacagctttattgaaatataatttacatgatttattggagtaaatttacatataatttacatacacataattcactcaattcaataatgtttagtacatttacagagttatgcaaccatcatcacaatccagttgagaagattttcatcatccccaaaaggatccctcatgcttgcttacgtccatctctatgcacaccccatagctgaccacgcatctgctttctgtctctttgttgttttattgttgtattttttgtcacccaggctggagtgcagtggcgtgatctctgctcactgcagcctcaacttcctgggctcaagcgatcctcccacctcagcctcccgagtaggtgggaccacaggcacacaccatcatgcctggctaatttttgtattttttgtagagatggggacttgtggtgatgcccaggctgatcttgaactcctgaactcaatggattcctcccgcctcagccttccaaagtgctgggattataggcatgagccacctcacctggcctgctttctgtctctccgaagatccagagctgtgttcattccagctggccctgtgacctcatgcaaattattgcccttccattactcctctgtatgagagggaataatcctaccctccttgtagggggttgtttgaatttcactaatgtgcacagtgtctgacgcacccgaggagctgggcacgtgggaggctggtacgcagggcacaggacataacacagatgcccaggtacggttggcacaggcctagcaaacattttaaagcactcactctgtgccagcttcttagattaagcatcttacatgcattacctactttaatcctcggtgaatgtgagtatcagtttcattttataactgaagaaacgggcactgagacgggaagtcacttttacaggctcacatagatgatagttgatagggctgggagtccatctgagagcctgtcctccctaaacatcatcctgtccccttcctgatgtgaatcaccaagcaagggacaacacaattcatagatccaggacaaggtttatggcacatacttctaaggggtgggacctggtatcatggacacggcattcaagagatagtacatggtatagagtctgtcacaaaacagacatcacatggtgcatgaagcatgacccaggggtaagaggcatgggatgccgctaaagggagacacacaggacaaagcaagaggaacgcagggcctgctacgtggcacagtcacagggtatgtgacactgggcatgacaaactctatgatgcagagacatggtacttaggatttgagacttgagctatggcaactgggcaggctcttggccacagtgggaccctttgtcatcagggatcctccattatgttggtgcctggggccccagcaagcaacagcaggaaccaagttcctcctcctcacaaaggcagtctgttttttttttcttttttttctttttttctccctcctcctccctgtctctttggatgccaaagagtgggaggggcccagcggagtggtggccagagtaaccccccgccatcccatcagctcagacaagggtcaaagcttggggccaagcccacggctcaggaagggtttgccaggcccccagatcccctctctctgagatagctgtgagcaccagtgttggctggggtgaaagccgggtaattttcctctaagctgtcctccctccgctcccctccctgcctgctggtgctggctgtgagcacgtctgcattccagagcttaggagagagagaacctgctgctgttaaggttgaggaagtagattgctaacagctgctgtaggaggggttggatgtgcggaagaggaggccgtggattgcaggctaacatttcttgagcctcttggcacctggcactcactacctcatcttgtctcatttgcataaagccccagtagcccggtgaggagacaggcccagagaggcaaagaacttgcctaaggtcacacagggaggcagagccaaggctagaccttggtctcccggaggcaggcaggtgaggttgtatagaggtgatggcacaggggatgttgttggggggttagtgggcaatgagactgcaagggcttgtgggccccatatcacagaggaccgaactcaggagtcctgacttctttctgtctgcaccgaggtctgcagaagggatgatgcaatctgtatgagtgacaggcccagtgcagagagagtttaagggagtgagggagctgatgttatgatcccagggaaaagatggggacaccaaaccaggacagtggctggagtgtgggggtgagaagtgggtataaagtggagaggagatgagcttggtctctgctctggtctcagcctttatgtactgtcttggtgggatgaccgtggttgggtcctgcctccaagggtatcccagagggttctagaaactcccacatggacaggcacttgaaggatagtgctggtgattgggcaggtgcctggatggaggtgaggcctaaagcacacccggggacagaaggcagcacccacacgggagcccagcttcgtgccagggactgtattttaggtgctggatcttgtttaaatcttccggctggctatgattatcctctaagctggggaaggaagaaaagcattccagtactatacctctgtttgggttaaaggaggggaaagtattttaaataaaacctattagagttaaaaggatgagtagcaataaaaatatctttgaatctctgatggttctattgtagtcaaaagttttagataaattgtgaagaatctctaatcatgctatgtggagtttttctcttttaaaaaatacaagttattgtatatacttaaggtatataacgcgatgttatgaatacatttagatagtaaaaaggttactatagtgcagcaaatgaacatattcatcatctcagctggcacaaaagtaattgcaatttttgccattactttcaatgacgaaaactgcaatacttttgcactgcactaataaaatctgctcatttagcatgaatcccaaaatacagtacaacttattccctatagtcctcatgttgcacattagtgctcttttttatttttaaatttttatttttgttatttttaatatagagagagacagggtctcacgacattgtccaggttggtcttgaactctggggctcaagtgatcctccctcctcagcctcccaaagtgctgggattacaggcacaagctctctacacttgttcattccacgtatctgctaccttgcaccctccatatcctcattcgtggattcaaccaaccacagatcagaaatattaaaaaaaaataaaaattaaaaaaagtaaaaataatacaaattttaaaaacagtgcagtgtaacaactatttacatagtttattgttacatagaaatttacatttacatttttatgtaacaactacagtataacaactatgtaaatagcatttacattgtattaggttttataagtaatctagagagatttaaagtttaatacatgggagaatatatgtaggttgtatgcaaatactgtactatgccattttatatattggtgtacagcatctgcagattttggtatctgagggaggtcctggaaccaactgatcccgcgtggatagggagggacaactattctctgatatgtctccccactggacttttttttttttttttttttgagttggagtcttgctctgtcacccaggctggagtgcagtggcgcgatctcggctcaccgcaacctccatctcgtgggttcaagccattctcctgtctcagcctcctgagtagctgggaccacagatgcccaccaccatgcccggctaattttttgtatttttagtagagatggggtttcaccatgttagccaggctggtctcgaactcctggcctcaagtgatccacctgcctccgtctcccaaagtgctggaattacaggtgtgagccactgcacctggcccccattggactttttctctaactgatttgtacttgtatcaagttctggtgagtccgtgagataatatggccattctatccctgtggacactgaagctcagagaggttgtgtcccttgctcagcatcactcagttgtaagtgctaggactgggatccagagccctcacttttttgtttttggttttttgcttttttgagtcagggtttcactctgtcacccaggctggagtgcagtggcacaatcataacttactgtagcctcgacttcccaggctcaagtgatcctcccacctcagcctccccagtagctagaactactggtgcatgtcatcacgcctggctaattttttaattttgtgtagagacagggtctcactctgtttcccaggctgttctcaaactactgggtttaagctatcctcctgccttgggctcccaaagtgctgggattacaggcatgaaccaccatgcccagccaagagcccttgttcttttgggtgaggcagaacaggcaaagtcagagaggaggggagggggtgtcattaggagtctcatggaggggattgggtagcaaggctggctctgtaggtgttggcttgaggccctctcctgagatgcatccccatccctggtaccagccttgtttggaaccctccctgtctcccttgctttgtatgcaaagacacagaggtagagggctaggtatgaggtaggtatagggcaggtataggggccagtgagctgtatgtgtgtatagggtctggacacatgctgtaggtcatctttggatgttatgcttactgagcacctgctgtgtgccaaacacagtgccagggctccttcagtcctaccagacaccccaccaggttggcatcttcacctcattttacagaggaggaaattgaagtgccgcagaaggtgccactggctcaagttccctggtggtagggatttgggctctgtccagattcatccctgtacattgcctcatattccttaggttggaaggtcacttgtcctcaccctgttggtcatttttggtatctccagcccacagagactccgcaggcactcctggatcccattgtcttttccctcttccccgcacctgcccccttttgtctttctcagggagttctccctgcagagtgcctttgcggggcatggtccacggatccctcacatttatggtctcatttaatcgtctcaactagccttcaagaaaggcactttgaccccgattttccacatccagacaatgggctcacacttcctgccagagcccagcaaggaggaaatcttggccatagttggtatgggaggcttggggacacagaagggctttgtttgaagccagcagcaggagggatgtggcaccatcatctgatgtgctgcatcattcattgtccccatcgggaaggtggttggcctggggaagcttccagcattcctggtagatcccagtgaaggatgaatctgatccctaggcaggcaggaggggaccctggccagatgcacaaacttgtttgctttttgctgtgtgtcttttagcatccttgagtcccagggcctgaagggttcttggacatgggccgattttcctgtcacctatgtcccctcaacctcatcaccactgggcagctcattatctctctggaaaaggggaaggaaaccagcatttgtctttccatttttttttttttaaactgtggaaacatacacacatcataaaatttgccatttaataggccgggcgcggtggttcacacctgtaatcctagcactctgggaggccgaggagggcagatcacttgaggttaggagttcgagaccagcctggccaacgtggtaaaaccccgtctctactaaaaatacaaaaattagccagaaatcacttgaacctgggaggcggaggtggcagtgagccgagatcacgccgctgcactccagcctgggtgacagagcgagaccccatctcaaaaaaaaaaaaaaaaaagaaaggcatttttaaccctatcttacatgtaaggaaattgaggctcagagagatagaaacttatccaagtctctcttttaacaataaaagcagcctcctttatatgtgcttattctgtaccaagcactgtgctaagccccaaatgttctttaccttattaaattcacacaactaccctaggaaaaaagtattataatccccgttttatagatgaggaaacggaggctcagagagccaaaacaacttgctcaaagccacactgctaataagtgatagaccggggacttaaatgcaggcatttctggtgggagctctttccacgatcacataacagaaggttgctctctgtttttctccctcttggaaagtccttcctctgcagagcaggaagctgcctcctgtggcttctcctgctcattctggcttgggttggggcattgtagaccctgccttcccctgcagctctgcagagcctgtgactctccaaagtcttctgctggttccacggtcccagcatctgcagccaggcctccctgtcttgttgtggatttgcgtttgtgcctgggcttcccaggggtgggtggtggggtgctgaaggggctaggacagttatttgcagccctggctactgacccaccacacctctcagggccatttcctccccgagagaaggggagacagactgctgaagtgggtcctagcaagaagggcccagagctcatacccatggccaaatctggctgcttccaggacatggggtcaggaagtagcagggccaggcccctccagatgtccagccctgggtcccagcactaggtggggctggctccggaagctgggaaaggaccatggctttggtccctgagacagttggtctcctggagttggcttcagccaagccccgctggccatctccccaacagctggccactcccaggatggacttggccaaagcagaaggccagccagccccgatggggagcactgctgtgtcatggagacccaggcctcagttctggcctggttgttgagagacctgagttctagatctactctgccaggcacttgtttgactttgtgaccctgaaaagtcaccctcttgttcttggtgtgatcatctacaaaagagaagacagactaatgaacactgctgctaataagtcctgctctgaacaacatactccaacagtctcacttctgttcccccaaaagtcctgcaactgggcatcactgtccctgtttacagatgagtgacctgaggctcagagagggaaggtaacttgctctgccttacacagcccagacctgaactctagcgtctcaccgtgaaatctgtaacgtttctcccgcaccatcacataccgaaggcaggcgtctgtgcagaaaacaggctgctcagaaagaagagtgcttacttttggcgagctcctgtgcgtcacatcctgggcttcctcactgctccatgctctaggtaccattctcccccttttagagatgaggaaactgaggtctggattgcagaagctgagtccagattcgcaaacctgtccacagggcttgccggaacttttccaggccctgttcagttccactgggtttcataactggcttctctgtttactgaccattgtcccaattagcaaaatccctggtcagaagggcgggtgctcctaggaggacccagagaacagcagtgagccaaaaagtaaatagactccaagagagggctttccatgagtggctggctgcctggaaaatcaagaacaacagtgtttggagtgaagagaaaagaacagggtggtgtcttccaggcccagccaaggcctttttgtacactgtggctggggatggaaggggcgggggaggccacctcctctggtctctggtagggggtcccgcagacatacagagaccaaggttacagaggaaaggagggcccagagctggttgtgttgtggaggtcctgggtcaactacaggggagggaggggtcccccagggggacatgggctgtacagcccccatcctgtggcagacacagagaatctgcctactgtgtgcctggagctgggcaggatccaggaatagccgagatcagaggtcaaggagatctccgaggtgcacagaagcagagaccaggacatgctcatgtactgagttggtagcagaagggctgcctccaaatcaaagaaaccatgccagacctgagtgccatgtggctcagagggcaggtgccacagccagtcctgcactaaatggccacagcctggggatcttccaggcctttggcctgggcagtcacatcaggtgtgtgaaaggctagagggctttcccggtgtcacctcctgccctggcctgggaagtgtcgtggggacagctgctccggagactcctggctgccaggcttgacttgggcttgattgatttagcctgttacctggaaagggcactgctgctccctgcccaggtcaggtggtgctaggagctcctgcttggtctccgcagacagagcctgggctctgaagccagtcagacttgtgtttgaatcttggcaacacctctttccagttgagtgacttgaacctccctgagtctcagtttcccaggctgggcccagaggtgaggtggcatgctgctatcagtgactgcagtgcctccttcctcaagtcaggggctgtggactgtctgatccagaacggcctgcagaggtgacctggccgaatgtacccattttacagatggaaccctgaagctcagagacttgtaggtcctggatttggttgtacaaccagtatctggtactgcttgggctaggaaagaggcttcgagtcagagcatcaggccctaccctgtattttgcatatgaagacactgaaacccagaaaggtacagtgacttgcccaaggtcaccaggaagtcagtgtcagagccagccctagcactcgggcctcttcctttccacctaggggtccttctcttgtacctgaattcccccattcccttgaactcatacatcttcttccaggctggaagcagagtaagacaatgttgcccgcatcatggtctccactcatcagtgccctgtagcaagggctccagggtctgtagtgagggctcccagagggcaagggtggggtctgttcaccagctctcctgtgccaagggcctgggctccagagctatatggcaggcaaagctgcaggccctttgtgatcattaacgtggtccctgggttgatggccagtggcctctggggccaaggtcaagccacagcagcccctctattaatcaccaactatgcaggtcagagtcacactgctctggaaggggcccctcagctgggcagttgctggcccaggttcagtctgggggctgggcagctaagaaaatttcttcctacttgtttgaattttccaaattgtctaatgagcaggcatcactataagcatattttaaaagggattgtttctggatttgtgttttataaaagaacaaaactatattggatatacacttgtaaagtttcaaatgctacggcaatgcttttacaattttttcggctagtatattaaggtataatttacatatcatagtgattcacacactaagtatacctatagttctatgaattttagtagatttaattggttatataatcttcaccataatctagtattagaatatttttatcaccccgaaaagttccctcatgccaactgcagtgatctaggcacttcctccagcctcaggcagccacggcaatgtttgaggatgaaattctcctccttcttccctttccagcaaacggccttaacagtttggtgcttaccctctgattttttaagggtatatgcaaaaacaggcaccattgtaaaaaggagaagaggagatatactatagccattgttgtgcaattgctttctgcacttggagatctccctgtgtttattgagtgcctactatatgccaggcacaatcagacgtagctcattcttttttcacagctgcatagtgtctattgtaatggtggctccatcatttatttaaccaggacttttgggtcctttccagttttcttcaaacaatgcttcagtgaacatccttgcacatatatttttgtgtttgttggtaagtaattctgtagaaagtggaactgttgttgcgttgtgtgttttgagtttggataaattttttatctagagaggtgaaactggtttatgcttccattaagagcctatgggagctgtggggttttttataatatcatcctccaaatggctagggggaagggagagctctctgaatttaggccagagctggcccactgcaggctgggcaggcccaggcctggacttggagcccggagaactcaggtatccctctggggccccccacagacaccgagacaaagttcagactcttcagtgtggcacacaggcctcggtgacccctgctgccctctgcagcctcctctgctcttgctccctgtgtttcatactggacccctggtaattcactggatatggttatgtttgcctgccctttgcctatgcgtcccctccccctggaatgtcttttcttcttaatctccgtcctccctgtccttcaaggcctgggtcacaagtccctttctccacgaagccttcttataatctctccagcctgaattgtcttctctgtgttcctttagtcttttatctgaaccatatccccccttaggtgggagcaagttgtgggtgggagagggcaaacttcagcctcattagatagaggctggacttccggaagagctgggaagggggaccatagtttctggggaggggtggagaactcacatttacctagctgctggccaggctattttcatacccacagaccgatttaattctcaactactgtactcatttagtagatgagaagaatgagacattgaaaacatgcacagtggaggtgggaatgaaagccagctctccaactctccagtcctctttcctgtcactgcatcaggctgcagggtgaaggggaggtctgggatacaaagagaacttagaggtggagcagttggattctgtgcagtgctaggagggaggagaggggttggagtaggtgggaagtaggcctccttcagtttggatagcacttcccttaacccaatgactctagtgggagggtggagggatggggatgggaagggagcctgggagtgaggaggaaaggcaaactctgtcttcccccaggggagtcaatgaatagtacctaaaatggaaaccaaacaaaacaacttcaggaagtaacaagggcttgcttagagacatgacggtaaaccctgaaccatcagctaaaagaggtagatagcagtggttgcccctggggagaggtaaatgtgatggagagggaacaactgtgtacaaacatgtgactttacgttttgatcaaaataagacttttaaaaaacaaacactttttaaaaagaaggaaagaaaagtaggaggggctatcccaggagctgagcgttctgccccgcccctctgagtcctgccggcttcacctgcccacgggagccgggtcccctgccctgctgcggcgcatgctgcctggtgggggttctgcccaggcccactacggcctgagttcaaatcccggcagcaccatttacaagctgtgtgcaagttgcttcaccactctgcgctgttcccccctctgtaaaatgggttggccgttgtaccctctctgaaaaggatgtgctgatgcctcggtgaaaagctttcaaaaattgttagttcatgttatttttttgctggaggtgttaggtgcggagaggcgagggggctcgcgtgcgtcgcaggaggctcagctgggctcgccgccgctcgtgcctgcgcccatttagtgtgcacacagctagcgcccgccgtatgtcaggcctggtgctgggtctccgccccggagctggggtgcaggggctgccgcgccctgtcgggtcgatccgggtgggaacccagatgtctccaagatccgagacagatccccgccccgcgccctccctggggggcggtccccggcttgggcgggatgggcgggcggctacttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcgggtgagtgcccggggggccccggggctcccggagtaactctctattgtaagttcttgcagatacagcgctaggaaaaggggagtaattcaggtctagaatggaaaaactgttttgttgctttgtaagtatctcttgctgcttccggggctctggctcgcagacgagggtgggagcctcggggccctggctgttccttcccaggaagctaacctcaccttggccggatttcttttcccctgtcctcctctaacatcttacctcctgtctcctgaattctccttttccttctctgattttttctcccctctgcctcacttctctccttctctcttctgatgtcttcttccatttacgattccttgttctcatttgatctctctccttctccaatatttccttctttcttgtatgacctcgcctgtctgcttatggtcattattatcatttcttctctcctttctgctgtcttccctgccctgtctggtttcgtgtttttccacccttctgcctgagttctccccaccttgtttctctgacttctctcctctgatttttactcccaccagatctcttctccggccagaggtgacctgcacctgctgatttttgtcctcgactccagcctaaccctcctgcaccctccccggccccagccccagtgcatgtgtaatagcctccccatttttaaccacttcatctccaacagcctcctgcagaccctggtgcatcctcttctcctcttccaagaaatgaaatttgggggtggtgtgttgtggggcaggagggaggaggcagacagcgcaggaggccacttggactcagccatttggacccttcttgggggtatgatggggatgggtacagagaggagagggggctcctgtggatcacaggaggctcaggtgggctcacctcgatttgcgagtgcacccacttagcgtgcacagagctagcgcctgctgtctgccaggccccgtgctggaaatctttccacttccaaagagcaaaagcaaacaggctgtgtgaccttcggtcagtcccctcccctctttgagcctcagtttctctgtctgcagattggggttggataatgagctctcagagggccctttggtttcaagagccattgaagatgctggaaggaagcaagctgaggccctggggacccttagatttactattgccatctgaggggtctacccatcatcccagagcttgtgatcttggagcctggggcaacccctgctacactgtttcctagctggaggtccctggcagagtcccttcatctctctgtgcctcggttatcacatccaattggcaataagaaaagaagggaggctgggcgcggtggctcacgcctgtaatcccaacactttgggaggccaaggcaggtggatcacctgaggtcaggagttccagaccagcctgaccaacatggcgaaaccctgtctgtactaaaaatacaaaattagccaggcatagtatcgcatgcctgtaatcccagctactcaggaggctgaggcaggagaatcgcttgaacccaggaggcagaggttacagtgagtcgagattgcaccattgcactccagactggacaacagtgcgagactctgtctcaaaaaaaaaaaaaaaaaaagaaaaaaagaaagaaagaaaagaaaggagcagggaggtagagccctctgtaccctccatcaccagaaaaagctgaagaggggctgagtaggagggacagatgctggccagggcacaggttttgaagcataaaactcttgccctgtttgctgactcgttgagacagggtgcccagaaggggatagacttccctggggcgtggggagagcaggaggctcaagtgagatgctcttggtgctagaaaccgccctccctcatgcctggggtctctccctgccaggaccctgccccgcttaggctctgccctgtctcatcccagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggtgaggctggccctgcccagcccctgccccagcccccattctgaacagtgcagacctttggggcatggtccccagggagggaactgattattgagcacctagtatgtgctgggcccttgactggtggttcatgccctgagacgctagagccagcctggccaagttcacacccccactctgcccctaacccatgttctgtcctttggcaagtcacttagtgtccctgtggagtggacatgatgatagctctgcactacctcacaggaatgttgtgagcgttaaacaccttactgtgacactcagaactgtgggtgaattggagaccctggacctctccacaacttccctggcccagctccaggcactccccagtttgcccttgagtcaggagcccggagtccctgccacacctctgccgtgggatgctataagttctgcccccttgctgagcctcagtttcctaatctgtgaattgatctgatgctcccagtcctgagtttacgctcaggagggctgagaatgaacataagggaatgtgacagagctgggaggacgcttagagaaaaatgaggtccatcgtcctgttatacagatggattaactgaggctcacagaaggcaagggctttctcagcttctacagctaggtcagggcagtgctggggttcctcctccacctcctcttcctcaggggtctgggatacttctggaaagccaggctcatattgctctgatgtcccgtaggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaaggtgggttgggccccaccttgcttgagcggtagggacagatgcaccagtaacagggctcactcaggcccatctatcttttggccttgtgatgcagtgggcagaccgatcagaggtcaggctttggagtcaaccaacattgtgtttaaatcctggcctctttctagccatgtgagcttggacaaatcacactgcctttctgagcctctggttccttatcttaaaatggggagaagaaaattccccataagttcatagtgttgtcttcctagccccaacagtgaggagtgggccagaggtgaaaatccagttcttcttgcaggccctggggggctttggcctagtcctgttctggtaccccttaattcttaaggccttgccaacagagggccccgtgttaagtatttaatagggcattgttagtcacatccctctttctgttcactagaatcccctttgaacttgaactcttcagagtctggatcaagacagagctcttttcccaagctcctagccaggtggggcagagcaaggccaaactgggagctccaagaggctgcaccctaatatgctggtgacttcctgcaagccacttgacctccttgagcctccctttcctctctggttacctgagagccagttgtacctgccctacagggctgggagaggatttggtgtgggggtggctgggaaatgccttgcgtggggcttggccatctggaagggctatggaaacactgtagttttacaaagctggggttttccttggtcaggatagagaaggggatcacaggctttcacagccaggtgggccttaatgtcagagtccaaatctcattttaccaggggagaaggggaactgagacacagaaagtcttaagcaattggcccagagtcacacagcgaattggtgccagacccaggactagaacccagatgttctgactcttagcattctttccactaaaccaacatacctctaatgaccagggtcctagggtagggtccaagcctgtctgtgctgctgatgtgctgtgtgaccttagagaagtcactgttcctctctggacctcaggatcatctatgtcaatggagtggtgaccttgtctgccctggtgaggcataagagattgaatgatgggaaagtgccagtgagactcagatagcaatgggcagggtgtgtcctgggaactcacagtccagggctgggcagggctgggctggattccctggagccccttgtgcccttgcactgagctcctcctgctgaggtgtccagctctgccttcttcccacagccctttctggggccttgataccttgcagaaggagaggtgagaagtttgggagccagtcccctgagctggagaaggaccaggtctttttgcaacttctggagcaagaaatggaacgaacacttgcccaggaatcacagagattgggattcaggttggaaggctaccttctgtaactgctgtgagactttgggcaagtcttgtatctttgggcgggtgttctcaatcatcctccattcatcattcattcagcaaatatttactgagcctcaataacagcagcaccagctcattgttgctacactatggcagatatggtactgggaatgtaggttatctcgtttcagcctcacaactgtcctgggaggtaagtaattcccattccattttacagatgagactggaggctcagagaggtcacataactatattcaaaccaggattgtgttcccttaactctgccaggccctgtgatgggtgctggggtgcccaagtgaagaaggtgggtccctgcccttgagagtgttctgaggagttggggagactggcaggctcacgaagagttaatccattgcctccaggtggggtgatgtgggatcccagggagtgctcagctctgagaggggttcagggatgagatagatgagtaggtgtttgctaatctatcttgtcctagtcactgtttcttagggcataacctgacagtctaacatggttacaaatatgagagttctcatatacacagaaagggtgattttccaggtcagagaatgttgcagagcaggtcataggctcccggatttttaggaataaacaaggatgataataacccttaccgtgtgttaagccttgactacaagatctcatttaattctcactgtagcctttagggtggatggtaatgctccatttcatagacgaggaagctgaggctcagaggagcaaactaacttgcctaagttcacacagctagtaaaaggtgcttgtcattgaacacttatctattactttctgtgtgtcagggactcttctgggtgctttactcatttaactcattttaccctaacaggtagggtatctgttagcaccattttataaatgaggctactaaggcacagagatgttaagcaacttttccaaggtcacacagctagtaagtgattggactagtgtgcaaacccaggtgtgaagggcctagcacagacctggttcagagtagacatttggaggctccctgatctttgatcctcgctcggatatggcctgggatctacttggatagccaggttccccggccccccgatgattttccaggatgttcttggatcacactcgaggaaagctccagctgggcccagatttggggcttctgtcctgaaaggcgctggctcctggtgtgaatgggaggcccagggctggtcttgtttaccaccttctgtaagtcctcagtctgcccccgcacttggcaggtccagcccaaggttctcgccccggcgccctcatcaattatagatcccggaggagcagggcttgttatgcaagacttgttcctgtgaaagcctcttcctctgagccaattctgtcctcggagtgtgagaaggggcagggaggggacagcaagccactagaaagggctgacatggggcttggccctcttgttctatgacccccaaatccttagatcactgccctgcaagagagttcagaatcccttgattccccgcccctcctcctcccactccgcagacccccatttttggactgaatcctggagaccccgtggggctgggttatttgaaacccattgttcaaatggaatctgggctaggcagagacctaggagcccttggacctgaggaacacaattgggaacccatagaatcactggaacctttctgtcctccctctctcctattccttagataaggagctctgagtttagagggtggaggggcccaagcctgatcaattcatttttctttgttttagaaacagtttaacttttgttttcatgtaaatcttcattgcttcttttcccccttcttctgactacaagagcaatataagcttattgtaaaatgtcaaacattacagaaatataggttccagaaaataaaagccctcccaacatgattctccccttggagatatatagtggctaatttctttctgtctctctgaacgtatataggtagacagacacatatatatgtaatcactttaatttggaaaatggcttttaaaacaatttatcctgtagaattttgttcaaataatttgatgccaatcttgctcacctaatgattagaccacagaaagcagcaatcagtgctaaagatgatagtcaaaaacaggaaaaacttcaaaaaacttctttcccctgcccttgtagatccactaatgtcttctaagagcttgctttaatttatttttgttaattaatctttccaattctaattccctagaccagtaaaattagaggagttaattaatcaggcagctcatggctgcaataattcaacatcaagagttatgttataaggccgggtgcggtggctcacacttgtaatcccaacactttgggaggccgagatgggtggatcatttgaggtcaggagttcaagacctgcctggccaacatggtgaaaccctgtctctactaaaaatacaaaaattagccgggcgtggtggcgggtgcccgtaatctcagcgactcaggaggctgaggcaggagaatcacttgaatctgggaggcagaggttgcagtgagccgagatcgtaccactgcattccagcctgggcgatggaacgagactctgtctcaaaaaaaaaagaattattttataaataaatacagagaatttttaagaagtgagatttatgacatgaagcaacccttttcctttttaaaaaatagggtaaagattttaataacaaaaatgaaaggcatacttcaacaagtaaaatatttagaggggtaaaaattttttctttccccccatttccttgtctccgaggaatcaatagaaacagtgagtccttctagcaccttttggaaaaggtttgcacatccactctctcattatgtccaggtgaatgaagtcccctggtcaggagttcctaggctgacagttgaatgaagctgggtccctggaagggggatcttggggatagaacccagcactgccgcccagcactgggctctggacacaatgcttaatctctttgaatctcagtttccttgcctttgaagtgggaaaattattaatagttcctgcatcaggggcttgtggtcaggacttcattgcatgcacttaaagcaggtgccccagctttggcaaagctcggtaagtggcagccactgtgcttgtttcaggtaagcacagctgagcacaggtgagcgcaggttgttgcattttcttccctggcggttcttcctcacttgctctgggcaggcttggttacatcggtctcagaaccctcctgtctttctgcgcttcccctgcctttctgcgcttcccctgcattgccctgacctatgtcctttgcactctgcctggctctccaatcccaggcctcacggccatccagccttcggaccccctcagttgtgactgcagttgtgactgcagctggtcagtccctcaccccagagtcccaactcactccttcctgatgatggaaaaatttactgtcttgcttcccagttttgggcagcaaattcaggagcagaagtcacagtcttaccccttgctccacaccgaggtcagtcatagtgtggccaacccacagctcccttgaaggggccctggaagcagggtggaaagataggttgttagctctgtgagcactggccgccctgctagtcccaagggactcttgaaaggccttagctgagaccaagaagggacaccagggagtcctccagccactggcaacccaaaaacatccattacttgaaagagggctctgaataatggcttgttcctgcctcccatcctggatgactgagtgatctttgctctaagaaaacctgatattggctggcacagtggctcatgcctgtaattccagcactttgggaggccaaggcgggaggatcacatgaggccaggagttcgagaccagcctggccaacatggtgaaacttcatctctacaaaaaatacaaaaattagctgggcatggtggtgcacatctgtaatcacagctacttgggaggctaaagcacaagaatcgctggaacccaggaggtggaggctgcagtgaattgagattacaccactgcactccagcctgggcaacagagcgagaaaacctgatattgagagaagaatgtggatcttacagattcagacatgcctgggtttgaattctagctccaccaccttgggcaagtcccgtcacctgtgggccccattttgcacatcagtgcgatgcagcaatgacacctcccttgcaggcgatgcgtgaagaatgcccggcacagtgggcatcatcatttcacaaacacgtatactgctgacacaggaagacagagcaggagcccaatatacacggactccgtttgtcccttgccctcctcgagtctgtgcggctagaattagacttagcacagtgggctgaggggccctggatggggtggctgcattgctggcctgagtggaagccctctgcttccacccccatgtgtctccggagcagggagacgagcacccgattgggaggaggaaacaaggtttccagccttggcttggccacgcacttgctgagtgcccttgagtaagtcacttcacttctctgggcttcagtttaccgtgggtaaagtggggtgaagtagaaggacctttccaactctgatttgacaactctggggcatggagctggggactgctcacaggaaagcccagctgactttccttggcttgcttctgagtgagggcagttgtgactgcagcagggaagctctcctgaacgccttgctctgggatgcagtaatgattacagagggctggggagcaggagcttgtgtctccacttcagaaaggagaggcctgaggctcggaaagggcaagtgacttacccaaagccatccagcattgttgtggcggggcacctgtcccttacccatagctgctctgaagggactgctgggtgggagttgctgcggtaccgtaggggaaagcagaagggtggcatgggctggaacaatccagaaagacttcccagagagccttgaaggatgagaaagatttggattagtacctctcaaagtggcttttgcaaaatactcaagctggaggcaggatatggtgaagaaaagtggttcttgggctgggttcagtgactcactcctgtaatcccagcacccaaggatctcttgaggccaggagttcaagaccagcttaaacagcatagtgagaccccatgtctacaataaaataaaataaaataagtaagctgggcactgtggctcataactgtagtcttagccactcgagaggctgagatgggaggatcattcaagtccaggagtttgaggttacagtgagctgtgattgtaccaatgcactgcagcctgggacagagtgaaaccctgttgaaaggaaggaagagagagagagagcggaaggaaggagagagagagagaaagagagaaaggaaggaaggaaaggaaagagagagggaaagagaatgaaagaaagaaaaaaagaaaggaaagaaaaaagaaagagggaaagaaagaaaagcagttcttggttcaataagatagggaaatactgtataaaacaaaaggcaagcaggtgtattcaccataggatttgacagagcctttattatgcacatgcgcgttgtataacagtcagggagggtgagtgagaagcattccctatgcttatttgaccgtggaactctttccttgcagaatgtcttaggggactagtgtgcctttgggaaacgccggttttgaggaaggaattgttgcagtttttttgatttagaaagtggctacaggggtccttgttagtggagtatgggattcaaaggggtggcagaaagatgcagtgggcagggaatctctcacttcttagctgtgtggccttgggcaaattttattcctttcctaaacctcagtttcctactctgaaacagtctcaaacaagataatgggtatgaaagtcctgagttaactgagaatcactgtgttgctggaaagcccctggtccacaagccagaatttcctttacctcaattctgtccccttcttccatatctgcttccctgggccttctcccctgggctaatgctgtctctttggccccacagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacgtgagtcctgctttcctctttcccaggagccactgaggtgctcctggtctgatcagggacttgggtacatccacgtgaacaaatgcatagatgcaggtgggcaaaccacagggaccagcattgttcacgtacagatatgtctgtatgcaaagactcccacaaatgtagactcacaccacgggtatagtgcgtacttggactttgattgacatatagacttcctggcaccttctgttcatatgtacgtcttgtgtcctttttcacatgcttataaatatataacagtcatgggcaaacactctgggcttttgcccaccaggtgtgcacatgtgcaccatcatgaatgcccacacatgtatactcgggtatgttgtttaaggtcccacatgtgtatgtcatacatgtagttgcacatgcccatgatctatggcaatgtgtgtgggatgcccttacccaggcccaccttatagatgtgtgacgctttgtacacacttgtctcacaaatccctggagcgcagacctgcaaatggacacggcccttctaccccaaagctcatatgcttatacacctgtgatataatgtccgtgcaaacatgagcacacactgatttagtgtaagctttttattaaagcgtcatgggcacacagaggagtgtgtgaatcctgagtgtacagcttgatggattacacagagcgaacacactcacgtaacactggatcatgaagcagaacctcaccagcccctagaaggccccttttgcccctttcggtgccctcaccccaagggcaaccatcatcctgaactttctcaacagcatagatgagttttgcctgtttctgaactttatagacacggaaccttgttcttttatctctgaccttttgctcaacattacatttctgagatgcatccgtattgttgcatttagttgtaggttgttcattttccttgctgtggaagattcagttgtgtgggtgtaccatgatttatgtatcctttatgttgttgatgggcacttgaggtggcttctggtttggggctattacagacagtgctactctgaacattcttgcacaagtcttttggtggacatacgaacgtacttctgtcaggtattttcctagaaggaggattgctgggtcataaggaaataggtatattcggctttagtggctatggccaaatggttttccaaaatggttgtgccaatttatattcccttcagcaggcaaacatttttgcacacattctagatgtagttgtacctgtgaaaaaattcctgtcctcagacatgcgctcccatctcctggtgtgtgcagatcacacttaattgtacgtaaataatgcacgtgtgcagactgtgccagccttcacctgggcaagtgcagaacagggtgagcctgcacaccacacgccacactccccaagccctgtcgctgggcggggcttataggaaggcggggcactgacttcctgggtctctgtcttccagaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgcctgtggggtgcgcaatggggtggccatggggacacgctgctcatgactttcttctgttcagtaggcaatttgaggtgaatttgaggaaaaaaaaaaacttccgctctaccccacctttttatttttaaaatacttttttattttaatttttgagacaggatcttattcattgttgcctgagctggagtgcaggggcgccatcacagctcactgcagccttgacctcctgggctcaagtgatcctcctgcctcagcctcccgagtagctgggaccacaggcgagtgctaccaagccaggctaacttttgaattttttgtaggaatgaggtcttgccatgtcgctcaggctggtctccaacttctggggtcaaaccatcacctgcctcaacctcccaaaatgctgggattacaagcatgagtcaccatgctggccctgcctcacttttgaggctgtttttccatcaaacctgatcactttagggagcaagggagatcagtttcttgcacaactccccgactaccctgagaggtgggactggaacccaaggctgtgctgtgagtgtgagccgcattctccagtggggagggccaggtcctctgcagagctaaggagggcagtctcttagcatccccagagggccagctttgtgctagaataaggtcagaaagagaccactgagccccaatcccctcttttctcttctgactatttctggtagtttttggcccatttagtcacatggtgggattgccagccattgtgcgttgaggacgtatcaatagaggcaagattcactaggaaaaggagaagaccatgagctctgctccatgtcacttggttcctgcttctctgggggcatccaattccagcttttggagagagcagaatggtgattattattatgggaagggacctggacaccaaccatggcttgggagggacagtgggagtgaaaataggctctgaagccacagggatggaggttcagattctggcttagccacctaatagctgtgtgagtaggtgacttcatctttctggacctcagattcctcttctgtaaaatgagagtgataatctgtgcctcctggcctggctgcgaggatgcagtgacatcttttaaaggtaggcggtagaaggtgttcagtagctatagttatcacaattagccggtaggcgaaatatctgaagcgctgtctggaggcagaggagcaggagtgttctcctggagtttctgagtcagggagacaaggtggaagggacctctgatggacagatctggacatgtgagcagatgcaggatgtgtctggaggaggtcagactccatggggagggtcacagtggatgtccttgtgatccttgcctgcctgggagctatctcaggagcctggcccctccctcacagccacccttcctctccatctctctatctcctacaggtgctgggccccaagccggctctgcctgcaggtaccgaggacaccgccaaggaggatgcggccaaccgcaagctggccaagctctacaaggtgagcaccagatgcactgtctgcctgggcatggggtcaggacagggaggtggaagacttggtcttccccactccactgctatgggaccttgagcaaagcacccctttggaggggggcctcagctttctcacgtctccagtggatgctcgtgtacttcctttgctttcctgcactaagagcatgcgatcaactccgtacatatctgtgtcacgctcatacatgaggtctctctgagtctcagtgtcctagtctgtaaagtgggaagaagagcagaatggtcgactttgtaggatttctgggagtccacagataaaatggatgtgaaaacagcttagaaaatacttggggaaatactacagaaatggtgtgtatgtggggaggttgggggtgtgggttatagttaatgactttatttatgatttctttcttgtgattttcacaactgaattcaggcttagcttcagctagggaactctcttggctgagctctgggagaaagctcaatcacacttacgttgtgccccaagtattttcagtaaaacaacaaaaaggggatgtcgattttcaccactgccaaagaaaaactactacattatcgattttttttctgattatgaagtaatacatgtttattgtaagaaaaaaaagtattcaaaatataaaaagaaaataaaagtccatgcaatttcactggtttaaaaaaccagtattacttttaaaatatgttttaattacaaaaatgacaatacccagttaaaaaatcagcctctcctcctcatgagagaacacatctttgtccagccacagctttctgtgcctagttacttttccatttccatcttattattttattttgagatagggtcttgctctgtcacccaggctgcagtacaatggcacaatcacagctcactgcaacctctgcctaccgggctcaagcgatctcttgcctcagcctcctaagtggctgggactacagatgtacgccaccacgcccagctaacttttgtattttttgtagagacgaggttttgccatgttgcccaggctggtctcaaactcctgggctcatgtgatctgcccacctcagcctcccaaagtgctgggattacagacctgagccaacgctcccggccatttctattttgtgtaactggatccaaactattcatgctgttgtgtggtcttttttccactcaacatggtcgggaatatctttctataataaatctcaacacgaccctttataacagctgtatagtattttattttatgaatgtaagaatttaagcaaatcctgattgatggacattaggatgttccaccttttccagttgcagacagtccctcttggtgcacttgtgctaagtacagcatagcactagggcaagttcctagacaaggaactgctggtcacaggccgaagaatgagtcagtagttgaaaatactggttctgggccaggcatggtggctcacccctgtaatcccagcactttgagaggccgaggtaggcggatcacctgaggtcaggagttcgagaccagcctggctaacatggtgaaacactgtctctactaaaaatacaaaatattagccaggcgtggtggcgggtgcctctaatcctagctctcctcctaagggaggagaatcacttgaacccgggaggcggaggttgcagtgagctgagatagtgccattgcactccagcctgggcgacaacagtgagactccgtctcaaaaataataataataaataaaataaaaaaagaaaatactggttttggagtcaggagtcagactacctgtgtttgaattccaggtcagctatttctagctgtgcaagttccttaaccactctgtgccttggtttccttgtgaatgagacagggatagtaacagaactatcatatgcaaggattaaaggggttctataattatacaagttatagaaattgcttagaacagtgactggcacagagtagtaagtactcaattcatgtagaataattattatttaaaggactgctacctcacagtcaactgtactctggaacagctcccaaattactgtcatcagggatcttaaatgcctgtttacccagagccttgccaactggatattgttaaacttttgaattttgactcttaagatagaacttttttttgagcttggttgaactttttattttagaataatttttaagtttacagaaaaattgtaaagatagtacaaagagttcctatataccattcactcagcttctccttagcatcttagcataaccaggtacatttgtcaaaactaagaaattaacattgcttcagtaccattaactaaactatagactttagccagatttccccagttttttattctaggttccaatccaggataccagattgcatttagctctttttacttttctttttcttttcttctcttttatttacttatttatttttgagacagagtctggctctgttacccaggctggagtgtagtgacgcaatcatagctcactatagccccgacatcctgggctcaagtgatcctcccacttcagcctcccaagtagctggggccacaagcaagcgccaccacaccttgctactttttgtattttttgtagagatgggatcttgccatgttgcccaggctggtcttgaactcctgggctcaagccatccacccacctgggcctcccagagcgctgggattaaaggtgtgcgacactgtaaccggcctcttctcttttttttgaatagtaaagttgaatacattttcagcaaactatgcagttcccctctgcacccaattccccaaattttatcccgccctcccttcccatgtgcagtttgtgttacccctgcgtgtaggtcagcagatgtggttctgacaaagcagaaaacgaaaaagaacctctaaatgtgtgcgagaggaagcccaggtgttactctacagggccatttgggacagggggtggggcaagatggtggaagtctcagggctgggcggccacagacactcatgtgctggttccttctgcttcgtcccctcaggtctccaatggtgcagggaccatgtccgtctccctcgtggctgatgagaaccccttcgcccagggggccctgaagtcagaggactgcttcatcctggaccacggcaaagatgggaaaatctttgtctggaaaggtactggagacagggaaagggtcccaactggcctgtaggatcttggatgggatgttctgcagctcccaggaactcagctcccggggagtgtggagtgtgcctggtgcaatggaaatcagaagtcttgggctgaggccttggttttgcatttgacatactgtgtgatcttgggcactttacttaccctttctgggcctcagattcctgatctgggctaaaatgggtgtttcccaagtgcattataacgtcagttctctgagaggctaattggcatcctgtagaaattatgtagaaaacatctaactgtatggtcagataaattcatgggcaacagtggattttaaaatgttcgagtttgtttactgtaggacttttaacttgttcatttacaggggggcttttcatgaagatgatctggtttgggaaatgctaagctagaagttcataaactctttcggtactatcttgtgggaattctcttggaaaccattggcccagatgtttcccagaggccctgagatgttctgagaggacccatcaatatcctcccctgattctctaaggctcatcttggggaagaggacagaggagagggaggcagtaggaggacagagagaaagggagacggtggggagaaagagagagagagagacactattatgattattactctctaggccccctgggccctgggccagctgatctggaccttggccttggcagtgagaaggctgggactgaggcccagcactggctggccaggagctccttggcacgggaatgccctcagggtggcagcttctcactcactgagtaacctaggtcaagtaatttaatctctctaagaccctagcttccttatagatactcagaaaaagataacaactttttttattacttaagactattctgtgaattaaataatctatgcatagttctaagcacaaaatacatgctcactaaatggaccacagtagtgttgtgattggtgtcactggccagccccaggctggacaccaggagctctagtgagtggtcggctctgggggtctctggccttggctgtccacagtctaagaagagtagggagggaagtttggcagctccttctcctggactgttaaaggtcaggatgcagcaggatcccgggcctctaaccctccatcacttcctctggctgccaacaggcaagcaggcaaacacggaggagaggaaggctgccctcaaaacagcctctgacttcatcaccaagatggactaccccaagcagactcaggtgagtcttggaggccaggtaggatgggaaggggtgggtcctgtttggaggggatgggctggagtagggcgggtgtcccaccctcagtgtggatggggtatctgaggctcccctggggacccctgctgggcagcccagccacatcctgctcctctgcctcccctccccaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacaggtacgtttagggcgtggggtgggtgtgtccaggcccctccctcactttccccatgcactgcctcttgcttccccaaggaggtttctctctgaggtttgcacaactttggtagctgagattctttggtgttacttagtttttacagccaatgcaccctgtgtatcaggccctgagccaagtgtcttggccccaccttgccccgaggagtgcctggtctgggaggggagttgaccatagccacagacctgtgtgatcagtggaagatgggagggagcacaggggattgtgcagacacaggaagcagtgggggtggttggtcagggcagcctgcacagagatgggaacctttgggttgggtctcagaggaggagtagagctttgctgccggagaggaagagcggagagtgatgggcattccaggagggactcgctatgttcggaaaggagggagctatcccagggggctagtgctgatggcatccccagggaggggccttgaatgccaatttcaagggtgtagacttgatcctctaaccagtgggtgctagtgaggggtttttctttttattaaatcagacatgcaacaggctcagatttatgctttatctttttttttttttttaatagagacagggtctcgctatgttgcccgggctaatttcaaactcctgggctcaagcaatcctcctgcctcggccccccaaagtgttggaattacaggcatgagccactgcgcccggccacctgctttagaaactcactgtgaaaatgggttggaatatgactccaggatatcattagaagaaaaaaatcagttaaaaaataaataaaagaaaaataaaaagaaaactaagaaaatggattggaggcaggaaaatgaaggtagagagcttataaggagcttgttctaatactgtaggggaaagatgatgaccttgagactaagaaggtcacagtggagaaggggaagaggggtgtggggttcagaggtgtttaggaggtagaatccgcctcaggcaaacttgactccgttcctaatgataggaataacaaagtgttcatttttatatattattgtttttggtttggtgctagcattcatttgttgcttcagtggctagggagaatgcaatgaaaatatttcgggtggggcggtgtggtaagacccctggcagcctgactgtgagactttgggcaagttacataacctctttgagcttcactttctcacttgtaaagtggggtttcatcccactccatcaccttcaagaatgttcaaaatccagagattctaggattctgtttcccaggacttggacgactccgtgtctccatagctccaccaggtggcgctgccgggcctcgtgaccacttggaaaaagcagtgtcaccagaacgctgcggagacctgccagcaggggtcacactgaggttgcctcgtggtgtccctgcctctgcaggtgacctatgaaattcctggcaggcccagcacagtggctcacgcctgtaatcccagcactttgggtggccgaggcgggtggatcacctgaggtcaggagttcgagaccagcctggccaacatggtgaaaccccgtctctactaaaaatacaaaacttagctggccatggtggcaggcacctgtaatcccagctactcgggaggctgagacagaaaaattgattgaacccgggaggcagatgttgcagtgagccgagattgcgtcattgcattctagcctgggcaacaagagtgaaacctcgtctcaaaaaacaaaaaaaaaaaaaagaaaaaaagaaagaatccaggcagctcagtaacaatagaggtaatggtgatattagtaagataataataataattatgacaataagagcagctgccacctacagagcagtccctttgtgccgggccctgtgctagactttcacgagtaatctcgtttgagcctcacagtactttgaggtaggtactatgattatccccatttttcagatgggaaaactgaggctaagagtggttaagccagttgtctgaggtctcatggcccggaaggggatgaggggcctgatttggggtctgtgtctggctcctcccctcactgtactgcattcctttggagctgccttgacgatcctcagcgaaggacagacgggctggggcagggcatggtatgaggagcccaggcaggaaccctgacccagagtcccagccctgccttctagtggctctgtgagttgggcaaaccatttaactccagtccgagcccaagtgattaaaagttcatcccatggcctaaccacaacctaccacactgcggtttcctggcttgcctgagctggggggtgggggtgctgcacagcatctgactccagctttgctcctgcagatctggagaatcgaaggttccaacaaggtgcccgtggaccctgccacatatggacagttctatggaggcgacagctacatcattctgtacaactaccgccatggtggccgccaggggcagataatctataactggtgaggttctggggccattggtgtgtgtcgtgggggtactggctgggccctgagcagggctgaagacaaactgagggtgtgagggcctgaggtgggaccaccactccctgctgggagaggcttttgtccacagggcaacaccatttgcttatttctccaaacaactttgaaactcttcttaccaaatgattatacatctattgtaggatatagtgaatgtggagaaacaaacagaacatctcccacaaatccatgacaagtactaggcacactagggtttatcctcccacacatatttttcaagccaaaatttttttaaatttatatttgtttatttatttatttatttatttattttgagacagagtttttctcttgttgcctaggctggagtgcagtggtgcggtctcgctcactgcaacctctgcctcccaagttcaagcaattctcctgcctcagcctctctagtagctgggattacaggcacccaccaccatgcctggctaattttttgtatttttagtaaagacggggtttcactatgttgaccaggctggtctcgaactcctgacctcagatgatccatctgcctcagcctcccaaagtgctggggttacaggagtgagccaccacacccagccccaaaattattttaaaacagagaatacatttacatggttcaaaaatcaaaacagaatataaaggtatttattgagaaatcttattcccacccctgtccctctctaccccattctccagaccccaccccttcttgggtaactgctttactctcttgcatatccttccagtaactcttcgtgaaaaaaaatacatatgcaaataatttatagcctggtccctcccttccttacacaaaaggtagcatactttgtatattgccctgcaccttgcttttctgactccattcttcctagagatcaataatgtcagtacatagagacagagagctttctcattcttttttacagttgcataatagtcctttgggtggctgtactatagtttatttaacaaattccttgatgatgcatacttgggttgattccagtctttctctattacaaacattgctgtgattagtaaccttaaacaaacatcactttgaacatgcagagacatgcctctagagtaagttcccagaagtcagattgctgggtcaaagagtaactgcacttgtcattttggtagatagcccccaatttccctcgatagtgttcgtagcattttacattcccaccaagcaacctgtgagagtccctggttccctatagtcacactcgtggattgtgtggtcaaacttttgggcgtttgccaatcttatggtttataaaatggtgtctcagtgtatttttaacttgtatttctcttactatacagtctaaaactttttgtctgattattgactgttggatttttttttttttttgagacagggtcttgctctgttggccaggctgtagtgcagtggtacgatctctgctcaccacaacctctgccccccggggctcaagcaattatcgtgcctcagcctcctgagtagctgggactacttgccactactcaccaccacacccggctactttttatactttagtatggatggggctttgccatgttgcccaggctggtctcgaactcctctaagcgatctgcctgccccagcctcccaaagtgttgggattataggcatgagccaccacgccaagctggattccttctttttttaaacttattttgaaataatattagacacttgctgaaaagttgcaaaaatagtacagacagttctcatatatccattacccaatggaatattcacctatgttcacatcttacataacccttacataaccatagcacaattaacaaagccaggaagtgaacattgacacaatactacttactaatctataggctttacctaaatttcctcagttttcccattaccgttttttttttttttttttagacagagtcttgctctgtcgccaggctggagtgcagtggcatgatctcggctcactgcaacctctgcctcccaggttcaagcaattctcctgcctcagcctcctgagtatctgggactacaggtgtgcgccaacacacccaactaatttttgtatttttagtagagacggagtttcaccatgttgggcaggctggtttcgaactcctgacctcaactgatctgcctgccttggcctcccaaagtgctgggatgacaggcatgagccatcgtgcccggcccccactactgttcttttcctgatctaggatctaacccaggatcccacatggcatttactcatcatgtctccaaagtctctgaatctatggcagttgcccggtctttcctttttttcatgcccttaacacttttaaagggtactagtcagttattttgtagaatgtctctcaatttgacaaccccagacatttaaaaacagcttaattttttttttgactagataacacattcacctggtacaaaatgtgtgagaagactgttttaaaaattagctgcatcagcgcattaataggtcagattttgtttgcttatacgacgacatatgttggttatggaaaacttagacaatatgcaaagaggtgggatagaaaggcaaaatccccctaaatcttccctctaagagcaatcaccatggacctttttggtgaacatctgtgcagacctctctgcacgtgttcatgggaggcttaatcactgacatcttttcccacaaataggctctcgtaacacttgctattctgcgacctgcttttccgcccagagaaatgtcctggccacttttctgcatctcagatttgagtctcagagcatcttctctgtggctgttcagcatgggatgacccagccagtctcctgtgggacacatttagcataaggaaatccatgcgttgcactaagatctctgtaagcgggcaagatgctaggctgagagtggaagtgttggtgtggttcctggctctcgttgttctgaaagagtccccttccctctctatctgtttcattactggtaacagggagatgtgtaggtttctcagactcagggcaagggagaggctcagggctctgtgtgcaccctgatgctgaatctcacttccccttccaggcagggtgcccagtctacccaggatgaggtcgctgcatctgccatcctgactgctcagctggatgaggagctgggaggtacccctgtccaggtgagcccagcccaccgcctctctgggctgcagcctgagccttgtccttctcttcactcatctgtctgactctcatccatccattcgtttgtccatctgtctgtctgtccatccatccatccatccatccatccatccatccatccatccatggaacaggtatttatttagggcttccatgtgttccacactgcatctgtagccatggacacacagacacactgtccctgccctagtggactttgctgtcttgggtggtagtagacattcaacacacaggcacaccaatggctatgacagatgcagtgagtgaaattgacaagaccttgggagagagacatgggagaggccatgtggctgagcacggatgtggaaccagcatgcttgggtttgaatcctgtcctcacctctgggcaacgttgggcaagtcacttagcctctctgtgcctctgtgtcctcaaaataggggtaataacagtaccatcccacaagattgctgtgaggattaagagttaacatttgtaagcatttagaatcatgcctgccatataagaagtgcccccttatacatatgtgttaagtacaaggaggtaaatcctaggtaggatcctattggattagaaaagcccacccctgtcccaggaggggactgttcaactgggacctgatgcacgtgtaggagttgcccaggcagagtgaaggaaagcacattgtgggtaaagggtggtacacatgcaaaggccctgaggtgggagggggcattgggtgttaaagcaaggggaaaatgccatgatttgaggctagagaggtgctcagaggggccagaccaccagaggccatagtgacgatgttgaccttgatgctgagaacaacaggaagttgctgaatgataagtctgaggtgtagggatttctggtttaaaaagtcactctggccaggcgctggagggcagcagagctggtttgtggaaatataggggaagcggacaacaactgtgcttcctccgtcctacggtgggagtgggcagggctctagattggcatcgggggttcgtgccctgacctttgactatgatagactgggtgctgggcactaaatgagatgatgaccatcttagctcagtgcatcctgacaacagccttgggagtagcatccttggctgcatttttcagaggaggaactcaagaggttgagacacgtgcccaagttctcaccatcagggtggagttggggtctaagccctaactcagcggtggtgggtcgtggtgggaagcgactgccatatgcctgacgtacatgtgaggttttcttctggacatagttagccggggccacggtaaggtgccgcacacagggcaggagcagatgtgagggtgtacatcttccctgcctcactcccaccaccaagcccctgactgctgcccgcatctggggtgcactggctctgcaggagggggttttctggatctagaatgctctgttcttaccactccaccagcagtcatgcccaggcctgacgtcagcattctggaagaatgtccaccagcaatccctgtgcttctatttaagggaacatttgcaaacacaggctctcctggttcttggaccaggctgaggatcaggaaggcatgtcgtcatggagatggagagcagcccagcagcagtgccctggggacctcagacaatagcactgtctccacccttcctggaattctggtgtccctgcctgtgtgttgtcgggtcacattccatgccacacacagacacaagcatgatggcttcgtctggagggatgggcccagtgcgacatagaaggactgaagcctgcccccaaggtccctgacttgctctcctgtctccctgccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtaatttccaggtcctggaacacagaagggattggcctccctgaaacctcccagctcaatgaccagatctccaggcacaggaacgggggcaggggatggtgaatgacggggtaagaagcagctttttgtattttcctgccgtggccacagggttgtctgtcttagactcccccctgtttcaaggatacccagtgtcccttgcacactttgcacagtggacagctcactacctaccattctgtacaatcagcatgccattcctgattacgttccagttgcctactatccctttcacggaggaaggcacagatctggacttgattcccaggatggtctgagcagcctagaggggaatgggactctcacctcctttgttctgggcattcaacttctgttaatgcagccctgatttttagaatcatgttggctagtcacagtgcattagtgactcatgggagtcaaccaaggccatcagggtccaaagtctgtgccctcagctctgatgggctgtgttcctccaagtccccacctgagagctagtcctgctgcggggtctcctgggctgtgaggagggggctgagggctttttgtctggttcctgattaaccaagctgtaccctcccaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccaggtaggagccggggtggggggcctgctgctgtccggatgcagctattaagtttcccccttctttccttcagcttgggggctctaaatcctcccctccatcccacctgagggcctgtcccctaatgtatgttaaataaaagcagttgcattaaaatgagggctgtggccagagagagggaggtctccaggagctaaagaaaggagagcctagcctgggcgtggtggttcatgcctgtaatcccagcactttgggaggctaaggcgggcggatcacctgaggtcgggagttcaagactagcctgaccaacatggagaaaccccatctctactaaaatacaaaattagccgggcatggtggcacatgcctgtataatcccagctactcgggaggctgaggcaggagaatcacttcaacccgagagttggaggttgcggtgagctgagatcacgctattgcactccagcctgggcaacaggagtaaaactctgtctcaaaaagaagaaagaaagaaagaaaggagagcccagtgtgggaaggagcagttggtctgtggaaggaggcggtccctcgctaggaagccttgaaaggtggtaggcagggctgatagcgtcagaggagcagtggtctccttgcatctctagactctccatggacagaaatgccaccagcctgctctgtttccagaatgtgggccgggcagctcttccttctgccagcctgcagtctttatactgttactttgagttcattcccacctgcttgatgcttaacagaaatggtgaagagtgacttggtctaaagcagctctgtccagcagaaccttctatgcagatggacatgttctgtatctgccgagtccaatttgacagccattagtcacatgtggctgttgagcacttgaaatgcgaccagtgggaattagtgggaatgaagaactgaacttttagtcgaatttaattttaatgaatttaaatttaaatggctgcacatggacagagcaggtatagtggaaagagtataggtgttagaatcagacaagatttgtatcctggtcttaacacttaccatctgtgtgaccttgagtgagttgcttaacctctccgagccacaactgcctcattagctgagtggagctaatggtcctcatcccgcaatgctgtcgtcagcctcaagccaatagtggtcctggctgtgtgactactgccaagtctgccctctctgggcctctatttcgtcaccttccaattccctcaggcctcttccctctggatctcctgggatttttaggatggagggaggagagggagagcagttggttgcgcttgggcagggctggtcccagggtccgatgagatgggagagaggggtgatggcgtcccttggcaactggcgtggcctcccctcacagatggcttctgggaggccctgggcgggaaggctgcctaccgcacatccccacggctgaaggacaagaagatggatgcccatcctcctcgcctctttgcctgctccaacaagattggacgttttgtggtgagcccctgcggaggtcacacctctgctttcccctcgggaggcgagttccacaggactggccggcagcaggggcaggagaaacagttctgatggtgtggcacagaggaaggggccccctgccagctgcagccagctgtgccactccctcagggggcagataaaggaaggccacccaggggagggaagacatctcactgatgctctttcgttccttcccagatcgaagaggttcctggtgagctcatgcaggaagacctggcaacggatgacgtcatgcttctggacacctgggaccaggtgggtgaaggacaggtgaaggctctctgtgccagagggagtgggagaaactagacttccagttctatgatcagttgctagaaggacctaaagggggcagtgccaggtgttgccagaaaagtctctaagggtactggaagtcacttcttctttctgagcttccatttcctcatctgtaaactgggagtggcggtacctcccttgcagatacactcaccttgaaagctgcaaaacgccctataaaggcaaatcacatgaccttcatcattctctcccagaccttgcaggagcgtgaactcttcctttaaatctgttggcagaggaagttgaacttagcagcatcttgtttgcaggcataaactgtccagtgtcacctagaggctctagagggctcctgcttctggtttgagggctctgggctctgtctccacttcatctcctagagaaggccattatgtaggacttggcaggggaagatgccattcacttactcaaccaatattaattgggcactgctttgtgccaggtgctttatgtttgagatgctgggatagagcaatgaataaagtaggcattttcctgctctcccagggcttacgttctcacaggggtgtcaggtcagtcacctttcctatcaaggtggcttctcccagagtcctcagagttacggagcagctggccacgaaggcataagactctacactacccacagggatgctcggaatccccagttggaagatcgggaccaaaaatgattgcagcttgagccattcagcagttgtcattgattgatccattggctacttaatctgtttgttcatctgttagggattcagtcagccaacatttattcagcaccatggtcttgcaggcaaaatgctgagtgctgagaatcctatgatgagcaaaatagaatgcctgccttcgaggggcttccactttagttgggaacacatttataaataagtaagagagggccagacatgttggctcacacttgtaaacccagcactttgagaggctgaggtgggcagatcacttgaggtcaggagttcaagaccagcctggccaacatggtgaaaccccatctctactaaaaatacaaaacaattagccaggcttggtggtgggtgcttataatcccacctacttgggaggtcgaggcagaagaatcacttgaacccaggaggcggaggttgcagtgagctgagatcatgccactgcactccagcctgggtgacagagtgagactccgtctcaaaaaaaagtgagaaaaatgaagtctgacattttattgtctaatgccattttatcaatgataggtgctctttgaagtaatattttagatatgcataaaaatagatgatacataaaaatcagctaaataatgtgtaatagaacttgtaacaagactcaaaatggtgatagtggtgggtgagttatttttattccaagccttaggcccattttgacaaagatgcacacagaccggcacatagtagactctcggtgcatatttgttggataaataaatgggtgagaatatgtttggccactcatttgttgaacgagtgaatgctgttcaagagataactcatggacctttagagaagaatctcaaactcaatgcctgatggtacctggttggcaatgttagcgaatgaagcaggctgggctggggagacgtgaaggagcagtggagtctgaggcaaactagaactgctcatctcaaaggggcagctcctgcgcagcttgactcaagtgaggtttgaaggcccaggctgctagatcctccaatttttaaagagaagttggaaatctagatttttatgtcataacggtttaaaaagacattgttggctaacacaaggtggtgggtgagcaaacaaaacatgtttgtaggttgccagttttcaacctctgttccaaatccttccagtcttagttcatgggctctgttagaaaggggagggctttgtctggtctgatacctggcccctccccagtcttcctccagccgtgaatttgatcagcactcctcatgtacctttcctgttgcatctcacctccaggtctttgtctgggttggaaaggattctcaagaagaagaaaagacagaagccttgacttctggtgaggacccgagtgcctgggggcggggggaggggtccgttgcttgtggggtgctgggagtggctcctgtacaggtctgggaatgagcatctttccaggggactgatggacaagatagggtggggacttcctcctctgtgggccagcccctcataaatcctgcctgggatagtgaagaacacatcagttccttcagaaaccctgaggcttctcaaagaaggctctcctctgttccaggagaaggaagggacagatgagaagtcacttcaagttcccagaatactcagaagctgaacttgtcaaggtttagatgtggcaaagcaggccaggcatggtgactcatgcatgtaatcccagcattttgggaggccaaggcaggaggatcacttgagcccaggagtttgaaagcagcccgggcaacatagtgaaacctcatctctagaaaaaatacaaaaaaattagccaggcgtgttggtgtacacccgtggtcccagctactcaggaggttgaggtcagaggattgcttgagcccaggagttcacggctgctgtgagccatgatcgcaccactatactgtagcctgggtgacagaatgagatggtgtctcaaaatgaaaaaaaaaaagaaaaagatgttgcaaagcagattcttggcagctgaatagatctgatttgtgagctgggaacccaaaagttggttcccatatcttccagtaggggactgcaagggaaagtaataagctttatgaagcaggagattaagccgtagccctgttccttcctgtgttcctgagcagggtggtggagagcccacgtgggtatcatgcctttaaaggaggatggtgcccagggcagggggtgggcagtagggacagtaggaccatagaccctcttctttgtcaactcctgtcctgagtcaccctctccctggtgtgggaggcactaagaattcctggggtttccttttcttgcacgtgtgtctgcagctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 1444 - DNA, 64741 bp, Homo sapiens; identical to SEQ ID NO: 1443

SEQ ID NO: 1445 - DNA, 64741 bp, Homo sapiens; identical to SEQ ID NO: 1443

SEQ ID NO: 1446 - DNA, 64741 bp, Homo sapiens; identical to SEQ ID NO: 1443

SEQ ID NO: 1447 - DNA, 64741 bp, Homo sapiens; identical to SEQ ID NO: 1443

SEQ ID NO: 1448 - DNA, 64741 bp, Homo sapiens; identical to SEQ ID NO: 1443

SEQ ID NO: 1449 - DNA, 64741 bp, Homo sapiens; identical to SEQ ID NO: 1443

SEQ ID NO: 1450 - DNA, 33042 bp, Homo sapiens
acttaaggtcggcgacccgaggccgcggctgccgactgggtcccctgccgctgtcgccaccatggctccgcaccgccccgcgcccgcgctgctttgcgcgctgtccctggcgctgtgcgcgctgtcgctgcccgtccgcgcggccactgcgtcgcggggggcgtcccaggcgggggcgccccaggggcgggtgcccgaggcgcgggtgagtgcccggggggccccggggctcccggagtaactctctattgtaagttcttgcagatacagcgctaggaaaaggggagtaattcaggtctagaatggaaaaactgttttgttgctttgtaagtatctcttgctgcttccggggctctggctcgcagacgagggtgggagcctcggggccctggctgttccttcccaggaagctaacctcaccttggccggatttcttttcccctgtcctcctctaacatcttacctcctgtctcctgaattctccttttccttctctgattttttctcccctctgcctcacttctctccttctctcttctgatgtcttcttccatttacgattccttgttctcatttgatctctctccttctccaatatttccttctttcttgtatgacctcgcctgtctgcttatggtcattattatcatttcttctctcctttctgctgtcttccctgccctgtctggtttcgtgtttttccacccttctgcctgagttctccccaccttgtttctctgacttctctcctctgatttttactcccaccagatctcttctccggccagaggtgacctgcacctgctgatttttgtcctcgactccagcctaaccctcctgcaccctccccggccccagccccagtgcatgtgtaatagcctccccatttttaaccacttcatctccaacagcctcctgcagaccctggtgcatcctcttctcctcttccaagaaatgaaatttgggggtggtgtgttgtggggcaggagggaggaggcagacagcgcaggaggccacttggactcagccatttggacccttcttgggggtatgatggggatgggtacagagaggagagggggctcctgtggatcacaggaggctcaggtgggctcacctcgatttgcgagtgcacccacttagcgtgcacagagctagcgcctgctgtctgccaggccccgtgctggaaatctttccacttccaaagagcaaaagcaaacaggctgtgtgaccttcggtcagtcccctcccctctttgagcctcagtttctctgtctgcagattggggttggataatgagctctcagagggccctttggtttcaagagccattgaagatgctggaaggaagcaagctgaggccctggggacccttagatttactattgccatctgaggggtctacccatcatcccagagcttgtgatcttggagcctggggcaacccctgctacactgtttcctagctggaggtccctggcagagtcccttcatctctctgtgcctcggttatcacatccaattggcaataagaaaagaagggaggctgggcgcggtggctcacgcctgtaatcccaacactttgggaggccaaggcaggtggatcacctgaggtcaggagttccagaccagcctgaccaacatggcgaaaccctgtctgtactaaaaatacaaaattagccaggcatagtatcgcatgcctgtaatcccagctactcaggaggctgaggcaggagaatcgcttgaacccaggaggcagaggttacagtgagtcgagattgcaccattgcactccagactggacaacagtgcgagactctgtctcaaaaaaaaaaaaaaaaaaagaaaaaaagaaagaaagaaaagaaaggagcagggaggtagagccctctgtaccctccatcaccagaaaaagctgaagaggggctgagtaggagggacagatgctggccagggcacaggttttgaagcataaaactcttgccctgtttgctgactcgttgagacagggtgcccagaaggggatagacttccctggggcgtggggagagcaggaggctcaagtgagatgctcttggtgctagaaaccgccctccctcatgcctggggtctctccctgccaggaccctgccccgcttaggctctgccctgtctcatcccagcccaacagcatggtggtggaacaccccgagttcctcaaggcagggaaggagcctggcctgcagatctggcgtgtggagaagttcgatctggtgcccgtgcccaccaacctttatggagacttcttcacgggcgacgcctacgtcatcctgaagacagtgcagctgaggaacggaaatctgcagtatgacctccactactggctgggtgaggctggccctgcccagcccctgccccagcccccattctgaacagtgcagacctttggggcatggtccccagggagggaactgattattgagcacctagtatgtgctgggcccttgactggtggttcatgccctgagacgctagagccagcctggccaagttcacacccccactctgcccctaacccatgttctgtcctttggcaagtcacttagtgtccctgtggagtggacatgatgatagctctgcactacctcacaggaatgttgtgagcgttaaacaccttactgtgacactcagaactgtgggtgaattggagaccctggacctctccacaacttccctggcccagctccaggcactccccagtttgcccttgagtcaggagcccggagtccctgccacacctctgccgtgggatgctataagttctgcccccttgctgagcctcagtttcctaatctgtgaattgatctgatgctcccagtcctgagtttacgctcaggagggctgagaatgaacataagggaatgtgacagagctgggaggacgcttagagaaaaatgaggtccatcgtcctgttatacagatggattaactgaggctcacagaaggcaagggctttctcagcttctacagctaggtcagggcagtgctggggttcctcctccacctcctcttcctcaggggtctgggatacttctggaaagccaggctcatattgctctgatgtcccgtaggcaatgagtgcagccaggatgagagcggggcggccgccatctttaccgtgcagctggatgactacctgaacggccgggccgtgcagcaccgtgaggtccagggcttcgagtcggccaccttcctaggctacttcaagtctggcctgaagtacaaggtgggttgggccccaccttgcttgagcggtagggacagatgcaccagtaacagggctcactcaggcccatctatcttttggccttgtgatgcagtgggcagaccgatcagaggtcaggctttggagtcaaccaacattgtgtttaaatcctggcctctttctagccatgtgagcttggacaaatcacactgcctttctgagcctctggttccttatcttaaaatggggagaagaaaattccccataagttcatagtgttgtcttcctagccccaacagtgaggagtgggccagaggtgaaaatccagttcttcttgcaggccctggggggctttggcctagtcctgttctggtaccccttaattcttaaggccttgccaacagagggccccgtgttaagtatttaatagggcattgttagtcacatccctctttctgttcactagaatcccctttgaacttgaactcttcagagtctggatcaagacagagctcttttcccaagctcctagccaggtggggcagagcaaggccaaactgggagctccaagaggctgcaccctaatatgctggtgacttcctgcaagccacttgacctccttgagcctccctttcctctctggttacctgagagccagttgtacctgccctacagggctgggagaggatttggtgtgggggtggctgggaaatgccttgcgtggggcttggccatctggaagggctatggaaacactgtagttttacaaagctggggttttccttggtcaggatagagaaggggatcacaggctttcacagccaggtgggccttaatgtcagagtccaaatctcattttaccaggggagaaggggaactgagacacagaaagtcttaagcaattggcccagagtcacacagcgaattggtgccagacccaggactagaacccagatgttctgactcttagcattctttccactaaaccaacatacctctaatgaccagggtcctagggtagggtccaagcctgtctgtgctgctgatgtgctgtgtgaccttagagaagtcactgttcctctctggacctcaggatcatctatgtcaatggagtggtgaccttgtctgccctggtgaggcataagagattgaatgatgggaaagtgccagtgagactcagatagcaatgggcagggtgtgtcctgggaactcacagtccagggctgggcagggctgggctggattccctggagccccttgtgcccttgcactgagctcctcctgctgaggtgtccagctctgccttcttcccacagccctttctggggccttgataccttgcagaaggagaggtgagaagtttgggagccagtcccctgagctggagaaggaccaggtctttttgcaacttctggagcaagaaatggaacgaacacttgcccaggaatcacagagattgggattcaggttggaaggctaccttctgtaactgctgtgagactttgggcaagtcttgtatctttgggcgggtgttctcaatcatcctccattcatcattcattcagcaaatatttactgagcctcaataacagcagcaccagctcattgttgctacactatggcagatatggtactgggaatgtaggttatctcgtttcagcctcacaactgtcctgggaggtaagtaattcccattccattttacagatgagactggaggctcagagaggtcacataactatattcaaaccaggattgtgttcccttaactctgccaggccctgtgatgggtgctggggtgcccaagtgaagaaggtgggtccctgcccttgagagtgttctgaggagttggggagactggcaggctcacgaagagttaatccattgcctccaggtggggtgatgtgggatcccagggagtgctcagctctgagaggggttcagggatgagatagatgagtaggtgtttgctaatctatcttgtcctagtcactgtttcttagggcataacctgacagtctaacatggttacaaatatgagagttctcatatacacagaaagggtgattttccaggtcagagaatgttgcagagcaggtcataggctcccggatttttaggaataaacaaggatgataataacccttaccgtgtgttaagccttgactacaagatctcatttaattctcactgtagcctttagggtggatggtaatgctccatttcatagacgaggaagctgaggctcagaggagcaaactaacttgcctaagttcacacagctagtaaaaggtgcttgtcattgaacacttatctattactttctgtgtgtcagggactcttctgggtgctttactcatttaactcattttaccctaacaggtagggtatctgttagcaccattttataaatgaggctactaaggcacagagatgttaagcaacttttccaaggtcacacagctagtaagtgattggactagtgtgcaaacccaggtgtgaagggcctagcacagacctggttcagagtagacatttggaggctccctgatctttgatcctcgctcggatatggcctgggatctacttggatagccaggttccccggccccccgatgattttccaggatgttcttggatcacactcgaggaaagctccagctgggcccagatttggggcttctgtcctgaaaggcgctggctcctggtgtgaatgggaggcccagggctggtcttgtttaccaccttctgtaagtcctcagtctgcccccgcacttggcaggtccagcccaaggttctcgccccggcgccctcatcaattatagatcccggaggagcagggcttgttatgcaagacttgttcctgtgaaagcctcttcctctgagccaattctgtcctcggagtgtgagaaggggcagggaggggacagcaagccactagaaagggctgacatggggcttggccctcttgttctatgacccccaaatccttagatcactgccctgcaagagagttcagaatcccttgattccccgcccctcctcctcccactccgcagacccccatttttggactgaatcctggagaccccgtggggctgggttatttgaaacccattgttcaaatggaatctgggctaggcagagacctaggagcccttggacctgaggaacacaattgggaacccatagaatcactggaacctttctgtcctccctctctcctattccttagataaggagctctgagtttagagggtggaggggcccaagcctgatcaattcatttttctttgttttagaaacagtttaacttttgttttcatgtaaatcttcattgcttcttttcccccttcttctgactacaagagcaatataagcttattgtaaaatgtcaaacattacagaaatataggttccagaaaataaaagccctcccaacatgattctccccttggagatatatagtggctaatttctttctgtctctctgaacgtatataggtagacagacacatatatatgtaatcactttaatttggaaaatggcttttaaaacaatttatcctgtagaattttgttcaaataatttgatgccaatcttgctcacctaatgattagaccacagaaagcagcaatcagtgctaaagatgatagtcaaaaacaggaaaaacttcaaaaaacttctttcccctgcccttgtagatccactaatgtcttctaagagcttgctttaatttatttttgttaattaatctttccaattctaattccctagaccagtaaaattagaggagttaattaatcaggcagctcatggctgcaataattcaacatcaagagttatgttataaggccgggtgcggtggctcacacttgtaatcccaacactttgggaggccgagatgggtggatcatttgaggtcaggagttcaagacctgcctggccaacatggtgaaaccctgtctctactaaaaatacaaaaattagccgggcgtggtggcgggtgcccgtaatctcagcgactcaggaggctgaggcaggagaatcacttgaatctgggaggcagaggttgcagtgagccgagatcgtaccactgcattccagcctgggcgatggaacgagactctgtctcaaaaaaaaaagaattattttataaataaatacagagaatttttaagaagtgagatttatgacatgaagcaacccttttcctttttaaaaaatagggtaaagattttaataacaaaaatgaaaggcatacttcaacaagtaaaatatttagaggggtaaaaattttttctttccccccatttccttgtctccgaggaatcaatagaaacagtgagtccttctagcaccttttggaaaaggtttgcacatccactctctcattatgtccaggtgaatgaagtcccctggtcaggagttcctaggctgacagttgaatgaagctgggtccctggaagggggatcttggggatagaacccagcactgccgcccagcactgggctctggacacaatgcttaatctctttgaatctcagtttccttgcctttgaagtgggaaaattattaatagttcctgcatcaggggcttgtggtcaggacttcattgcatgcacttaaagcaggtgccccagctttggcaaagctcggtaagtggcagccactgtgcttgtttcaggtaagcacagctgagcacaggtgagcgcaggttgttgcattttcttccctggcggttcttcctcacttgctctgggcaggcttggttacatcggtctcagaaccctcctgtctttctgcgcttcccctgcctttctgcgcttcccctgcattgccctgacctatgtcctttgcactctgcctggctctccaatcccaggcctcacggccatccagccttcggaccccctcagttgtgactgcagttgtgactgcagctggtcagtccctcaccccagagtcccaactcactccttcctgatgatggaaaaatttactgtcttgcttcccagttttgggcagcaaattcaggagcagaagtcacagtcttaccccttgctccacaccgaggtcagtcatagtgtggccaacccacagctcccttgaaggggccctggaagcagggtggaaagataggttgttagctctgtgagcactggccgccctgctagtcccaagggactcttgaaaggccttagctgagaccaagaagggacaccagggagtcctccagccactggcaacccaaaaacatccattacttgaaagagggctctgaataatggcttgttcctgcctcccatcctggatgactgagtgatctttgctctaagaaaacctgatattggctggcacagtggctcatgcctgtaattccagcactttgggaggccaaggcgggaggatcacatgaggccaggagttcgagaccagcctggccaacatggtgaaacttcatctctacaaaaaatacaaaaattagctgggcatggtggtgcacatctgtaatcacagctacttgggaggctaaagcacaagaatcgctggaacccaggaggtggaggctgcagtgaattgagattacaccactgcactccagcctgggcaacagagcgagaaaacctgatattgagagaagaatgtggatcttacagattcagacatgcctgggtttgaattctagctccaccaccttgggcaagtcccgtcacctgtgggccccattttgcacatcagtgcgatgcagcaatgacacctcccttgcaggcgatgcgtgaagaatgcccggcacagtgggcatcatcatttcacaaacacgtatactgctgacacaggaagacagagcaggagcccaatatacacggactccgtttgtcccttgccctcctcgagtctgtgcggctagaattagacttagcacagtgggctgaggggccctggatggggtggctgcattgctggcctgagtggaagccctctgcttccacccccatgtgtctccggagcagggagacgagcacccgattgggaggaggaaacaaggtttccagccttggcttggccacgcacttgctgagtgcccttgagtaagtcacttcacttctctgggcttcagtttaccgtgggtaaagtggggtgaagtagaaggacctttccaactctgatttgacaactctggggcatggagctggggactgctcacaggaaagcccagctgactttccttggcttgcttctgagtgagggcagttgtgactgcagcagggaagctctcctgaacgccttgctctgggatgcagtaatgattacagagggctggggagcaggagcttgtgtctccacttcagaaaggagaggcctgaggctcggaaagggcaagtgacttacccaaagccatccagcattgttgtggcggggcacctgtcccttacccatagctgctctgaagggactgctgggtgggagttgctgcggtaccgtaggggaaagcagaagggtggcatgggctggaacaatccagaaagacttcccagagagccttgaaggatgagaaagatttggattagtacctctcaaagtggcttttgcaaaatactcaagctggaggcaggatatggtgaagaaaagtggttcttgggctgggttcagtgactcactcctgtaatcccagcacccaaggatctcttgaggccaggagttcaagaccagcttaaacagcatagtgagaccccatgtctacaataaaataaaataaaataagtaagctgggcactgtggctcataactgtagtcttagccactcgagaggctgagatgggaggatcattcaagtccaggagtttgaggttacagtgagctgtgattgtaccaatgcactgcagcctgggacagagtgaaaccctgttgaaaggaaggaagagagagagagagcggaaggaaggagagagagagagaaagagagaaaggaaggaaggaaaggaaagagagagggaaagagaatgaaagaaagaaaaaaagaaaggaaagaaaaaagaaagagggaaagaaagaaaagcagttcttggttcaataagatagggaaatactgtataaaacaaaaggcaagcaggtgtattcaccataggatttgacagagcctttattatgcacatgcgcgttgtataacagtcagggagggtgagtgagaagcattccctatgcttatttgaccgtggaactctttccttgcagaatgtcttaggggactagtgtgcctttgggaaacgccggttttgaggaaggaattgttgcagtttttttgatttagaaagtggctacaggggtccttgttagtggagtatgggattcaaaggggtggcagaaagatgcagtgggcagggaatctctcacttcttagctgtgtggccttgggcaaattttattcctttcctaaacctcagtttcctactctgaaacagtctcaaacaagataatgggtatgaaagtcctgagttaactgagaatcactgtgttgctggaaagcccctggtccacaagccagaatttcctttacctcaattctgtccccttcttccatatctgcttccctgggccttctcccctgggctaatgctgtctctttggccccacagaaaggaggtgtggcatcaggattcaagcacgtggtacccaacgaggtggtggtgcagagactcttccaggtcaaagggcggcgtgtggtccgtgccaccgaggtacctgtgtcctgggagagcttcaacaatggcgactgcttcatcctggacctgggcaacgtgagtcctgctttcctctttcccaggagccactgaggtgctcctggtctgatcagggacttgggtacatccacgtgaacaaatgcatagatgcaggtgggcaaaccacagggaccagcattgttcacgtacagatatgtctgtatgcaaagactcccacaaatgtagactcacaccacgggtatagtgcgtacttggactttgattgacatatagacttcctggcaccttctgttcatatgtacgtcttgtgtcctttttcacatgcttataaatatataacagtcatgggcaaacactctgggcttttgcccaccaggtgtgcacatgtgcaccatcatgaatgcccacacatgtatactcgggtatgttgtttaaggtcccacatgtgtatgtcatacatgtagttgcacatgcccatgatctatggcaatgtgtgtgggatgcccttacccaggcccaccttatagatgtgtgacgctttgtacacacttgtctcacaaatccctggagcgcagacctgcaaatggacacggcccttctaccccaaagctcatatgcttatacacctgtgatataatgtccgtgcaaacatgagcacacactgatttagtgtaagctttttattaaagcgtcatgggcacacagaggagtgtgtgaatcctgagtgtacagcttgatggattacacagagcgaacacactcacgtaacactggatcatgaagcagaacctcaccagcccctagaaggccccttttgcccctttcggtgccctcaccccaagggcaaccatcatcctgaactttctcaacagcatagatgagttttgcctgtttctgaactttatagacacggaaccttgttcttttatctctgaccttttgctcaacattacatttctgagatgcatccgtattgttgcatttagttgtaggttgttcattttccttgctgtggaagattcagttgtgtgggtgtaccatgatttatgtatcctttatgttgttgatgggcacttgaggtggcttctggtttggggctattacagacagtgctactctgaacattcttgcacaagtcttttggtggacatacgaacgtacttctgtcaggtattttcctagaaggaggattgctgggtcataaggaaataggtatattcggctttagtggctatggccaaatggttttccaaaatggttgtgccaatttatattcccttcagcaggcaaacatttttgcacacattctagatgtagttgtacctgtgaaaaaattcctgtcctcagacatgcgctcccatctcctggtgtgtgcagatcacacttaattgtacgtaaataatgcacgtgtgcagactgtgccagccttcacctgggcaagtgcagaacagggtgagcctgcacaccacacgccacactccccaagccctgtcgctgggcggggcttataggaaggcggggcactgacttcctgggtctctgtcttccagaacatccaccagtggtgtggttccaacagcaatcggtatgaaagactgaaggccacacaggtgtccaagggcatccgggacaacgagcggagtggccgggcccgagtgcacgtgtctgaggagggcactgagcccgaggcgatgctccaggtgcctgtggggtgcgcaatggggtggccatggggacacgctgctcatgactttcttctgttcagtaggcaatttgaggtgaatttgaggaaaaaaaaaaacttccgctctaccccacctttttatttttaaaatacttttttattttaatttttgagacaggatcttattcattgttgcctgagctggagtgcaggggcgccatcacagctcactgcagccttgacctcctgggctcaagtgatcctcctgcctcagcctcccgagtagctgggaccacaggcgagtgctaccaagccaggctaacttttgaattttttgtaggaatgaggtcttgccatgtcgctcaggctggtctccaacttctggggtcaaaccatcacctgcctcaacctcccaaaatgctgggattacaagcatgagtcaccatgctggccctgcctcacttttgaggctgtttttccatcaaacctgatcactttagggagcaagggagatcagtttcttgcacaactccccgactaccctgagaggtgggactggaacccaaggctgtgctgtgagtgtgagccgcattctccagtggggagggccaggtcctctgcagagctaaggagggcagtctcttagcatccccagagggccagctttgtgctagaataaggtcagaaagagaccactgagccccaatcccctcttttctcttctgactatttctggtagtttttggcccatttagtcacatggtgggattgccagccattgtgcgttgaggacgtatcaatagaggcaagattcactaggaaaaggagaagaccatgagctctgctccatgtcacttggttcctgcttctctgggggcatccaattccagcttttggagagagcagaatggtgattattattatgggaagggacctggacaccaaccatggcttgggagggacagtgggagtgaaaataggctctgaagccacagggatggaggttcagattctggcttagccacctaatagctgtgtgagtaggtgacttcatctttctggacctcagattcctcttctgtaaaatgagagtgataatctgtgcctcctggcctggctgcgaggatgcagtgacatcttttaaaggtaggcggtagaaggtgttcagtagctatagttatcacaattagccggtaggcgaaatatctgaagcgctgtctggaggcagaggagcaggagtgttctcctggagtttctgagtcagggagacaaggtggaagggacctctgatggacagatctggacatgtgagcagatgcaggatgtgtctggaggaggtcagactccatggggagggtcacagtggatgtccttgtgatccttgcctgcctgggagctatctcaggagcctggcccctccctcacagccacccttcctctccatctctctatctcctacaggtgctgggccccaagccggctctgcctgcaggtaccgaggacaccgccaaggaggatgcggccaaccgcaagctggccaagctctacaaggtgagcaccagatgcactgtctgcctgggcatggggtcaggacagggaggtggaagacttggtcttccccactccactgctatgggaccttgagcaaagcacccctttggaggggggcctcagctttctcacgtctccagtggatgctcgtgtacttcctttgctttcctgcactaagagcatgcgatcaactccgtacatatctgtgtcacgctcatacatgaggtctctctgagtctcagtgtcctagtctgtaaagtgggaagaagagcagaatggtcgactttgtaggatttctgggagtccacagataaaatggatgtgaaaacagcttagaaaatacttggggaaatactacagaaatggtgtgtatgtggggaggttgggggtgtgggttatagttaatgactttatttatgatttctttcttgtgattttcacaactgaattcaggcttagcttcagctagggaactctcttggctgagctctgggagaaagctcaatcacacttacgttgtgccccaagtattttcagtaaaacaacaaaaaggggatgtcgattttcaccactgccaaagaaaaactactacattatcgattttttttctgattatgaagtaatacatgtttattgtaagaaaaaaaagtattcaaaatataaaaagaaaataaaagtccatgcaatttcactggtttaaaaaaccagtattacttttaaaatatgttttaattacaaaaatgacaatacccagttaaaaaatcagcctctcctcctcatgagagaacacatctttgtccagccacagctttctgtgcctagttacttttccatttccatcttattattttattttgagatagggtcttgctctgtcacccaggctgcagtacaatggcacaatcacagctcactgcaacctctgcctaccgggctcaagcgatctcttgcctcagcctcctaagtggctgggactacagatgtacgccaccacgcccagctaacttttgtattttttgtagagacgaggttttgccatgttgcccaggctggtctcaaactcctgggctcatgtgatctgcccacctcagcctcccaaagtgctgggattacagacctgagccaacgctcccggccatttctattttgtgtaactggatccaaactattcatgctgttgtgtggtcttttttccactcaacatggtcgggaatatctttctataataaatctcaacacgaccctttataacagctgtatagtattttattttatgaatgtaagaatttaagcaaatcctgattgatggacattaggatgttccaccttttccagttgcagacagtccctcttggtgcacttgtgctaagtacagcatagcactagggcaagttcctagacaaggaactgctggtcacaggccgaagaatgagtcagtagttgaaaatactggttctgggccaggcatggtggctcacccctgtaatcccagcactttgagaggccgaggtaggcggatcacctgaggtcaggagttcgagaccagcctggctaacatggtgaaacactgtctctactaaaaatacaaaatattagccaggcgtggtggcgggtgcctctaatcctagctctcctcctaagggaggagaatcacttgaacccgggaggcggaggttgcagtgagctgagatagtgccattgcactccagcctgggcgacaacagtgagactccgtctcaaaaataataataataaataaaataaaaaaagaaaatactggttttggagtcaggagtcagactacctgtgtttgaattccaggtcagctatttctagctgtgcaagttccttaaccactctgtgccttggtttccttgtgaatgagacagggatagtaacagaactatcatatgcaaggattaaaggggttctataattatacaagttatagaaattgcttagaacagtgactggcacagagtagtaagtactcaattcatgtagaataattattatttaaaggactgctacctcacagtcaactgtactctggaacagctcccaaattactgtcatcagggatcttaaatgcctgtttacccagagccttgccaactggatattgttaaacttttgaattttgactcttaagatagaacttttttttgagcttggttgaactttttattttagaataatttttaagtttacagaaaaattgtaaagatagtacaaagagttcctatataccattcactcagcttctccttagcatcttagcataaccaggtacatttgtcaaaactaagaaattaacattgcttcagtaccattaactaaactatagactttagccagatttccccagttttttattctaggttccaatccaggataccagattgcatttagctctttttacttttctttttcttttcttctcttttatttacttatttatttttgagacagagtctggctctgttacccaggctggagtgtagtgacgcaatcatagctcactatagccccgacatcctgggctcaagtgatcctcccacttcagcctcccaagtagctggggccacaagcaagcgccaccacaccttgctactttttgtattttttgtagagatgggatcttgccatgttgcccaggctggtcttgaactcctgggctcaagccatccacccacctgggcctcccagagcgctgggattaaaggtgtgcgacactgtaaccggcctcttctcttttttttgaatagtaaagttgaatacattttcagcaaactatgcagttcccctctgcacccaattccccaaattttatcccgccctcccttcccatgtgcagtttgtgttacccctgcgtgtaggtcagcagatgtggttctgacaaagcagaaaacgaaaaagaacctctaaatgtgtgcgagaggaagcccaggtgttactctacagggccatttgggacagggggtggggcaagatggtggaagtctcagggctgggcggccacagacactcatgtgctggttccttctgcttcgtcccctcaggtctccaatggtgcagggaccatgtccgtctccctcgtggctgatgagaaccccttcgcccagggggccctgaagtcagaggactgcttcatcctggaccacggcaaagatgggaaaatctttgtctggaaaggtactggagacagggaaagggtcccaactggcctgtaggatcttggatgggatgttctgcagctcccaggaactcagctcccggggagtgtggagtgtgcctggtgcaatggaaatcagaagtcttgggctgaggccttggttttgcatttgacatactgtgtgatcttgggcactttacttaccctttctgggcctcagattcctgatctgggctaaaatgggtgtttcccaagtgcattataacgtcagttctctgagaggctaattggcatcctgtagaaattatgtagaaaacatctaactgtatggtcagataaattcatgggcaacagtggattttaaaatgttcgagtttgtttactgtaggacttttaacttgttcatttacaggggggcttttcatgaagatgatctggtttgggaaatgctaagctagaagttcataaactctttcggtactatcttgtgggaattctcttggaaaccattggcccagatgtttcccagaggccctgagatgttctgagaggacccatcaatatcctcccctgattctctaaggctcatcttggggaagaggacagaggagagggaggcagtaggaggacagagagaaagggagacggtggggagaaagagagagagagagacactattatgattattactctctaggccccctgggccctgggccagctgatctggaccttggccttggcagtgagaaggctgggactgaggcccagcactggctggccaggagctccttggcacgggaatgccctcagggtggcagcttctcactcactgagtaacctaggtcaagtaatttaatctctctaagaccctagcttccttatagatactcagaaaaagataacaactttttttattacttaagactattctgtgaattaaataatctatgcatagttctaagcacaaaatacatgctcactaaatggaccacagtagtgttgtgattggtgtcactggccagccccaggctggacaccaggagctctagtgagtggtcggctctgggggtctctggccttggctgtccacagtctaagaagagtagggagggaagtttggcagctccttctcctggactgttaaaggtcaggatgcagcaggatcccgggcctctaaccctccatcacttcctctggctgccaacaggcaagcaggcaaacacggaggagaggaaggctgccctcaaaacagcctctgacttcatcaccaagatggactaccccaagcagactcaggtgagtcttggaggccaggtaggatgggaaggggtgggtcctgtttggaggggatgggctggagtagggcgggtgtcccaccctcagtgtggatggggtatctgaggctcccctggggacccctgctgggcagcccagccacatcctgctcctctgcctcccctccccaggtctcggtccttcctgagggcggtgagaccccactgttcaagcagttcttcaagaactggcgggacccagaccagacagatggcctgggcttgtcctacctttccagccatatcgccaacgtggagcgggtgcccttcgacgccgccaccctgcacacctccactgccatggccgcccagcacggcatggatgacgatggcacaggccagaaacaggtacgtttagggcgtggggtgggtgtgtccaggcccctccctcactttccccatgcactgcctcttgcttccccaaggaggtttctctctgaggtttgcacaactttggtagctgagattctttggtgttacttagtttttacagccaatgcaccctgtgtatcaggccctgagccaagtgtcttggccccaccttgccccgaggagtgcctggtctgggaggggagttgaccatagccacagacctgtgtgatcagtggaagatgggagggagcacaggggattgtgcagacacaggaagcagtgggggtggttggtcagggcagcctgcacagagatgggaacctttgggttgggtctcagaggaggagtagagctttgctgccggagaggaagagcggagagtgatgggcattccaggagggactcgctatgttcggaaaggagggagctatcccagggggctagtgctgatggcatccccagggaggggccttgaatgccaatttcaagggtgtagacttgatcctctaaccagtgggtgctagtgaggggtttttctttttattaaatcagacatgcaacaggctcagatttatgctttatctttttttttttttttaatagagacagggtctcgctatgttgcccgggctaatttcaaactcctgggctcaagcaatcctcctgcctcggccccccaaagtgttggaattacaggcatgagccactgcgcccggccacctgctttagaaactcactgtgaaaatgggttggaatatgactccaggatatcattagaagaaaaaaatcagttaaaaaataaataaaagaaaaataaaaagaaaactaagaaaatggattggaggcaggaaaatgaaggtagagagcttataaggagcttgttctaatactgtaggggaaagatgatgaccttgagactaagaaggtcacagtggagaaggggaagaggggtgtggggttcagaggtgtttaggaggtagaatccgcctcaggcaaacttgactccgttcctaatgataggaataacaaagtgttcatttttatatattattgtttttggtttggtgctagcattcatttgttgcttcagtggctagggagaatgcaatgaaaatatttcgggtggggcggtgtggtaagacccctggcagcctgactgtgagactttgggcaagttacataacctctttgagcttcactttctcacttgtaaagtggggtttcatcccactccatcaccttcaagaatgttcaaaatccagagattctaggattctgtttcccaggacttggacgactccgtgtctccatagctccaccaggtggcgctgccgggcctcgtgaccacttggaaaaagcagtgtcaccagaacgctgcggagacctgccagcaggggtcacactgaggttgcctcgtggtgtccctgcctctgcaggtgacctatgaaattcctggcaggcccagcacagtggctcacgcctgtaatcccagcactttgggtggccgaggcgggtggatcacctgaggtcaggagttcgagaccagcctggccaacatggtgaaaccccgtctctactaaaaatacaaaacttagctggccatggtggcaggcacctgtaatcccagctactcgggaggctgagacagaaaaattgattgaacccgggaggcagatgttgcagtgagccgagattgcgtcattgcattctagcctgggcaacaagagtgaaacctcgtctcaaaaaacaaaaaaaaaaaaaagaaaaaaagaaagaatccaggcagctcagtaacaatagaggtaatggtgatattagtaagataataataataattatgacaataagagcagctgccacctacagagcagtccctttgtgccgggccctgtgctagactttcacgagtaatctcgtttgagcctcacagtactttgaggtaggtactatgattatccccatttttcagatgggaaaactgaggctaagagtggttaagccagttgtctgaggtctcatggcccggaaggggatgaggggcctgatttggggtctgtgtctggctcctcccctcactgtactgcattcctttggagctgccttgacgatcctcagcgaaggacagacgggctggggcagggcatggtatgaggagcccaggcaggaaccctgacccagagtcccagccctgccttctagtggctctgtgagttgggcaaaccatttaactccagtccgagcccaagtgattaaaagttcatcccatggcctaaccacaacctaccacactgcggtttcctggcttgcctgagctggggggtgggggtgctgcacagcatctgactccagctttgctcctgcagatctggagaatcgaaggttccaacaaggtgcccgtggaccctgccacatatggacagttctatggaggcgacagctacatcattctgtacaactaccgccatggtggccgccaggggcagataatctataactggtgaggttctggggccattggtgtgtgtcgtgggggtactggctgggccctgagcagggctgaagacaaactgagggtgtgagggcctgaggtgggaccaccactccctgctgggagaggcttttgtccacagggcaacaccatttgcttatttctccaaacaactttgaaactcttcttaccaaatgattatacatctattgtaggatatagtgaatgtggagaaacaaacagaacatctcccacaaatccatgacaagtactaggcacactagggtttatcctcccacacatatttttcaagccaaaatttttttaaatttatatttgtttatttatttatttatttatttattttgagacagagtttttctcttgttgcctaggctggagtgcagtggtgcggtctcgctcactgcaacctctgcctcccaagttcaagcaattctcctgcctcagcctctctagtagctgggattacaggcacccaccaccatgcctggctaattttttgtatttttagtaaagacggggtttcactatgttgaccaggctggtctcgaactcctgacctcagatgatccatctgcctcagcctcccaaagtgctggggttacaggagtgagccaccacacccagccccaaaattattttaaaacagagaatacatttacatggttcaaaaatcaaaacagaatataaaggtatttattgagaaatcttattcccacccctgtccctctctaccccattctccagaccccaccccttcttgggtaactgctttactctcttgcatatccttccagtaactcttcgtgaaaaaaaatacatatgcaaataatttatagcctggtccctcccttccttacacaaaaggtagcatactttgtatattgccctgcaccttgcttttctgactccattcttcctagagatcaataatgtcagtacatagagacagagagctttctcattcttttttacagttgcataatagtcctttgggtggctgtactatagtttatttaacaaattccttgatgatgcatacttgggttgattccagtctttctctattacaaacattgctgtgattagtaaccttaaacaaacatcactttgaacatgcagagacatgcctctagagtaagttcccagaagtcagattgctgggtcaaagagtaactgcacttgtcattttggtagatagcccccaatttccctcgatagtgttcgtagcattttacattcccaccaagcaacctgtgagagtccctggttccctatagtcacactcgtggattgtgtggtcaaacttttgggcgtttgccaatcttatggtttataaaatggtgtctcagtgtatttttaacttgtatttctcttactatacagtctaaaactttttgtctgattattgactgttggatttttttttttttttgagacagggtcttgctctgttggccaggctgtagtgcagtggtacgatctctgctcaccacaacctctgccccccggggctcaagcaattatcgtgcctcagcctcctgagtagctgggactacttgccactactcaccaccacacccggctactttttatactttagtatggatggggctttgccatgttgcccaggctggtctcgaactcctctaagcgatctgcctgccccagcctcccaaagtgttgggattataggcatgagccaccacgccaagctggattccttctttttttaaacttattttgaaataatattagacacttgctgaaaagttgcaaaaatagtacagacagttctcatatatccattacccaatggaatattcacctatgttcacatcttacataacccttacataaccatagcacaattaacaaagccaggaagtgaacattgacacaatactacttactaatctataggctttacctaaatttcctcagttttcccattaccgttttttttttttttttttagacagagtcttgctctgtcgccaggctggagtgcagtggcatgatctcggctcactgcaacctctgcctcccaggttcaagcaattctcctgcctcagcctcctgagtatctgggactacaggtgtgcgccaacacacccaactaatttttgtatttttagtagagacggagtttcaccatgttgggcaggctggtttcgaactcctgacctcaactgatctgcctgccttggcctcccaaagtgctgggatgacaggcatgagccatcgtgcccggcccccactactgttcttttcctgatctaggatctaacccaggatcccacatggcatttactcatcatgtctccaaagtctctgaatctatggcagttgcccggtctttcctttttttcatgcccttaacacttttaaagggtactagtcagttattttgtagaatgtctctcaatttgacaaccccagacatttaaaaacagcttaattttttttttgactagataacacattcacctggtacaaaatgtgtgagaagactgttttaaaaattagctgcatcagcgcattaataggtcagattttgtttgcttatacgacgacatatgttggttatggaaaacttagacaatatgcaaagaggtgggatagaaaggcaaaatccccctaaatcttccctctaagagcaatcaccatggacctttttggtgaacatctgtgcagacctctctgcacgtgttcatgggaggcttaatcactgacatcttttcccacaaataggctctcgtaacacttgctattctgcgacctgcttttccgcccagagaaatgtcctggccacttttctgcatctcagatttgagtctcagagcatcttctctgtggctgttcagcatgggatgacccagccagtctcctgtgggacacatttagcataaggaaatccatgcgttgcactaagatctctgtaagcgggcaagatgctaggctgagagtggaagtgttggtgtggttcctggctctcgttgttctgaaagagtccccttccctctctatctgtttcattactggtaacagggagatgtgtaggtttctcagactcagggcaagggagaggctcagggctctgtgtgcaccctgatgctgaatctcacttccccttccaggcagggtgcccagtctacccaggatgaggtcgctgcatctgccatcctgactgctcagctggatgaggagctgggaggtacccctgtccaggtgagcccagcccaccgcctctctgggctgcagcctgagccttgtccttctcttcactcatctgtctgactctcatccatccattcgtttgtccatctgtctgtctgtccatccatccatccatccatccatccatccatccatccatccatggaacaggtatttatttagggcttccatgtgttccacactgcatctgtagccatggacacacagacacactgtccctgccctagtggactttgctgtcttgggtggtagtagacattcaacacacaggcacaccaatggctatgacagatgcagtgagtgaaattgacaagaccttgggagagagacatgggagaggccatgtggctgagcacggatgtggaaccagcatgcttgggtttgaatcctgtcctcacctctgggcaacgttgggcaagtcacttagcctctctgtgcctctgtgtcctcaaaataggggtaataacagtaccatcccacaagattgctgtgaggattaagagttaacatttgtaagcatttagaatcatgcctgccatataagaagtgcccccttatacatatgtgttaagtacaaggaggtaaatcctaggtaggatcctattggattagaaaagcccacccctgtcccaggaggggactgttcaactgggacctgatgcacgtgtaggagttgcccaggcagagtgaaggaaagcacattgtgggtaaagggtggtacacatgcaaaggccctgaggtgggagggggcattgggtgttaaagcaaggggaaaatgccatgatttgaggctagagaggtgctcagaggggccagaccaccagaggccatagtgacgatgttgaccttgatgctgagaacaacaggaagttgctgaatgataagtctgaggtgtagggatttctggtttaaaaagtcactctggccaggcgctggagggcagcagagctggtttgtggaaatataggggaagcggacaacaactgtgcttcctccgtcctacggtgggagtgggcagggctctagattggcatcgggggttcgtgccctgacctttgactatgatagactgggtgctgggcactaaatgagatgatgaccatcttagctcagtgcatcctgacaacagccttgggagtagcatccttggctgcatttttcagaggaggaactcaagaggttgagacacgtgcccaagttctcaccatcagggtggagttggggtctaagccctaactcagcggtggtgggtcgtggtgggaagcgactgccatatgcctgacgtacatgtgaggttttcttctggacatagttagccggggccacggtaaggtgccgcacacagggcaggagcagatgtgagggtgtacatcttccctgcctcactcccaccaccaagcccctgactgctgcccgcatctggggtgcactggctctgcaggagggggttttctggatctagaatgctctgttcttaccactccaccagcagtcatgcccaggcctgacgtcagcattctggaagaatgtccaccagcaatccctgtgcttctatttaagggaacatttgcaaacacaggctctcctggttcttggaccaggctgaggatcaggaaggcatgtcgtcatggagatggagagcagcccagcagcagtgccctggggacctcagacaatagcactgtctccacccttcctggaattctggtgtccctgcctgtgtgttgtcgggtcacattccatgccacacacagacacaagcatgatggcttcgtctggagggatgggcccagtgcgacatagaaggactgaagcctgcccccaaggtccctgacttgctctcctgtctccctgccagagccgtgtggtccaaggcaaggagcccgcccacctcatgagcctgtttggtgggaagcccatgatcatctacaagggcggcacctcccgcgagggcgggcagacagcccctgccagcacccgcctcttccaggtccgcgccaacagcgctggagccacccgggctgttgaggtaatttccaggtcctggaacacagaagggattggcctccctgaaacctcccagctcaatgaccagatctccaggcacaggaacgggggcaggggatggtgaatgacggggtaagaagcagctttttgtattttcctgccgtggccacagggttgtctgtcttagactcccccctgtttcaaggatacccagtgtcccttgcacactttgcacagtggacagctcactacctaccattctgtacaatcagcatgccattcctgattacgttccagttgcctactatccctttcacggaggaaggcacagatctggacttgattcccaggatggtctgagcagcctagaggggaatgggactctcacctcctttgttctgggcattcaacttctgttaatgcagccctgatttttagaatcatgttggctagtcacagtgcattagtgactcatgggagtcaaccaaggccatcagggtccaaagtctgtgccctcagctctgatgggctgtgttcctccaagtccccacctgagagctagtcctgctgcggggtctcctgggctgtgaggagggggctgagggctttttgtctggttcctgattaaccaagctgtaccctcccaggtattgcctaaggctggtgcactgaactccaacgatgcctttgttctgaaaaccccctcagccgcctacctgtgggtgggtacaggagccagcgaggcagagaagacgggggcccaggagctgctcagggtgctgcgggcccaacctgtgcaggtggcagaaggcagcgagccaggtaggagccggggtggggggcctgctgctgtccggatgcagctattaagtttcccccttctttccttcagcttgggggctctaaatcctcccctccatcccacctgagggcctgtcccctaatgtatgttaaataaaagcagttgcattaaaatgagggctgtggccagagagagggaggtctccaggagctaaagaaaggagagcctagcctgggcgtggtggttcatgcctgtaatcccagcactttgggaggctaaggcgggcggatcacctgaggtcgggagttcaagactagcctgaccaacatggagaaaccccatctctactaaaatacaaaattagccgggcatggtggcacatgcctgtataatcccagctactcgggaggctgaggcaggagaatcacttcaacccgagagttggaggttgcggtgagctgagatcacgctattgcactccagcctgggcaacaggagtaaaactctgtctcaaaaagaagaaagaaagaaagaaaggagagcccagtgtgggaaggagcagttggtctgtggaaggaggcggtccctcgctaggaagccttgaaaggtggtaggcagggctgatagcgtcagaggagcagtggtctccttgcatctctagactctccatggacagaaatgccaccagcctgctctgtttccagaatgtgggccgggcagctcttccttctgccagcctgcagtctttatactgttactttgagttcattcccacctgcttgatgcttaacagaaatggtgaagagtgacttggtctaaagcagctctgtccagcagaaccttctatgcagatggacatgttctgtatctgccgagtccaatttgacagccattagtcacatgtggctgttgagcacttgaaatgcgaccagtgggaattagtgggaatgaagaactgaacttttagtcgaatttaattttaatgaatttaaatttaaatggctgcacatggacagagcaggtatagtggaaagagtataggtgttagaatcagacaagatttgtatcctggtcttaacacttaccatctgtgtgaccttgagtgagttgcttaacctctccgagccacaactgcctcattagctgagtggagctaatggtcctcatcccgcaatgctgtcgtcagcctcaagccaatagtggtcctggctgtgtgactactgccaagtctgccctctctgggcctctatttcgtcaccttccaattccctcaggcctcttccctctggatctcctgggatttttaggatggagggaggagagggagagcagttggttgcgcttgggcagggctggtcccagggtccgatgagatgggagagaggggtgatggcgtcccttggcaactggcgtggcctcccctcacagatggcttctgggaggccctgggcgggaaggctgcctaccgcacatccccacggctgaaggacaagaagatggatgcccatcctcctcgcctctttgcctgctccaacaagattggacgttttgtggtgagcccctgcggaggtcacacctctgctttcccctcgggaggcgagttccacaggactggccggcagcaggggcaggagaaacagttctgatggtgtggcacagaggaaggggccccctgccagctgcagccagctgtgccactccctcagggggcagataaaggaaggccacccaggggagggaagacatctcactgatgctctttcgttccttcccagatcgaagaggttcctggtgagctcatgcaggaagacctggcaacggatgacgtcatgcttctggacacctgggaccaggtgggtgaaggacaggtgaaggctctctgtgccagagggagtgggagaaactagacttccagttctatgatcagttgctagaaggacctaaagggggcagtgccaggtgttgccagaaaagtctctaagggtactggaagtcacttcttctttctgagcttccatttcctcatctgtaaactgggagtggcggtacctcccttgcagatacactcaccttgaaagctgcaaaacgccctataaaggcaaatcacatgaccttcatcattctctcccagaccttgcaggagcgtgaactcttcctttaaatctgttggcagaggaagttgaacttagcagcatcttgtttgcaggcataaactgtccagtgtcacctagaggctctagagggctcctgcttctggtttgagggctctgggctctgtctccacttcatctcctagagaaggccattatgtaggacttggcaggggaagatgccattcacttactcaaccaatattaattgggcactgctttgtgccaggtgctttatgtttgagatgctgggatagagcaatgaataaagtaggcattttcctgctctcccagggcttacgttctcacaggggtgtcaggtcagtcacctttcctatcaaggtggcttctcccagagtcctcagagttacggagcagctggccacgaaggcataagactctacactacccacagggatgctcggaatccccagttggaagatcgggaccaaaaatgattgcagcttgagccattcagcagttgtcattgattgatccattggctacttaatctgtttgttcatctgttagggattcagtcagccaacatttattcagcaccatggtcttgcaggcaaaatgctgagtgctgagaatcctatgatgagcaaaatagaatgcctgccttcgaggggcttccactttagttgggaacacatttataaataagtaagagagggccagacatgttggctcacacttgtaaacccagcactttgagaggctgaggtgggcagatcacttgaggtcaggagttcaagaccagcctggccaacatggtgaaaccccatctctactaaaaatacaaaacaattagccaggcttggtggtgggtgcttataatcccacctacttgggaggtcgaggcagaagaatcacttgaacccaggaggcggaggttgcagtgagctgagatcatgccactgcactccagcctgggtgacagagtgagactccgtctcaaaaaaaagtgagaaaaatgaagtctgacattttattgtctaatgccattttatcaatgataggtgctctttgaagtaatattttagatatgcataaaaatagatgatacataaaaatcagctaaataatgtgtaatagaacttgtaacaagactcaaaatggtgatagtggtgggtgagttatttttattccaagccttaggcccattttgacaaagatgcacacagaccggcacatagtagactctcggtgcatatttgttggataaataaatgggtgagaatatgtttggccactcatttgttgaacgagtgaatgctgttcaagagataactcatggacctttagagaagaatctcaaactcaatgcctgatggtacctggttggcaatgttagcgaatgaagcaggctgggctggggagacgtgaaggagcagtggagtctgaggcaaactagaactgctcatctcaaaggggcagctcctgcgcagcttgactcaagtgaggtttgaaggcccaggctgctagatcctccaatttttaaagagaagttggaaatctagatttttatgtcataacggtttaaaaagacattgttggctaacacaaggtggtgggtgagcaaacaaaacatgtttgtaggttgccagttttcaacctctgttccaaatccttccagtcttagttcatgggctctgttagaaaggggagggctttgtctggtctgatacctggcccctccccagtcttcctccagccgtgaatttgatcagcactcctcatgtacctttcctgttgcatctcacctccaggtctttgtctgggttggaaaggattctcaagaagaagaaaagacagaagccttgacttctggtgaggacccgagtgcctgggggcggggggaggggtccgttgcttgtggggtgctgggagtggctcctgtacaggtctgggaatgagcatctttccaggggactgatggacaagatagggtggggacttcctcctctgtgggccagcccctcataaatcctgcctgggatagtgaagaacacatcagttccttcagaaaccctgaggcttctcaaagaaggctctcctctgttccaggagaaggaagggacagatgagaagtcacttcaagttcccagaatactcagaagctgaacttgtcaaggtttagatgtggcaaagcaggccaggcatggtgactcatgcatgtaatcccagcattttgggaggccaaggcaggaggatcacttgagcccaggagtttgaaagcagcccgggcaacatagtgaaacctcatctctagaaaaaatacaaaaaaattagccaggcgtgttggtgtacacccgtggtcccagctactcaggaggttgaggtcagaggattgcttgagcccaggagttcacggctgctgtgagccatgatcgcaccactatactgtagcctgggtgacagaatgagatggtgtctcaaaatgaaaaaaaaaaagaaaaagatgttgcaaagcagattcttggcagctgaatagatctgatttgtgagctgggaacccaaaagttggttcccatatcttccagtaggggactgcaagggaaagtaataagctttatgaagcaggagattaagccgtagccctgttccttcctgtgttcctgagcagggtggtggagagcccacgtgggtatcatgcctttaaaggaggatggtgcccagggcagggggtgggcagtagggacagtaggaccatagaccctcttctttgtcaactcctgtcctgagtcaccctctccctggtgtgggaggcactaagaattcctggggtttccttttcttgcacgtgtgtctgcagctaagcggtacatcgagacggacccagccaatcgggatcggcggacgcccatcaccgtggtgaagcaaggctttgagcctccctcctttgtgggctggttccttggctgggatgatgattactggtctgtggaccccttggacagggccatggctgagctggctgcctgaggaggggcagggcccacccatgtcaccggtcagtgccttttggaactgtccttccctcaaagaggccttagagcgagcagagcagctctgctatgagtgtgtgtgtgtgtgtgtgttgtttcttttttttttttttacagtatccaaaaatagccctgcaaaaattcagagtccttgcaaaattgtctaaaatgtcagtgtttgggaaattaaatccaataaaaacattttgaagtgtg

SEQ ID NO: 1451 - DNA, 248545 bp, Homo sapiens
ttgcacaaatattactttcaattttatttaaatcaaataatgttgtgatgatatgaagaactttgcatagaaaccacatgaattttaaagacaaaattcgaatacctaattatcctattctgaaacaattaaaagaatacacatgttaaattgccataaacatgtacgtattacataatacacataacaatcataaaacattttatactgatttattataaataattggaaacaatatttcatttctcaaacccagacaacaaaacagtaaatatcatgctttctttttttattattttattttgtttttgtaatatgagtttggaaatagtattctttatccaaaaactggtttaagaaagtgtctgtaggaacacaaaaggacaaaatactcattttctttcccttaaatgaaaacagttgagaagtttttagaaggagaggcttacctgctatgaagaagccaccaagaatagaaaaatggtataatacctgcaaatatcacttgtaaggcaaaaaggggtagaatacagacacataaatataaaaaagacttgatggtaaactttaaaaagtatttttcttaacaatgtgaatagctttattttctcaaatggaggaaaccattaaggcatagtggatcaagtcaccaagtttgaaactggtattgctaccttgccaacaactgtctcttttatgagaggaggcccagtagctttatttcaattttctcatcccatagtgactcatgttttaataaaaactgtttactgtcataaccttggacacttacaggcagagaagacttcttgataaaataatgcagtaacttcaagcaccccaaaaattcacttaaaatacattatcccataggaatatttccattgagttatttatggcaactagcagtcagaatttcttagtcaggtgactatgattaattttctttttgtatatatttcccttacatataatagttttgccaatttttctcccctgataataatttttaaaaattaaaaattgcctaagggaatggactgaaggagaaatatatgaagaatgatgtatttcattaagggatatagtagatttctttgagcatttgtgttatttgcatcaattaaggacaatgttgcatattccagattaattagctattaggttttttgcagatataaacatgctatgtacaatgatatttataattattttattttttatagacttcaaagtgtttcttttatagacactggaacagtgtgaatctggtaagcatgtttcagttaattagcaaaatttaaattagcaagacataacagggtgagtattggagttctaaaaatatttttaaaataatgaagttacatgtatgtatacacatgcaagtagatactgtaaaatgaactgctccagagtacttgcttttacttcaacttaacatactccaaaatattgctttcctgtataatatcaaaggaaatattaaatgcatgtatattattttaagaacttgatgatatattttacattcttttaactttactcaggctataaatatatttatatatcattcaatcagtttttagagtaaatgaaaaccatagtatgggggtggtaagttttcaccacatacatccttacttgattatgttcatttctttttctgaaaactgtatcaaaaatcagagtaatggagtttgtttctaccacacacttattgtccatgtactacagttcattatggcttacaaaaatggaattttcatttgaagatgggtaagcagaaatcaactagtaagtatgatactggaattaggcttctgaaatccattaacatttaaccaactcagaggacaatgctgttctaaatttttatcaaaattgtgcaacagtataatttgttagtaggtttgcatagatataacaccttttcactggtataatacatcttttccaaaggattatggcaggcttgtttctattcttcatgtatattctctttttcactctttttttctgttttacatgaaattaaccatatttatcatctggctaccatagttccaaaataaggtccagtagtagtttgaagcacagcaagctcagcagtttcttccctttttaaagcccgacagtcagtggagttttctatagtcgagccacgtgagcactgtcaccccaagtagagactcttgtgaactcaaacggctccagattcacggtcaagaaccttggtgacttcacataactaccacttattgctggaagggagacaatattgtttgcttctgaagttttcaaacagtttctcacctggcagcttctccggatttctttgttgctttcataatcgcttctgacattgcgctttcaaaaatctaaaggtcgaatcatcatagttgtggaacgtaaggagtaactgggccctttgaagtagtgccactttatcccattcagttttccatggttttgtcccgcagtatagaacattccatttagattggaggggccacaagcatcaaaccaccatcctgaaaaaataattcataatagaagagagaaggagaggcaacaattttaagtaaatggaatatttggaaattaatggcattaaatgatgggaaacttgcttgttcttgttatgcttatttgcaattacgaggcatcagtaaatatattcccagtagtgaaactgttttaaatgacttctgatttaagatttgtatgacccatcacagacagcaatgctctcatggaaagcagctttcagtgtgactccactggaactcacttcttcttgtaatgatgggaagcctctgggcttcaagatacaatctacataagagatggatttacatttaagacaaatgcaataaggaaaatgcatatacccataagaggcattccatcttaagactgttattgggaatagaacaattaattattagtgaagaaatgcagaaacttagacaagcaactgagatctaaatagaaagatattctccatctactgcatatgtttgtcaataattggccctaagctgcttctaaaattaattggatactgtgcaatgactatgatgctcaaaagggcttttaattaacgtaccctctctgtagtttataacagtagaaaaagtgttcagcaatagtagccattcagttcctgtacagccatattttgtctatggttatttaagtgctttccaaacttagtaaaaagaaaaacaacttgatgagtaacatggaaattctatgcttgtatagctctctataaggataactggataagtcagttttattttttaaataaattaagttcttagatttttagataaagcatagtgttttttcctgtctgctgaagtaacactactgaatctttagggagagatttatgccagagacattctggcatattttttatttggatacagttgacctctctttgattacagacttatacctaagggactaatagctaaagaaagagaaagctgtacagctgatgtttaactgtaacatgagcacaatcttgcagaaactttagaagaagtcaaatggagaaaagctagttctcatttttcaactttagaagatgagtacagctggcttgtgtttataaagtcacactagaggcgtaacaagctgcattaatcaccagttcatagtggggaaccacaaggtatgtcttgatgaatttggaaagacattatattccgtgcagttttatcaactgtatgcaaacaacataaatgttaatgtagtcaaaacatgagggacaaaaaggttcttgtttggaaaagaaggaggaactgcaagtaaaatcctacctttgtttttcttaagattaattcttctaatttttgatcagtacagctgttaaatatgctgtttatattataaaaagcattctaatattagtgaatttatttgcccaaaagactctttctaaaggactaaaataaaactctaagatgaaattcaacttgattgattctgtttttaacttttctcctccttttctgtgaccttcttgaagcacttttccattgcattaatgaacttttttatagtctttcaaatatgcaccatggtctctcaagcaaacacacttactctattgttgagactgacaatgattcatagaattctcttccaagttgcattggggtaaaatgtgtgtttttgtttatttggtttatagaaagtcacaggagtcccagaggagtgcggaaagacagacgtctgttgcaacaacagcctggcaataaagagcacaggctaaaggatacgctcattgggaaactttgggaaaacttaggaaagagacaagaaacagtaagagcctgtgagagagtcaggtaaattgatcttgtgtagctttttgaaggaataaagtggggtaatgtttgcaatgagtagaatggcattttggagacattgaaggaaggccagtatggctgggtcacaatcaacgagggggatagtcacctgaagctaagtgggtctgaagcaaatcacccagtgttttgttcatcatcctaaaaacaatggaaagccatggtttgtatattggcccatctcctgtacttagtaggacacctaacgaagtttgcttcccaaatgaccggcgggtcactgcaggcttgttaactgattgactctctgattggttctccttgtgaagtctttgttgtctgaagttgtttagcttactaaaatgctgtatttgatagataccccaaaatgtaacacctgtccttattgtattcatttttttctttatgtatccattcaatatataattattgtgaaacgttgttacacaatactcaagacagacatagtccttgccttcatgaaactcacttctaatgggagaaacagatgaatatatgtaagcaggcacataaaataactattaggttggtgcaaaagtaactgcggtttttgccatgactgttattgacaaaaaacgcaattacttttgcaccaacctaatataaattatgacttaaaatgtcatgaagaaaatacgtaggagctctgaaggagaataacttgacttttcacatttgtgaaagaagctgatatttaacgagaccagaaggaggagagagacagccccaagaagatgggaaaagaccctgctaagcagaatacagcacctgcaaaggcgatgaggaagaaaacaagcttgggatgtgtagggacatcagtgcaactggtgcacagtaaacaagaaatgacttgcaggaaatgaaggtggaggaataggcagtcctggtgagaagttcaatgtttatggaacaatttgtagtttagccagcctgcttgtccatgatcaggcaaacaagtaaaacattctctacagatgggaaccacaatcgaaccagaagaaccagatctgctaggttaaatgtttaatcaaacatggtttagagtcctcattctctacgatcttccaaagccatcctgagcatatgtgacagcttaaaaaaaaaaaggagaaaattgagtctagaatcaattctgcaaatattaaccaatggatagggataggggacagaaatttttggaaacaaaatttctgactttaaagcatgcacagttttgtgtaggagacaaacaaaatgctacacattgagatgatagccgttaaactaagagaagaagaaaatttgatggaaacacagaggcagtaggtgctaactgtctgagggaccacaaagctcactcattcaacagctgctctgggtcctgaaagatgggtatgagttcactggacagaaagagcttctatatagtctgtactctggaagaccaggggagagtgtctgccagcaggttggcttggctggagtgccagtgggttaaagggttggagaatatagggctaaaaaataaacaggagggaaaacataaaggtttttattacacctttagacattttcttttgggcaatgggaagcctggagagcgccggagcagaagttagaagacccagacttttcatgcttacttcatcaataaataaccaagagatcctacacaatagtaccaatagtatttgatatttattgaatcgttcatatgaaggtatttatatgcattttctcattttatcccccaaacagccttaagtgatgtggcaagtaccataataaagatactaatgctcacagagtttaaggaactgcttaaggtcacattcataatacatagattctaagagctaaccaaccattttcacagcacagttataagaatcaaataagataatgcactattacagcctgtaaaatcctactaaagtgccagctgtaagttatctagaaaatggggcagaatgtttaggccagaaaaaaaagagacaagaccttgtggagcatcacagtaatttaataataaagacaaggtcatcagtgccaacatattttcttatttgcttagtggggtttattagagaaatatgaaaataattagacccaaataagtacaactgtacaatgttcatgttataaaaacttggcatttaagttcctaatttttttaaatgtttcattttgatttcatgacaaatcaaggagtttgaaatgttcaattaactctttatcttaagactagtgggccatgaattctgtgatctatctcagagcaactgataataaagatgatgaattaagatggaagaaaatgaaataaaagagcaattatttctcatgacaatttcagttttattataaaatatcctaacttcaaggtagaagaagtaattacttctgtgtaggcaaggattctctgttttctttgatatatacattaaaacaaactaaataatttgttcgtatcaaatatttcaaacagtttgtccactttctacctttatttttaaaaattaagcatggccaagtcttttaaacacaaatcctgaaaatatgtggtttaaagcattttttcaatgcaggcaaaagtatagcagactcctcattactcatatgcattccttgtatttacaggtgatcatagatactcagtacatatggtaaatctgcatgggatgaagatgttctatgaatatacagaagagtatgcctgagtttacagttcctctctgataagattctgaatagctgaattatatattctgtgcaatcctgggaaaacactgactttgtattttgtttatgcttgggaataacaaataagaaatatcctagagcaattcatttagggaaggcacttcaagcctgaaagaactcaatgatgcaagcaaaggattgaaaaaaaagttaccctctgctattgggacaactgataaaatgtctcaaatgtttttttgttttgttttgttctgtttttttttttgttttgttttgttttttttgagatggagtctcactctgtcacccaggctggagtgcagtggcacaatcttggctcaccgcaacctccgcctctcgggttcaagccattctcctgcctcagcctcctgagtagctaggactacaggcatccgctaccacgcctggctaatttttgtattttttttagtagaggtggggttttgccatgttggccaggctggtctcgaactcctgacctcaggtgatcgaatcacctcggcctcccaaagtgctgagattacaggcgtgagccaccgcgctcagcctcaaatgtcttaaggttggcaactgctgagatgtactttcgaagcatttttcttcataacctgtaacctcatgtatattttaataagaaatctgagattcatgtttccaattcatttacacttaactcattaaaatttagtttagtaataactatcccaggccttttaaaatcatttgtgtcttttatctttgaagcagaaaattcacattttatcgctaatagatgaaactttgcccagaaaataggaatttgattctcaactttgtactcaggaagttcaactttatttgaacatcaggaaatctaactcttaaattcttctgattctaaacaaaacacctctcaacacttcttttctgtggtaaaatgtacagcaaaatgaaaaggtatatttgtttttgtagatttcttttgttcgttttcaatgcatgcattctaatcagcagtatgcaaaacagcttgcacagaaattaagattttcatctttcatcactaactaagaatgagtttaaactaaattgattggtgccatcaatgggatcataatggaaaaaatctcttggtgagtttatgtggacaaagttggccctacgcaaagcaagcctcaagaagcagctgcatgggtcttgcatgcaggaggcaaagaaccttgctagaagtccattccttctgtcatctcttaatatatcctcttcaggccaaggacttgtttttgtttcttttttgtttgtttgtttgtttgtttgtttttgactgttctttctttctctctctctctctctctctttctttctttcctttctttcctttcttctttctttcttttcctttctcttctttttgttctaaagatgaaaagttgtttatcctggctaggaatatcaaattcacttaaaacttctaggtattcttttacctcctctcttctccctcatacttcattttgcttttaaccatgtttaaatgaggaaatgcttgcaaaaagatgctgcaaacggtacaatagagctctgtcattctctttgaatgtcatcccttttaatggaggcagtagaaagagtagatagaacaaaggcctctggaggttgagtacctgcatttaaattctacttctgacaaaattctgtgacctatggcaaattatctaacttttctgtatctcagttcttgccaaaagtattattgtagtctgtatttccaagagtttttggaagcttcatatatgttattaaatataaatcatttagaataatataaacgtatccattagaaagagctcaataagtttttaaatattattactgagtacaatacaaaattaattggttatttctcatccactgtcaattattaagctttggttgtagccttgcacgagaggactatcggttctgattcacctttttccaaacttataaaagacattttctgatactctttgctctttttctaagaaatgaaactttgcccgagaaaataggaatgtaatcttaaactttgcattttaggaagctcaaatttatttgacagtcaggaacctaacactcaaatttttataattctgcagttcagtcttttggggtttggttattcttaagttagtttcagtctttgatagtcatctctttgttccatgctggtgcatataaatacatgtatgtattaggcattttaaatataagttcatgcaagaatcacgtttatactaacattcatttatgtattttcaccagaataatttgtaattttgcaatgtcctttcagagtctctgctaacatttactcactaaaccaatatttattgaacatatgctatctgccacacactatggcagccactggggatacagtagtggacagcataaaatccctgcattcacagaacttacatttgtgtagaataggcttacgttttatgtactaaatatagaaattgggttgaaataaaagtagtgcaatgtagatttctatagtcaatcttacattagtcatatggatcttcttttctctcaatatttttaccttgaaacagagaattttagttatctgatcatgcttagcaggtctttcttgggttcccaaaaatgctaagacaattatattttcccaaagatcttgtcacttcaaggtcatacaccagttgaaaaaactgctagcttctatcattttctttgtcttctttaagattatatagtaggcaaagtgagcgtttgtcaactgtctgctgttagcatctggaaagttctagatgtactaagaaatttacgtgtatggctttatcccctatttaaggactgaactgaaaaatatccttcgttagctttagaaagtcttgtctaccagttgacatggtttatgcattgggaaaagaaatgagagtttctacttcaatagattctttctacagaaagttaggtcacatttttacatagcctttatattatgtactaaatatggaaattatactgaaactaaagtaaggaatgtaaaacggtaacatatttgtttttgttgttggcaacctttaataattacagtttatgaaagatttttagaaataattctttaattataacattaataattttagttaactgtagcttaagcaaactttcagaaatgcagactttgaaaactcctaatttagtatcaaagatttttttttagctgaaggtaagtttgttttgaatgtgacaatctagtaacaaaaatttgtcactgtcttaattttggaatcagaatttttcacatatttatctccatatacaataaatctatacaaaaagtatgcattgaatgagatttcattttcattttcttaatgttaaatagtagataaaactatttcttttaaatttttaatgaaacttatgctctagcctgtcttgctcatttgtttaatagtaattaacccccttaaactgatagaagaaagccaagaaataaggaagttaggaaatgaagaacaaagatcaagtcctaccttgggtctagctgaaataccttctgctttcagttaagcctatttcctgccattcagtcttttaccgataagggtaatgataccagattctccagctagaattcctctatgtacttgaagaaaactaggatagttagtgggcaataaatcttattttactcttaatcccttttagaagaaacaaaggaaaaatatataaataaacaagataaaacaaagctttaattgatgatgacaaagagctatgagttactagctccaaagagtatgaagtctcactgcttaagagagggtattttaaataggcaacaggctcaaatactaagtttaaaaagaaaaaaaaggaaaggaaaaatcattagatgaggaaaatggctctaagggaaattttgacagagaataagtagtagtggtggggagtaactaagtaggacctaagttccaggcaatactccagttacctggactgtcaatgacattcatccttatgttctccagttcttagctatctaaattccacattttagctttccataataaatagctttgcaagacctggattctttcaaagggacatttgataaggtaatggcgtttattacaaaaacacatttacttagactattccagcccaagcaataagtggaaatattctctcccaaacatatgtgtttattggtgagtaagaattgggtccaagaataattatggatgaaagaacatgacgaagttcaatcatttaaagcagaaataaaatcataaatctgagcagtgaagttttctcattgaaaaccaagatgtacattcttctctttgcttcactccatattttcattattatgacagaaatatgaacatattggaatactcttctaaggacacatttgaaagattttactgttggttttttcatgtattgtatttatttggtaagaaaaaatatctttgaaaatagacatggagaaaataaagcatatttcaatattaaaatgtgcaggaaactgaaaaatcaaagtccctttgtctttgtataaagttgctgacaatttcatttatgagatcagggaagtaataaaaataaaaattttctatcaggaaaaagctcaagacctaccttgtgtgtaccatttaaaaaaaaatattagatttgtagcaactagttttgggggtgagggctgagggaggagtcataaaattacatataggagactttttaatatttgatgatgttaaatatgatgccaaaaggatagttcaaagattaaggaaaagaacatgaagccgggcacggtggctcacacctgtaatcccagcactttgggaggccgaggcggtcggatcatgaggtcaggagattcagaccatcctggctaacacagtgaaaccctgtctctagtaaaaatacaaaaaattagccgggcgtggtggcaggtgcctgcagtcccagcaacttgggaggctgaggcaggagaatggcaagaaccctggaagtggagcttgcagtgagccaagatcgtgtcactgcactccagcctgggtgacagagcaagactccatctaaaaaaaaaaaaagaaagaaagaaagaatatgatagaatatgatagaggcagaatcataataggttagttttgataatattggggctggtatcatattgaaaagatatcaacataggtggcatggatggggtcaatgggctgtgatttggtgataatagtaatagaggggttggggatagggaggaagacaaaagatttatcccaaaccagctgggtgtggtggctcatgcctgtaatcccagcactttgggaggctgaggtgggtggatgacctgaggtcagggcttcgagaccagcctggttgacatggtgaaaccctgtctctactaaaaatacaaaaattagccaggcatggtggcacgcacctgtagtcccagctactcaggaggctgaggcaagataatcacttgaaccagggaggcggaggttacagtgagcctagattgcgccattgcactccagcctgggcaacagagtgagacttggtctcaaaaaaatgataatcatcatcatccaaaactttcacctatactctaccaagctctattcgtggatgaagataacatcaacctaatgatttatttatttggttttaaaatttgaaagttatttcaagagttaaaagatggtaattcatgtactatgctcattcatgtacactactacttcactaattcaggtactacattttctaataagtttctatgtgtcacagtcagctgtgctagatgtttgggatgaaatggcaaatgctagctgtcattcattttcctcatgtacaacatagagatgagtttctctccctgctatctcacagagtggatctggagttcaagtaagatagtacaacatgtgcagaaacacgtaatatgttttaataatggtagtaacgtagtgttgggaaaggaaaatattagatttgaacaattttttccttgctaatatgaaatcatgttttgtaacagaataagacagaaagtatatcagaacaattgaaggtggtagtgattattacagtaagagagaagcagcactaaaactgtgagaggagaaacactgaaataggaatttctcttacaattttgtttgttgtcaactcctttcctgccagagcctataacattcttgagtgatatcatttgccattgggttttatcttagtgtttcccaaacttcagacagtcatgtatcaacttcacagttttgccatatccatttataactcttattaatatgtaacaattttttctttaaatctactatttgttaaatacagaatattgtgaatgcattctaaaatgcaagtttatatcattcatttaaagaggaaatcagcatcatttgctgtaacagaagttagatatagccaggtgccatggtggctcatgcctctaatcccagcactttgggagagcaaggtgggcggatcacttgaggtccggagttcaagaccagcctggccaacatggtgaaaccccgtctttactaaaaatagaaaaattagccgggcgtggtggtgggcacctgtaatcccaactactcgggaggctgaggcaggagaatcgcttgaacccaggaggtggaggctgcagtgagccgagacagcaccactgcactccagcctaggcaagaagagcaaaactcagtttcaaaaaaaaaaaaaaaaaaaaaaaaggaagtagataaaaaactcataaaattaaaacaaactaacattatttaattttaggtatgtgccattgcttaaccaaggctctgagactatggataagggttttttgttgttgttattgttgttgttttttgttgtttgtttgttttgccaagaagcatcattggtaagtgatgcattacatcactgaagaagtattacagaaatgagagcaccaaattgagaatttctctgtggggctatcagaaggctggaaaaatatttaaaatgtacaaaaggattaactttcttactctatgatatgatactatttaatggtatctcctatactagctaaaatatcttgcaatgattaatattatgtaatgcaaaactctggtatagctggtctgaactgtgttacctttggtttaactacacctctttatttttcttatctcatttcaacaaaatgatcaattaacttactacataattgcgaagtattttataagaagtaattgctgtatatgctgagttcccaaactattgttcattttactaaggatatcaagatactaatttagaaagtagaatatctgggacttaagagactgaaaaatgtattcagaaccaagcttagcacattttcactcttgatgttgggggaggacgcaaacctctaaatatgctagcaatgtcttacacaagaacgcagggtaaattcgtgggcagaacaaaatgatctctagggacttgctcttaagtttcctgaccataagatcatactcctttctcatagataagaaaccttaagccccaaaccaatgaaacatagcttagagaatggccccataggacttacctcctgttaacatgagggcacatttgcacatacagttgtcattatcagcatctttagtgctgaaatcagcaccgtgtaagatcaggctgctctgttttcctgctgtcccagtgtgaccttttaaatacaacctgaagtcaaaaagaaaaaaaagaaagataagccattcgacagaataacagaacccagaagaccagcttgttgaatgtttgcctttttcatcattttcttctttctttgaactcagcccttccaacaaacctctaggagacccaagctatctgaaccaaaagaacaaaggaaggaaaaagtttatttcattatgcatgctcaaactcatgtggttctctgatactgcaggatccagaaaacataaaaacttgggtttattgtattaatacaggtattaacctctaaacataaacgctttttacaatgtcaattcagcatgtcactcccttaatccattaatatctaatagtgcagatgtactaaacattattaatagcaataaaaggaggaagtttcattgattggggatttcctctgtgccaggcactatgttaaatgatttccagtgtttatttgattaaatttttatattaaatctgtgatccagacattaatatccccaatttgtatactaaggtttagggaagctatgtaagctggaatttagctggtatgagtctaaaactcaagctttgaatcattatgcattccctggacaaatatttgctgagcacaaactacataccagttattgatctaggcacttaagatatataagaaaagaaaacaaaaatctgtgcttttgagggacttgtattctagaggtatccctaaaattaaattcaaaatcccatctgtttaatatggcattcttcgaagaacctctcttactatctagaaacatttcttatataaaacttgcattaacctagatcagtggccctctaatggatgtgcatataacaaatcatctgatcttttgtttaaaaggcctatttactaaccccaggaatgtttgttttcaactagcatctcagatttctctttgcagactgtccaaagagaacattttgacaagtattgtcctagaatccgagaactagtgggcaaatcacaatagttgtcaaatgtagtgacctgtctgatgtctgctcatttcctactgatcgtacaagctgctttcatatccttctgggcaacgtagtgcttagaactaatgtaaacttgctcacgtccttcagtggctccatagggcttagagtagctaaactgaagttgtcgtatcgacagcttgaagctcaaggtgttctctggctaagactctagcccctctctctctaactctacctaacactgcttctccataccagcacaatgttttcatcagaatcatgtagtaatatccccttcaaattcatataggtcaccacctgtatgcctgggtcttatttatgaatcctgtccacccacagtatagttaatgggtgattcacatctctgtatgagtgagacactcctaaaacctaggctggctctgagcaaaacattacattattatgaaatagaataataaagatcaattaatatttggagatatattttaacttgtgttttcatctaggtatatgtatatatcctactgtttgtggtatttgatattatttttagcaaaaaacaatattattggatgtttgtgcaatattttacaaatattctgcagagattttgagccagagcaaagtatacaagtaaacctcagtcagtttttgttggtttcaataattaatggaacttctggttcacagtagtacaaataatcttctaatgttgaattatcacatacaagcttgtattttaaaactctgagaggcagactacaagtaactggtgatgcaaaattgtagaattttttaaagtgccaattcacatttgaggctgcagccagcccacgtggaggtgggtttcaccaggagaaagtaagatgacagatcaccaaagggagttctgggacatgttacctgggtgaattcgccaccttccagagctggtgagaactttcaattcaatcacttctttggaggtcctcagcctcccaaagatagacacacattggcaaaactaacaagagacttttgtcaggcctccatttgcagtccaagtaggaatatggtggggacccagtctcatggtcttcttagagagaatttcacacagaaagccaaattataatcagaaagttacttgtttggtgaagacagaatcagaattgagagaataagtgaatgattccaaaattaagtagctacgtctctcctagcgtgaaatctgctctactgggcctgggagagtttagcccataggcgctcttgaatgagcaatggcaattttaactctgattttttgtttctctgtgatttgtaatggccttcctttttacggtaagtcaatgccattttctccgcagtagctttaagctcactaataaagacagactttccaggatgtaatgattttctatagtgtctttgcagggaattcagcacaaatgtttgattttaaataagagactgctatgtgcttgaatacatagtttatacttttaccctttcacataagatttacaatctaagtctcataatttataattatttatttgtgtaatcaaggcaatacaaatgcatgattataaatttgagaagaaaagcaaaaagaagaaataaaaatcaacccaaatctcatcactgagtataactactcttttcatattaacaatttttagtattttacttgtttctcccctctaaatataaaatattatttatttttaaatatatacgtatctgaacacattcttataaaatttttgaacactataagtaaagcttctgcccacagccccatttcatctccctctttagaggtatccttcaaaaacaacctctctccatgtgaaaatacaaatagaaatagaattatactttacatgtttctgtatgagattattttcaaatacaaatttgtgaccactttttcatatcattacatttttttctctaaaatcatttggaaaatattgtatgaatatatcatcaatagtcacaagactaaggctgccttcaggtatctctctatatgtgtgctggtataggtataggtatataggtataggtattaggattacaatataatccacatttctttcctgacctttccccgtatgaatgttatcaatgctatgttaggctatcagtaaagagacatctttccagatctatttaagacttggaggtcagtttctagtcttggcagttcttctctggattatcaaagaagacttacaactagtctccctgccttgagtttcacttcttcttccccttccccatgaagtccatgcagctcattcaaaaacatgcatctcatcattcctctattctggttaaagttgctcggttgttcctccaaaattcaaagataaagtccaaattttttactgtgatttgcaaggcctttgaagtctagtcctttactgtctactttttcccatgtctcacccaccctaaccctcccatatcttgttattttctgcacgtacacatagtgctccagccttacccactcacttattccctctaagcaacactcttatttctccatacatttgcaagtaccatcccctcttcctagaaggtactctccaggtttgaacagctgctgaactcctatccatcctttaagatttgttccaagtataacctcaaagagcatcaaatcagcatcttcatgatgacacttacttgctgtattttaattgtcttttcacttttctgtttcccataataaactgtgagctccttgaggcatagactatgtcttactcatctttgaatcatcagaatcttgaaatcttgaacagtctctgagatagagaaaggcctcaatgttcattgactagatggatgatgggtttactaactgattaatttttggtaagctcaaggtagcaagcaaaagcaaactcaaatataaataactctaatatcaaaatatacttggtctacatttcagaagtatagcttttacatctcatttagttaggtactcaacatacctacctgggtacccacttcattgcccatccaactcaaataattaaaaaatacacatgtagggttgtgtgtgtgtgtgtgtgtgtgtgtgtgtgtgtgtacatagatacagtctctcacatccttcttatctttccagttttgtttttgttcttattttctcagagactccagaatataaaaacatgagcaaggcattatgcagatagaataaaggaaaaaaaggccatgtcttaattcctattattccttacattttattgaacaatttatttgtattgtatgaatagccaactgaaaacaatttgaaagcaaattcaaaataaaaatatgcttaaggttagtgtttcagctaaaattattttttaaaaaagaaatattctaataaggtgtgaacataattccttaaggtcctgcccagattaagcattaaaacataaagcagaagtagagagaagtctcaagatgtgcaatgtaaacagtgacatatattggttgaaatgatgtacaagtagaagggactgatatattgaggaataatgaatgtttcactgttggatacttagtagcacttgtaatttacatgaagtagtattcatccccccatgtttatatccttagcatgtcacagaggagcggcttatgctcttctaaggaagagacacacagtctcttgcactgggagataaagatgaaatgtcataaaaatcatttcttctaaacaatattttaaaaactttgcacatgaggacaactgtacttctgtggaatcccagaaggactctgggagaaactatgcagtccagagaaggtctcctgcacagttcaggggctcattctttcttagcagctctttacctagctcagagtcccaatttttggcccaaagccaacgaccacagctagttatttgatacaggtaaattaaggaccagtcactcattagtgccaagtatttctgtaattagatttaaaaaaaaaaaacttctttgagttgaggctcaaacagaacatttggatgattctttttaacactggttctggctaatatctagtccttatgtgtaattaactatcatctgtggctttctctatgaagctaataattgttccaaatagactttcagtttatcaaagaaaaatcaatatacaggatggctttgcacctgactaccgtgacagtgaattggaagtgtgaaacattagttagaatacatctcccaaaataacagcatgggaatcctggttatttatttcttgtgttcagccagtgtagacatggcctgtatgaaagacgatatgttagaagataaaaacaaaatgttcctccagaaaaaaacattagggacagacataaggaagctgtgaaaaacaaaacaaaacaaaaaactccagagaatctaatttgatgtgaccaaaaagcagccacgacatagaattatggcatttattctcatccatgtattttctcctaataaagaaaaaaaaatgagtcccttcgacggatgactataaagaatgtcagcatttttattttttcaattagcatatcatgggaaaactgatgtccattgaaattagtcattattctctagtcatctttgataaaagttactccttttcaatcacttttagaaatttcagtaattataaagactaaatcatcacatttcttaatgaatataggacaacagtgagttctattatggaagaacaggcttcaaaatattcctatatatcatccaagagattctagaactttcttttctttaaaatgggcagcccaatctcatgaacccagtttcttactaattttctctacttaagagactcactctcttcacatttttgcatcttcaccatactcaggtggccaagtgtctctttcatgatccaaggcagtgggagttgtttgtatgacaaattgaagtttggcctcaacccttttaaacagtagacagactcgcagatatctgaactttaaggtcgtaggtactgacaagctgagcagatttttattttggctctgagttctctccctgccaccatatggaactagtttatctttctcacaattactaagaaattcaaaatgaccttcatggttctctttcagaggctggtagcaatggctcaatctgacaagagtttcctgatgtggctatgatttctagttgctgcttctgggctgtctctgccatattcaacctctccaatcctaccccctttccactgaaagaactgggcaccattagccaagagggatgtcagagcatgtatgttagcactgactttttcacatcctggagatatattctataactctattgtccatacatgaacagaattctttacttatttgcaatagcctatcaatgaatatgtgagaaaatgctagaaaaatatatgaagcaaagttaatacacttacgaaaaagtgagtgaatatattaaagacattcagttatatgacaataatctataatccagaaaagaaatgtttgaaagaagtttccaaagaaaagaggatgtgagtaggaagactaaaagaattgataatgtaaagtgtgactaatcaagaattaaggctgtgataaagacttatagatatctaaaaacattttaaaaatatacagatcaagcagatacaggtaatttggtacaaaataagtacgaatgaaagaaataaccctctataaagccattaaccaaaactcttccttttttcctcctcctccacacacacgaaatggagaaataaataagccattggcttctgcaaattaaggctgtgtcatgaccacttgtgtctggaaagacagcatgacatcacagagtttgtagtgtacctgtttgggtttgcaatctagctcttattctttctgatcctcagttgcctcatctgtaaaatacctctatgtcctgccaatattttgtgaagattaaatgaggtgatacccggaaagcccttaaaaagactgctgcatgcaaaataaagtaagtacttgactatttgcaaaaaaattaaagtaatcaaacttccttaagcaataaccataaaatatacagtagttcaataggcatgaattacgggaatgactaaggctaaattacacaggtataaacatatgaccttgatagacatatgtaagtgttctgagagtgataaaaacaatgacatagagatacagctcatgaggacaggcatggaggcaacaagccagagaaattaaagatgaaaaggatcaattttctcaaacccatgaggccccatatcctttggaagtttttcttattttctatagaggaagcagagtactaaacatgaaggacaagaaaccaaagagttgctttgctgactgactatgtagttaagatctatgttaatttgactctagatggtctgaataaatatccttcaattaaaatgtttatcttttaataaattaaaatttcagacttttgagaaccctacaattttcttgccatcatataatattttgttgaatgaatccaatatatatttgtttggttttcctttctttactcataattgatactggtaaaaaaaaaaaaaaaaaaaattcctggaaaaatcatccatgccaacctagcctttaattctcatgactacttgctgaaagctttctttttctcattaaaccttccacaattggtgtcatttgttttaacagggaactggataattgggaatcaccagaatttgtgcataataattttaccattatgttaagaaggaagacattatcttatttgtttcagaagctacagatgtcctgaggtagatatgctattcattttggaatatgtgtaatggaagatgtacacaaaagtgtgaaaaaatatgaaaaatgtttgagatagtaatggtcctgggaatctgtgctatgattaaggaagataaatttccaaagctacagaaaacctcaccccaaatgatgaaaaatctttagaaaattgagtttcacttaatctctgattctcatatgattgttttagatattagcttgtataacacctgtataaattgtactctggatttccatgtaagtttttgataatatacatttttaatgtctccccttcacttacaaacattaatatcttgtagaatttagataaaatgagcttatcaaccttccaggtcttcccaagctcttgacattaggaacagtgttagcagtaatttttgtttcaaaactctggtaaaatacagttcttagtgttttgcagtgatagacatgaagcttgcatatgctcaaaactcatgataaatttttcctccaaagaaaatagcaaacccacgtactgttattgttgtgtgcctttcaatagtgctgacagagtgctctctattctgtacatcatatacatatataatatatattatatatgtatgtatatatatgagatctgtgacaatgaaatatttcccaaatttcagaaatacatgctcagtgattatgtttttagttcaaaataagataaatagttattccagtattccttcccttttttaagaatacataaaaaaaaaaaaaactgagtgccaaaatgaatcacgtgacaccaagacccctgtttaaaacacaaacagtcccttaaacatatttggatttccttggcatcatgtgtgactgatagagtcagcttccagtgagtgactctctggtctgaccctcttgtggtgcctaaaagaccaggccaatggccatctcagagagtttatgggttttgctttgttaccaaaaattaagtcaggaccttgtaaaacttgtgattgaaattggtgatttttcagtctaaacaaattctcgggaggtagatttgttctcattttttatttgtgtttaaagagcaataagaaactttctttccagcattcccttggggtagatagagagaggagagggtaagcaaaatgttgaaaaccattgagatgcattgtctgaggtttcttgcaaagagaaaatactttcccttgttgtacttggacattgtattgctataaggtctgcaaataagcctccagcatgcattagcagattcttctgatgaccaaagtcatcagtgtgcttatttgtctccacaatcagtataagctagagtcgaaaatctttgtcatggattctagccctctgttatatgtagcacagtaaagccctgcatacaagatgtcctctaaatacttgctgtcctctaaataaggcagactgtctctcatctctgcatgtgtgtccacattgctcctctggctgggatctcaagtccttcctcctgccattaactaccatacttgcctcatgagcgcttactcatttcacacatctctaaggatttcctctatgaagcctttcccagtcccatttaatctcctccaatgaaccctatccattcccaactccagtagaattgaccactatttttttttaagtaaccaatgatagcctaattccaagggttctttcccagggactgtgagtgtaaaggtgaattacacataaatttatacaaaattttgtgtttcttcatcattctagggaaaaagtccttggcttcatcattaaaaaaaaaaaaaaagatctatggttccttgatcaaaaaacaaaacaaaagaaaaatcaaacagacatgctaaatcacttcagctaaaacttttgagtcaactattccatgttttgtttccttctcctaaactattagccccacaagagaaggtatggtgtgtctgtttggtgtaaccaaagtgttatttctgcatcagcatcactttggtgcacttgataggactgagagctctaggtcttaacccaggataagaatctctttaggtgcgactcagaaatctgtactttaaacaggcaccctagttacctatatgcacattcaagaaataaaacaactggcatagtgccaggaaaataatagtaacacggtaagtgtatggtggttggctggctggataaagcaatgaaggcagactctgatttcaaaagaactataataacttttaagagagtaattttagtaaagttatgtaggtaaaagcaaaactgtagccagttaagagaaatgaacaatgtatgctgtgggacaattttattaatttttttatttacttgccaacaagcaatatagaaattcttgcatatcatttgcagttaaagataaaagagataaagataaaagaagctagagtttaatagttctagaaaataaatcttatttaagcaacaacaatccagggaacttaaggacatgatactttattagaaatcttagtggcaactgtcattttataccataaacctttggaggcaggatttttgacttgttgctctttgaatttctggtatctagatcaagaattgccatgtattagtcagctgtgtggattcgcacaaaaaaatcacctgtgttgaatgcacaaaaaaaccttgtcaatatgtcttttatatacctattaagaaatgcttttttttcgagacatgtgccaagcattgtgaagaggttcctgtcctcctagagattacagtctaataatagggaacagcaattacaacccagtgtgatgtgtactctgataaagacatgcccagagcacagtgggaggacatggaaggggctcctaacccaatcaaggacgaagagctctatggactgagctaagacttaaaggatcaagaaaatccaattaggcaaagtgaataaaatcttgaaaaatagaggttgagttctgtggggttttgtttcatccacagtagcttgcatattgttgttgctcatatttaccaaacagagtaatcaaaatattgagtgtgaaaaaattgatgtgagaaaaggccgtatcagagcaatattgcccccagaggccatggctgcttacctgtcccaagtctgccacaagcagcggttctcctttctcttagcatcatgattgctcattattacccccttacgctctaagcttaagcaacagttaaccacttgtagtttcctagcaagacgtgctgagtctcacttctgagctaatccctcttctacccccatctctgaactattccccaactaataccaatttgccacatttatgtcactttaggccactatttggaagctttctcaaccttccaaaactggttagccctctttagtcacagcacatttgtgattgtaagtgaactgactgtgttcgtggcattgtaattgcctgtttggctgtctgcaaccatccgaccccactccatatccatcacatatgggtatgcacctgcatgaacacacgtatacatgactgtactgaaatctctgtggacattttatcctaggatagcacatgatggatgcataacaaatatttcatggagccatcatctttttgatagtgaacagcagtaggggaacctagagcagtggatcacaggacatcaccttagataatttattggaggcagtgcttgctagctggttctggcaacttttgccaacctgtaagtttctaggacagcagtggtctgagtcttagcattacccattctgtgacaggaatcctctgggaatccttagacctaacagcatgcaggcatttgttttcatcagcttgaaaaatatccaagactctagagactgacattcaactgcatttttaagtgaagagattttcccaacacttaaaagacctaaagaaggtgcaaagtgactgtaagaatgtgctcatccgtgcctctgaagacccaggaagccttttttgtcttcagtatttcatctcagtcaaggggattaaaatataaattttgatgattaaaacaacttctctgttttaggaagtaaccacaacaaaaatcacagtctaaataaaagtaatgcaccttccaagttggagaaattatttgaaaacacaaataagactctttaaaaccttgagtttgaaaacctatgttaggaattgagggaagtagaaactgccaggagatttcctacatattttttcataccttgatcagtccagaactgctgtaaaaaaataactttcctcttagtatttcaacatatttgctactggttccatccaggactatgtagcccagaggatcagagaaataagaaacatttcactgaaagaaaaaaaaaatgaaacaagttttgcaatatctacaaaaatgcagggcttaaatttacatgggaggctcgagagaattcttttcaatccacatgaatttgttttgtccttgaaatacatacacggcatgggagtactttaatgatttaaaaaaaaaaaatggattggggaactggaaagaacttcagccttacctcctcattttacttctgaggatctgagacttagaaaagtgaagcaaattgtccaaggtcattcagaaaagtaactgcaaatccaagtctagagttcatgtctctggattcccgatacagtgttttacaaattacatcaaactacttcccaatgaagatcttggccaaaaacaaacttgcgcaaaaagatatttaatgaccaaattattttcaggttgttttcttcacaattttggtttaaaattctgttcatctcttcatgtggaatcttttccagaacaaggcttatgatagacatcaacagtcagttctaatctaatgatgtcatttatcctcaataaataatataaagtcaataaaatataaatatccacaaaatgtgcattataaattatgtagtaagattataatgacaagatgtgcattaaaaaatgttaaacattatcattcggacttaactaatactaattttctattgcttaaaagagaggctcatgataccatctgtgacagaggatttactaattaagttaatagcataaaagacaacaaaataatgaactgtaaggaacaaactgttcccaagatctgaaaataattacctgcaaaatgactttataatggaatatgttcactaaaattgtgtccttttaatattaaggcagaaaaatttttatatagttttcttttaacatttaaaaatagtacagtgaaatttatttccaactggtaaattctacttttttatttataataatataacacaatggtttttaaactgtgctgtactaatgtttgagataatagcaagaggaaatattatactaccttcccacaaccatttcaaaatagatcagctttacgtgtttcatacattatgatcctttgtaagaattttggagagaataggtattccattaaaaaaccaaaaacaaaaccttaacaagtgattaagcttagcccaatcaataatggaacaaattaatcttttgtgcctttggatgtgatagaatgggaaatagacaatatcatttatttagtattcttctcaagaaagctttaatctgaatctaatcagaaagaaatagtcagataagcccagaaagagctgttctgggaaaagctgacccaaagtcttgaaaaatgtaattgatagatgagtggtagactgtttcaggtaaaaggcgactcaagagacatgactgcaaatgcaatgagtgaagctggatgggatcctgaatccaagtaaataaacaactatcaaccagccaaggacattgttggagacaatagtggtgatttcgatatagaatatataattaaaaattgtttattgactcaataatatatttcttgggcatgataaaaatttaatttaaaaagtctgtttgctcttttcttttcttttttttttttttaaagacagggtcatgttttgtcagccaggcttgaatgcagcagtgcaatcacagctcactgcaacctcaacctcctgggctcaagcaatccttctgcctcagcctcctaagtagctgggacaatgggtgtgcaacaccacgccaagtgaatgtttgtttttttaatttttaatagagacaaagttctcgctatgttgcccaggctgatgtcaaactcctgacctcaagcagtcctcccactttggcctccctaagtggtggaattacaggtgtgaaccactgtacccagtctctaaacagctttcgtattagcatgatatttaagtttaccaaatacaaggtatatatgtacactctttttgattcgaggatattattcccactgaaagataagaaaactgaggcataaaagtaatatcaacttggttaatctgggtactccatttccctgaatccccttcattgtaaggttctaagctggggttggctaaaagagaattttgtgtgagatttggaaggcgaaagtgaagcagtggcctgactctgagaacgtcatcagatatggtgaagtccaggggcagagatgcctgacagtttctacattgtgtatttcttcacttagcacccagcttgtcttcctgatgctggcaacagctccagacccaccacaagatgcttgactgcacaacctcatttaatggaactacagcaaggcaacaaatttctgtagatcttcccttttgtggttccactttggtggctacacgtgtttggtttcttagattttcacaagctctggcttgtctgccatgccaaatttcaagcatatgttttaaccttatttccgtaagactcatcatggctctgctcccctgactgaacactgacaaatacaaccatgccagtttcccaggtggtagagccagatttcttctcagcctccacatcctgattccgactccagagctccttccagtggacatagcatctcctcaaccctacaataaatctgctattattaaaatatttttaaagcatttattgttgcagtggtggttgtgtatttgtttttttaaactgataataaactctcaagtgtttattagagagatcaaatttaattttttatcaaagaattgaaaggtaataaaaatagtgatgcacaggtaaaggtagttctattgtagaaaatttttgagctacaaggtgctttacaaatactttaacttgtaagaatagaaaattgagaactggaaagataggtaatgtgtccaaaggcattcaaattattaaagagagaagtagggttagaataaacatatactatatcttagagtatgtgttttgggtttatttaattctagaaattaactgatgaacttctttatttgaggatgcccatatggtgggtagttataagaccaaatttcaaatcggactcctactcatcgttatcagtgcctgtgaccttgtgcaaagtactatgcctcagttttctcttgtgaaaacaagacatctggtgtatagtatgtgtgcctcaaatatagctagcttagtcagtaatttggctaaattagttacatatcttgaatttttccaaaatgggttctacactttaaaagcttagaacacacacacatacacacacacgtgtacacacacacacacactcaaaggaagggggggggagagagagagcacaagttaaagatagttaacagtcactcattaatgacttataacaggatttggatcctggatagttatccagagtgctacgggtcaatgggagcacagagtatccaaattggcctaagaatgagggtgatgcatttctctgggaaatcagtgtagggaggttgagaagggagaggtcccaggatccgtggcagagtgaagcatgcagaactcagcaaagggagattcagggctcacatgctgtcatggtgaagacttcaactaatctgaagtggaattttggattctgaggggctcttcagaattgccccaaattggggcaagagggtcttcatattcttatattgaccagtcattagatacaatgtatcttgcaagaagtaatcttgggtgatgttactttctttctttttttatttttttttttgagatggcgtttcactcttgtcgccctgactggagtgtaatggcgcaatctcggctcactacaacctccacctccggggttcaagtgattctcttgtctcagcgtcccgagcagctgggattataggcatgtgctaccacgcccggctaatttttctttaactacaaacagtgcctggaaaggggacttcagctgcaacctgtcagtcaacatttcccggaagtggaagaaagaagcgctttagtattgaaggaggcaatgggttgacacgttacatctaccacagtaggtatcagggaagacttggaataagagagaatcttaaagatttaagatgtatccatgtgacaaagttaagtttatgtgttgagtgagtaagaatatagcataaacaaaggcatggaggatttagggcaatcgcaaatagttaccagaacataaccgttaatgagaagggtatccaggtaggtaaagttagggagagtgtatggcagcaataggtgcataattaggtagtggccaggtcacgaagagtcttagtggtagacttttacctgcagatatttgaacactgttgaaatatatgaaggagggaaagaccaagttgtctgttagaaaaatcatctcaacaacagcatggaagatatatatgagagtatgaagactaaagaggcaggaaggttctataattgcctgggtgttagatgatgaggatctggataatactacctctctagaggaagtattaaataatttcacattgatacatgttagttcatatgctatgcttatcatgacactcttacattattattttttcttatttatattctcttgggttctacagattttattttctatctgagaaaattatttggagtttccttagaggataaaagaaaaatatgtgtaatacatgcacatttataagctcatctatccattcacaacactttcttttaattaatatgtcaagagcatgataaatgtttttttaaaaaacaacaccacagttaggtttaaacattaggaccacacctgttacaagaattttcaaacaaaatttccatgatagaatatgttttagaaaataaaacctcaaacaattctgaatttaatttaatttaatttaatttttgagaaaagttatagaaaacaaaaaatataaaacaaaaacctagtatgaatttcatagttttatatttcagtcggaatttagttgaatttgaccaagtcaactgaccaaaacctcagttttcttattttttaaatgtgtctaggcccagagcagtggctcactcctgtaatcccagcactttgggaggctgaggcgtgcggatcacgagatcaggagatcgagtccatcctggctaacacggtgaaactccgtctctactaaaaatacaaaaaattagccaggcatggtggcaggcacctgtagtcccagctactagagaggctgaggcgggagaattgcttgaaccggtgaggcggaggttgcagtgagccgagatcgcgccattgcactccagcctgggcgataagagtgagactccgtctcaaaaaaacaatgtgtctaataatacctacctccaaaagaggtttatatgcttgtagtgttaaaaatcatttcataggttatggaatactgtgcaaatcttagtattaatacttgaaacaattgatcacaaagacacacgccaattcagagggacgagacatgaatggacaaaaagcacatgaggcagtgatggacaatgtgagttctaactgcaggccacgggaggcattaatgggcctagagaagcagtactgggcatacgtgatgatacaggcagggagaaaagttgcaagggcttagcttctgttttcaggcttctgttccatttttctttgaaaaagcgaataacaccatcttatagtgtgtttactttaatgaatctttcaccagagtaagcattatgttttaatgagttctcatttcccatttcatgtcaacgtgaatcgtatacttgaattgcatgagaaaatgatgactgcacatctactttctgttaggtccctgcaggaaagaggccagaaccactaacttcatgtcagcagcatgacagaacagaaaccacattgaatgaggcaggagttagacatcccttatttaagtctttctccctttttgggcaaaattatatatatgaggctcatatgtatatatatgtgtgtatgtgtgtgtgtgtgtgtgcgtgtgtacacatgcatatgcatgtgtgtgaggcttgaagagttcatatatattatatatcatatattatattatatatatattacatatatgaaccatatatatatatatatatatatatatatatatatatatatatgagcctcagctttccttcccataaaaccagaggtttgaaattaaattgttacatttcttctggctttataattttgattctcaaggttcacagttctatcaagaaagaaaaatggggatatcagagtgtatgcatcaccctagcagggaagacttactttttgatcatagatccctactgtgtggtgagaatacaaaatcacacagatgtcaaagaaatgagaaatgctcaaaagggcagtggggcactctaagaggaggtgagtactccttcctcatgcagatggcagaatggcatacacatcatacactccgaagtgcaccacagatgccaacaatcctcctaaccctgccccaacactctgtcccgcaacaccctccaagcctgacacacatgcatatgcatgtgtatgcacacacacacacacacatgcagccacctatgaaaaactgagagacattttggaaaggaaccaaagcaaattcttcaggagcctaggaaaagactagactaattatttgctagtcctattgtcaggctgtctgacattagccaagtttcatatagtttcaagtttcaggtcaaaacatttacataagagtatccctgatgtttaacagtggttttcttgttataaaactttcaaaatattgacctccttggaaacatttcttcttacactccattgcattttataaatgtctcttctttggtttcttgagctgccattaagtacaccctcgcttcccctccacccccaccatgagactatcaactcttttagatctatttctcattctctgttgtggtgacatcattactatttgtcgagaaaatgattattatgtctccaaggatccaaccccatacataatccattaaaatgaaatgagttgtgcctatgaaaatatgcagaattcaaacttttaaaaaattaaaaaaaaaaggtttgtcttgaaaagacaaataagcagcagaaacagttgaactatgagataaccacacaggttgaaacaaaacacacgcaagggttgggttgctattgttgcaattacttgaagcaatgtgcccaccctttaattcatacaatcatattttcaagacagaggtagagcagtcacaatattgagagttaaaaatcattacaactctaatttactaagaatgaaactgaggcacacacaattaaagacctgctaggcatcaagaattgcattaatgagtagcagtagaagagtaactaaaatatcttccctgttcccaaggaatgccagccagtttttagtgacctagttagtaacaaagcttgactttgacgtctgtaagaccagcgcccagtagaattccaggaacacagaagtaacacaataagtgttcgtgcaatgaatccaccacatcacattatttccttagccatatttttgtgtgtttatttttccctagtagacgagcttctcattgaaaaaggataattggaaacatgtatcattaagtgtatagtttatctatttttacatctgcaatcatgtattatgtatattgatgccattattacaatttatttttgctttttagatttaccaagaaaaccctctaaatcatgcctcatcttctcttttatgtaaatcattcaaacataaaaaaattttacttttgtcatcttcaagatcatttgaaaaatgctaattcaagaaaggtcatcaaaaaaagtagaaccagaaaatctttttttagaataaagagattatttaagccaatgagtttgagtatgaaacttatcagttttatatatatgaattcactgcaactgcatgataaccacagaacaacagtatgcttgacttcattcaccattccctaaaatttaagccaatatcaaagatagtcaacctacgaaaactgaaatttaaatctttgaaaaagtctttacaggcttttttgtacctctttgtaataggtctagacaaaaaaaaaagaattttcattttgaaggatgattttcatttctttttttcatattttcccactacaattattaagtggctaggtaaaaggtagtcgaacactacactgtagcatgacttacctatagttttgcttttcatttcctatgtggaatctgtcatactgtgaataggctcggttcccttcccagtccattaactcaattcttagcatgtactgcctctgactggtaatggcaaaaataaactcattccccagccaatattcaccggagggatttccaaaaccctgggaaacaatatagagatgcagttgttactttagagaggaattcttttcatgttcagcatttaactattttctaaataataattaaaaattattaaaaagtaaaggtttttgttttttacattttacactttttctccagtgattgacatttcaataattctgtgtctcttcatcaaagcttctgtctaattcttacttagtacaataaaacctctgttattcaaatctgtgtggatgagacattttgtataaaataaatctagttaataggtttaactggaaaacaattctcaattcaaggtttgcttttgaaaatgtttctaaattactagttaacaaaatattttgaatagagtttaaagatttttcaatgaacactatgagagtgatattagacaagttatttaacaatattatttttactattattattcacaaatgcaattatgtttcaacaataacttcatatttaggttggtgcaaaagtaattgcagtttttgccattactttcaatggtaaaaaccataattacttttgcaccaaactaatagattactagaaccatgacttttggagctttaactttcttatttttaaatattaataagcaaccctgtaaatccatgactgtaattatttacaaagctgcactggcattggaattttgaggcagaaggctgatttgtaagtgctcctgagtgaacctagctgactgcttggcttctgaatgtcaacatgactttattgttctctttgggggaagtcaaggttgttaagtattcaaaatagtttctttgtagggagaaaaaagtggtcccaaaagaaagccagcgcttaatgttggagatgttagtgataggaaaagaaagaacccctagaaacttgctggcattctagatttggagtattcacaattgcctcagaaaatactcattggcagtgcttgaagttcaatgtaattcttgatctacatatttgtttcactggccatgttgtgagctccctgatgatagaaactgtgttgtatttgtgaatttccaaaaaccagtgaagagctgacatgcactgagcattccaatagggttgttttgaaattcaaagaaaaaggtagaaaggaaaggatagaggaaagaagcaagaaagggagagagaaatggaggtaaggaggaaggaaaacaaaatattacagcattttacaataacacatggaaaagtaaccttaaagcacaattcttgttgtagacagtacagttgagtcttggtgaaatgtttcttaaagtgcccaactgggtcacttgcgcactacctcctctgccaactgagttacttaccaaagttcaaaggtgtttggtaccaaacccatttatgccagttcagttattgcaatatttataaaatgttatgcaaataagttaaatattagtgggaaaagagagttttaattttttataaatatccggatttgctcaataaaagcaaattagtaaaactttttttaaaattacgaattgttggaactctaaaagactgggaaaaattttaaaaatttaaagaatttttaacatattgccttgcatgtgtcttcatgtactgttctatttttaaaaaactgaaactagagattggatgcattctactatgggaaagttttaggaaagaactgatgacacagaattccaggctttggccctcgttttatttttttttattaatgggtatgtgatgtatactgttatatttaaagttaaaattaacatatgtgtacacttttaaagttattccccaatttaactaagttttttgataggctgaatatgcttggtccagattgcattgagtatatactcttctgaagaccatccacccatagctcacagtaaagctataagaccactgaagttagtactccattggctctttacttctctgttcctaagatgctcaagtcacactttgtaaaagtttcacagtggcaggaaatattagagcaatttctggtgtgctaagaattttacacatttttatggcagccaatgctacctactaaggagaagagcaaagcttaccttctccaaagcataaacaaaacagaaagttacaggaggctgaaagtcaaagaattagcactttatcaattacaacagcccctgggaagaaaaagaagaccactgggattttccttgcatttttttgcagctcagacatgtcaaaactctccctcttgccacttgatgattcccttttctgtgcagtcattgaaaagggattcaacacttatactcaatgtgaataaagaggctgggaatgatgaagtgttaagttttgggtcacatatttccatgctgttgaaagcgctgtgtggataaaactctccaacttccccagggaaacacgcagtgatcctgggtgagccttagaaatggacaagcattagcctcattcctaggacagcctccatccctgtctccacatgcaggcctgtacttccctctaaatggaaataaatatcccttcctaaacagtttgcatttttgtctttcaggaagaagtgactaaaaagaacgcagtataatttgcatttagaaactaacatttatttcgagctccttcccaaaaaactgtccaagcatgctctagtatgagagcaaaaggtttgagtacaatgaatcaaaatggctgcaatatagggaggaaaccttctaatagccaagtgcagtgatccagaaacaactgtttcattataaagatgaaaaatacgtgaaagaaggggaattgtgttcccacattagtaaactgtcttttggatagtttaccaggcatgaccacagatctgatatgtaggacaaaggcttggcttggatgaaataacctctaccccttatctctggctccagattaaagccttgaactgccacatatttgctgtagaaatatcgactttgtttctgagcctcagtttctctgtctgcaaaacagggattacagacatcattttcatatacaaggttttgagaataaaattgataatataaccgaagcacttaactgagcactgatagacagaaaacacttaaaaatctagctgttgttatagttaaaatatatgtcataatacacagtaattttctggttagttgcttctcttccatgagactgtgagtcatatgtggggaaacaagttcctttctactttgtataagaaaaggaaaaagaataatcttgggtcttgtattagcccaaaaattaataaagggatactgaaataattatttaaaaggctctcagaggactaatgtaatattttactaaattgagagttggtttatacaaatgagtattgtcattttaatccaaaaagttaattattaaataagaaattacaaccaactgatttcaattgggactaaactatagtactaatgaaagcacagactactttcttattcttacctttgcttccaagtacttaagtatctgtttccttcgactctcccttagtgctatctctttcaagccctctctttccatatctcacgagttttaggagctacacaagaggtaatttttaaggtattataccatgctaataagttaatatttgtaataattgctttcaaccaggaatgcatatcagaaacagctgtgggggttttaaaaaaatacagatggttaggtcccccgtgaagattctgattcagtatgtctggggtggactcagagggagagctatacatgtaaaaggttgcacatgtaagtctgctatgaactgaaggtagagatccatataaatatgatgtggaatagatattccaagtgcaaactaaaaagaacatattaattaaatcaaattatttgagtggtatacagggaaaatgcaggagtaaaatctcatcttcatactgaggtccctatagggaggcaaattttgattacatgtctgggactgtccttcaaaaattcatattcatgcctaaaagacagagtcaaccaatgcatatgctccaaaataggcttacacattatggcacataacagtttaccacaggtctttattttacccccaatagcctgtaacttccataaaaataaaaatgaaagtatatatgaaattctgtgctgatattgaaaaagcagcaacgaatgagtaaacaattacaatacaatttcctctttttcatgaataaaatctaaggatactatgccatgtacttttgtaaaaatgatgtttaatgatgtcaaacacaatcacctgaaaggttttgattcagtaactcagatacattgttaattgattttatttcttctctaacgctctaataaaaggataaaaagacactgaaatttaatctgaactaatgctgacttaaaattggccttaaaaggcacatattactcaaaaacacatgcaaaggaaagatcaacatttgttagtttttgccaaaacctgcagaaatgttcaattttggtttgtgcttttccaagttaataaaataattgtctctgatactttatttgttttgtctgataatgctctcaggaagcgttgactttttatagatgaagtaaaattgaaaccagacacagcccatgtattccatgggttgcatcttttttcacacaaattatttaaaaaataaaaaacagataagacagcgctgtggctttcagggcactttcatatgcagttaaattgtgcatctcctctaaatgctgagacgtgcaactcaagaaagactgaaacaaattttgtatttcaaaatttttaatttcatatgcatttttctctttttaatgtgaagatgttaaaatatagctgaaaatgtgctctcaacttctttccagaaacaaagaactcccagaaggaatggtgctcacactgaaatttttgagtggataggaagctctgtttatgggggtaattgttctcaaaataaagcaagtttgcctccaggacattagtcattgcctacaacagtataaaattaggccattttgggtactatctggaactcctagcctcattgcgttttatatgtgaaagtactgctgataagtgttactgctggaggccactaaagggtatccttatgacttgaaggagctaatatcttccctaagtgcctcattaaaaagcctactccagactttcctttcagacaaacatctttacaaatccataaaccagattttgctgaatctcctcatgaggaaggttaagtgacagctaagcttaggtaagatacttgtaggcttaaagccaatgccgagaatccaaaaagtggtaaacctttcatattgacagaggtttaaaaataatgataatatatagtatatatttgtaattacatgtgatggaaatcttatgaagcaagaggcagcccatagatatcaatcactatgaagggaaggaaggagagaggaaaggcagaaaggaaagagagagaaaacttgatttctgcactcattgcccaaggaagaaatgtagcatcctagtatatataatagtagattggtaaagactggagaagagttggggcatgccaagttcttgttatcccgaaggatgtacacccttagctgaagaagtgagcaggcagttctttggatgcaggaaatagaagtaggtgtgattgataagaactggcataaggagtctatatccattcctggtggagtcatgttattttgtctttaggtgaaagaaaaactctagagaaagaaccgaaacactgtctaccatgtgttttaaccatcttgtaacatatgatgaatattttcaattaaaaaaattcagcctcatttttagccagaatatttcaaaatgttggagcttatctcattttttgatcatgcaaaattgacattcatctgataaatgtttcaagtttgaataaagcatgatagcctttcttattttaaaaaagggaggaggggtaaactccataaaacatgatgattaaagaatttcagttttgttccaataatgaaaaaagaattgcttagaaatggatatatttggtaaatacttacaagacatgaattgattccatacttaacaagtcagtatctcttacttaacatgcctagcttgccaaggcagcagatgtttacagttaagaattcaccattttggaaagtcaccatgatgacaactttatatttatttttctgttatcattaattttaataataatgtatttcagattagcctgagtctctatctacagtctgattttcagatgacttcttcacatcacattttagtggtgaaaataatcatgaattcagatggtttgcaaaacagtatttttggcatagttaagtgaaatttttgctttgatgttttcatcttggataataaaaataactactgttcactgaaaattcagtgtgccaaagtgctttacttacattacttctaatccttgaaacatcactgtgaggcaggtgaagtattatcattgtcctattttaactagttagaaagctaaggtgcaggttaggtgatctgtcgaaaatctctcctcttgtaaatggcagagtgaagactataattgtgttttgttttgttttgtttttagacagagtctttctcggtcgctaggctggagtgcagtggcgtgatctcagctcactgcaacctctgcctcccaggttcaagcgattcccctgcctcagcctcccaagtagctgggattacaggcacgtgccaccacacccggctaattttttgttgttttagtagagacggggtttcaccatattggccaagatggtctcgatctcctgacctagtgatccacccacctcggcctcccaaagtgctgggattacaggcttgagctaccgtgcctggcctataactgttaatataaacataattcaaagtctttttgtttttgaatatagataatcttttatccctcatatatttttagaatcacctaggtaggaagaggccttcaaatctgacctagcattccaattctccataccaatcccaaaagataatgatatactttctatttccactgaagatgggggggggggggggcttgccacttaataggcagtctatttgatgttgggattaatcattagagagttttgttcatacttggtcaaattttgccttcttggaatattactccattcattattgcactcccctctcaggcagtgttcaaatgcacattctaattcagtaaatctggtccagagcttgagattcgtgtttccattcagtttccagaggatgctaatactgctggtccctggaccacattttgagaagcaggctctactatcacctacctccatccagttaactaaaatagctatcaggtttatgcctaattctttttttctccaggtgtttacctgttacagatgtaatttctaaattcctcccatcctgcttataacccctaggataagttcacttgtttgaaaacctctagaattgaaactatgtttttgatgtaaccagaacatggcagacaccagtgagttctgcattttatgtgaccccctaaactactagtaatgtacactgagtacattaatctttgttaattcaaaatgagcttagaaccaaataaacctctctttcaaatactaagtccttaaggcaatttgtcacccttaccctgttttctcagagttaatttaggtattttttatctaggtgaaatattctacaatcatctctgtggaattatatcttgctggcttcagcctacctttccatcttgagtttatgaaataacaaagacatcaggattccaactttgtgtaagtccaaactttttaaacgtgctttcagactgttcgactgagtatctgataaaaatgtagatgcagtgacaccactagaaacctccattcatttattaaaaccccttatttactgtcatttgaccaactatgagcctattaatgggcaaactctgatgcaaatcaaccatagtttttacaaattgtctgcaagaatatcaagacagaactgaggctagtatagcatttctttctctctacctggtgagagaaaatttgtcaaaaagtcaagacaagaattatctagaggtttcagctgcaaaagaatgagaatccataaatatagattctcctgcattactatgcctttacattctgtcagcagattttaatagttaatattgtaggcaccgactatgtgattactggattttggattatttcaacccttgctcatctctgtttccttttaaaatgggcatagtgttagttaatagggctgatattaaaaattgataagaaattacatatagggcagacatattgagcattaaaaaagagaagaactgtgatgatgatgatgatgatgatgatgatgatgatgatgatgcctgctgttattttgcagaccccagtgagccatggctcacagttcatacctttgtgtactcctcgtgccttaaatctggactttccttttgaccaaccataaccaacagaatgcaatggaagtaacactgtttcatttctgggtctaataaaactaaaaaaggctgaaagctcctgctttgtctttggaggatgacaagtgctacgtaagaagtctgataaccctggatcactttactgaaagaagcttagcttagccacatggaaaggtcacatggagaagcttccagtcaacagccagcaacaattagccagttatgtgggtgaggccattgctattacccatcctgttccacaacctgcaaccctgcacagctcccttggtcaggctcacgtatccaacgaaggtctgagttctagcttcccccaccctcatgcaactaggaacaaatacagacaatacacaacagttcaccaaataatttcagtaatacgtttttctttctgacgcacacgtggaaatcatttactgaaagtgatttatgagtgttttgtgtctaatgaaaataatactaatgtatcattttatgtcaaaaataactcaaaaccacctaaaaataccaagattcatcatatagtatggagaagataacttcaagataaaacaccaaaaagcaccataaattcttgcatcttaccattttatattccttccagcctctttggaaatctagacttccatcttcacgatgttgtattacagtccaacctcccccattgacatccatattgcaaaacacctgacaaatggaaaacaaagtcaagtaaaaaatacttctactttaaaaaacatatatcctacatgtttcaaaataggaataaggcgaacaggtctgcagattacaaaaaccgaaattactatattgaacaatgttaatttagatatattattggttatttcttcctctgattcatatttgagttatttctgattaaattccatcaatgatgaataaattacatgcacaaattttagtcagctgaaaattaagtctttgtctcagactatacaacattttaaaaaatctttgttttaaatgaaaataagcatttgagtatgttcaaagttttggaaatgctaccaaatttccaaagttacagaccatttgattgccaaaacacatgactcagaattttaaaactttaaattgattgaaatgggagtacaataagaataaaaaatttttaaaatataatgtctttaactatcacatatttcattgcctatcaattcttatatatgtacatgttacagtagatatccttgagtcaatatttcattagaggcaacatttgtggcatagcatatgtagaatatattatttgcttgtattttagtcacgaacaataacaggagaacatgacatattgtatctcttctgactgtgacaataacttctttcccatgtggaaaatttatacaaatctttcaaagacttatgcatattttaattattcaaaatacaatggtatttatttagaaattgactcatttcccccagggtctacccaagaagagaaacatatctgtaatgggattatcgtcggagagcaatcactgtaattgatgtagcatgaatgtggcagcttgattattcaacggggactatgggaaacactatttcctcaacaactgaatactaaagcatgttgaagcttggctaaaggtgggatatgatgcaacagcagcaagcaggctatgaggacacagagctaagccctgattaaagaaaaaacctcaagtgttttccctgaggcattgcatttggaacacaagtagcaaaaagggtataaaagcagtggcaagaaatgtcattcaaagagcgaattgtccatgtacttcctcagagtggaagggtccaagatatacatgcctacttgtgggcatatgaaataggacaactctcctcccaaggctctcgccctactttgacaacagccacacatacagtatgtcttcattaaccctaggaattgactcacctccaagattgtacatttgaaatgttgattcctgtcccagtagtccccaccaccactattcctttaatttctgcacctgctctcagtcaacataacctcgagctacacttttattttccgtaattctacttcatttattcatttattttttgatttactcaacaaccattcttgggcatcagttttcacttacaactgggggtattattataaataaaatatgggtcaggtactcaaacatctccaagtttcaatagtgactgatcccatagaattaaggagacagagttcacaattttcagctctaatagcctgaagaatcatggagacaataatctaaatgagaaatttaagaaagaaaacacgagcaaagaaaatgatcatagttttggatacctcaaaggctagcaaagaaaatgatcgtagttttggacaccttagcctttgaggtagcacagatatccaaagaaaaagtttatcgagcacttcgagatgatctagaccaaggataaaaatatggataagagcataaggaagaaagaaaggaattgctattaacaatgacatgcttgttaaggaccaaataatataaacaccttacatgcattttctaatttattctcatgatagtcctagtaggatgtaggtatgatgatcatctccattttacagatgaaaaaatactgaggtttagagtagttcagtaacttaccagtgattatactcaacaataagctctggatctgggatttaaaattgatttgaactggattcagaattgaatcctatgtctacctaattgaaaattattgggaataatctgcttaaaagcatttgttaatagcatgaagacaaatgcaattacttaaataagtaaagaaaaaggtggaaacagatgtgtgtggcagggagtgagaagggtcaaagaacgggctttggtgaacacctgagaaggacagaatacatcaggaaactttaggtgggcagggatttctttcaattgactgctgtccccagtacctagaggtgtgcttagcctgtagcgggtactgaatgaatatttgataaacaaatagagatggaacaggagagataaaataggaaaatttgattaatggaatgctaagaaagatggatttagagttggggaggtgatcatcaaaggtttcagaaaagtcaagataaaaaatgattaagaaaatataacttcaatttgaatgaagaagcctttagtgaccttggtgagagagaatgcagattcctgtgggaataaaatcagatggcatagtttcaagagggcataggtggtgattcaagagaagtggtcaaagtggagctttaccagtgaaattcaaatgagaaaaaagggaagtgaaaatatcaaggaaacatttttctagaagcagctaatatcactagtttctcaattaaattttatcgtgccctgacttgttaatccagaatgaatgtttttattcaaatttttatttcctaatggacactgattgcctgaaagtttgccaagttgtgtttgcaaagctgtaaagtccacttacatactcagggaaaagaatcactacatttataaatgtagagtgcagagaggaaactatattgtacagtttttaaattactgttacctagattattaaaactctatgcacttagtttttaagtcactcacaaatttttgaaaaagacaactttccttctaaacagaggcatcttagcttttaaatcactcggaaatttttgaaaaagacaactttccttctaaacagaggaatccagtgacttgtaaatgttcagatgtgctgagaatgcttcttaaataaagacctagaggaaaaaccattgggaaatataaattacccaggcagattactaagttggaagctgagggacagagaggttaaagggttgaacatatgcttcccaattcttatgcagacttaataacatcaatgataacagctgctctttgtgttatataggcacaatggagctgaatgacaccttggttaatagcgccaacttgagtgctacattgcctgaatttaaaatccacctctgctctctgtatgtacctcttagatattttctgagaatttgatgagttaatgcatatagaatttttagaacagcatttggcacttaataggcattgacactactcccatctcttacatgtattactgatgacataatatatgtttatgctacgcattatacactctatgtatataatgtaatatttaatatgtatataatatttaaatttaatatactatagttatataacattgcatacaaattttataatttattataaataatagaaaatatacaaaaccaaaacatgtagaagttcaataaattatctttataattatgatttctaggctctagttattataatattggcatcactaatctttgagcatgccacctttctatatgtattatgtatgcatatatatatatatatacacacacacacgcatacatatatctatatttaagaggttggactcactctagcaaagacaaaacaaaagcctattatttttagtcagaaaaaaaaataaaagcctatgcttaacagatgaaggaaatttaaaaaaatagatggtaggttttagaaagatttgagacatgaaagacttgaaaagttcatttgccagtattgtgtggtctgtgctatctggcagtgtccttcctgtggacaagaccctgctacattaactatgcctattgcatttattgatcatatgacttgggcttaactctatccaagaaatgactgaactggctcctatcccaggcaaggtcaaagctttcaagcattaaacaccttttaacataatacggaggcttaaacccaaacaaaacggggaaatttgattcacatagtttttatacttttatgttccatagaagttggaatgattagacttgtgaatgttaattatttttccataccataaatgaaaagggcttaacccatttgttacagtacttttccaagaattaggggaattacgagttcagaatcaaatttttaatattttacaataagcagagtaatgattaaatggtttgttttttggatgaaactaggcatttggttttggaaacataaaatgaaagggaaagtcttgtttcctactactatacattgaagggaattcagaaagaaaaataaacacaagccattaataacataaaagcaaaaagtaaatacagaaatgacctaaatctaattttctttctgcttgaaaagttaaatagtcctagaaaaccgtctttggcttccacatttgaaaagataacatttctctaactttcaaagacatttttttttggcatggaacaatgtcaatcgaaaaaattactgtactacaatcctgttatacttgcaactcacacactgactacaagatgaataatttctgctcattggtttgtcactttcctttaataaccctagtttattttttcgtccataccatgcatatttgatgcttcggtttttgtgtaggttgccttgagattcttacccttgccaaaacttctggaaacattataatgagcaatgctttggctaagcctacccaggggtagcaccaaacttcctgtttacaatgtacagtctacatggaagggtgaaagtcttaacgatgaattttgctagcactttttataggattgagagaatgctgacaatttatttcaagatggaaaaaactgagattataggaaggtgagaatgaggtgggttataatgagaacatgaatcaacttacctaattttctaaaaataaacccttgcctgtgtagctcacatgtcacaccatgtgtttaccaccccatggggcaacaggttcatatttaaaattataaatgatacaatttcaattatcgttaacataaataatgatcctgcttaatcctctgattaaaagggtgtatcctagaattagattcctttgtttcaaagtcaatattcaatatttgctaagaatttgtatggggcaggttaactttctaaagtagggataatgggagtctctatctcatagggttgttgaaaagagtaaatgaaggagtgtatatatatatatatatatatatatatataaacatacatatatatactaagcatatatatatacactaagcatatatatatactaagcatatatatactaagcatatatatgtactaagcatatatatacactaagcatatatatagatatttagatatacatagcatatatagatatatatagcatatatagatatagacagcagatatataggtatattatatatctatatatagatctctatatatagatataaatatctatatatagacatatagttatatagtatatttagatacatactatactatactatatatactatatatatagttatatctagatatactatatatctagatatgtagttatatctagatatactatatatctagatatgtagttatatctagatatactatatatctagatatgtagttatatctagatatactatatatttagatatgtagttatatctagatatactatatatctagatatgtagttatatctagatatactatatatctagatatgtagttatatctagatatactgtatatatactatatactagttatatctagatatctagatataactatatatctagatatctagatatgtagttatatctagatataactatatatatagttatatctagatataggtatctatatctatagagatctatatatatctctatatatctatatatagtatatatatagtatagtatagtatacatctatatatagagatctatatctatctatatatagagatatatatgcttagaagaagactggcaaactgtaaatgctcaatacatttgagctattttgttaatcagcttgtaaattacttttgaggaaattcacacaatatttgttcttaccagtgctatgctatgcaattatactaagggattaaacactaaattttttacctgcaaaaatgtgtatgtatgtcagtctgaaatacccatctttattatagaacaatgttactacttgtaagagaatctatgattataatagggaaataataaaacaagagaatgaacatctaagtccagaagaaggccaggtctttctctcttcagctcagttatctccccttctcaccacactctgctagtatttcaataaaactaaatctaaatctaacaatagtcctgaccaggtaatattggaacttctccttcttctctctgaaaagccatggtggccattcagcagtgataaaatttgctccttatgggtacgtatgggtatgttactgctaacctgttcagattattattttttcttagcctaaatatcagaagttaattcagtaggtacttgacatttgtgaatataatattctaagttttatttatttaagaaaacccaaaaactccatcatatttaaaatccaccattttgtagaagcgtaagcttgaatcttgctttcctgatgaaaccaacccaggagccagccatggaaggagtaaattggattctccaacattctattttatgtaagcatgaaaagcaaacctattcaggattatgaattgaggtgggatctttttcttcacattaccaggcgcagtggttctgcaaatagcctgtgcaccatttgcatctcataatgtttcaaactagagtgtagttgtggttatatatgaactaaagtccatagaatgactaaagctgtatttgtactgcaccccttcccacagaccacatggtagtactgatgatgaagtcaaaaaaattctaaaattgtgaatattcttgatctgaaaactttgggaattatttttcgattcatttatatcacagaatcactatgagtctaaatggaagttcgcttagtatttttagttaattttatttttatagtcagattataagctctagtggaactgacaataatttagaggttctttcaggtcttgagtagtactgtaggtaaatgataaagcaaatgttttaactccacctcctactccagatcaaattctcacatacttcatctgctgtgtgtatggtgtgtgtttatgatgtgtgtgtgtgtgtgaattgaatttaagcttaagtgtgattttaggatatcttccttagaataagttatcttcatctcctcattcccagacttgccattgtatttcaatttttcatttgtttgcttctttaagccatgggattcaatgtaatcttgcacagaaatcaaacatgaaaaacagcaaaaccacacttctctggtagatggctgaggtagcaaagtacagaagagtgcctcctgcctgtcctccctcctgtgcccactccactcctacattttacccccttatagacaacatcaaaggtatctttcaagaagaaaattttgtcccagcaaaggggaaaaagaaaccatttagagctaacataaacaactattcattacggaaatcaagagagacagaggacagtggtaaaagggaaaatagaattgtatcagacctggactatagtccagacttcctgggttgccaattaagtggcatctggcaaactgggctccaggattcatttcctttgcctatcaaaggagactaacaatcaggaagactaagtaagttagactgatttactatgcactgcatggaagtgttgatattgccatcagcaggtcacttactcatttattccagcacatatctattgagacctactatgtgccagaaactatgctaggttccaggaaatcaaagataaaaggcacaatctctgccttttagaactctggtagtgagaaagtcatgtaaagttgcctgagggaatcagagaagattccaagagcattgcacaggccccagaggaaatggggataagagacaagtaatttaggtgggggcatgaggggaggacagttgttttatcctgtaagggcatgcggtcctcttgggaccctgggcttccagttaaaactcacagacactgaagagcaaggttcttgcctaatctcactctcttcagctgtctcacctcaaaacttcccatataccctgctttacacagaccatttctatcactatacttattgacagcattttataactatctgcataattgtctatcttcatcattacactagaaactgtttgctctatattcatgttcctaacaaatgcatgatatccacttaacagtattgaatgaaggcatagatggatgatttaatgaataaatggtggaagacagtatacaaaagagatgttacagcaggaagataatgtttgcttactccaaagtttaccttgggtcctgttcaacatactgatgaatccgatcctccaacccactcttttatgtaaatatggaaagcaaattctttcaagattatgaagtaagataggaaatgtttctcctatcctaacaggagcaataacttgcaaatagctatatctacccctccctctcctcacagtatttggctttggataatgtgtgttctctggattgttgggtctttggaagatggcttctctttcccatagactcacggtagacatgacctcaacatgtaatctgtacaaggcaaacatgtatgagcaaggggacatcctagggacaccagggaataaatgcaaaattttgtgtgaaagaaaaggtgtgtggattggggatttctgtacaatagggttttcatcctttatggacctgggaaacagagtatctctgggagaaaaaagttcaggcatctctatatatatttccagtttaacaagctcacaaatcaatctgattatccagcaattcaactgggatctggcttacatcttgtaaacaaacacttctggttttacctttttgggttctggcatattattaatataaatagtgtagattccacttttattaaaaccagcttgatatacatctgcacagtctctaaatggtttctcttcctctctttttcctccctttagtaaaactgcaaaaaaaaaaaaaaagattgcaatatgtgaatatcagtaccattagtagccaaactgactccaataatagctaagcatgtcttcatttcctccacacaaatgtcaatatcgcacatagtaaaaagtcaatcataaagacaatactagattttgaggtagcttacaaaattaaaaaaaaaaaactgaaggaaaaagctgtagagccatttttaactgaatgcttatattttacttaatttcttaattcttttttttctatgtatcctttccaaaacatcaacttaaggaacaaatgacctgggcatgtaatatcttcaattggtagcaattacgtcaagtttcctgcaaaatctctaaaacgttcttacctacatttcacaggaaagtctaaaaaaagtgctaacacactttttggagcaggaagacatgaagataaattcaaacataaaaatgcaatatggaagtttaaaacactaaaacaatggaagtactgtttttctgtgactttatattgaagagcttctagaaaattttaccaacaaaacaaagcaaaacaaaaagaatcaacaactcttaacaataattagatttgggaagtagaaaagagtttatgacccaacttaactacctacaatgaaaatgaaaccaaactttactttgttctttctttaatgccctaaagttaaatcatcaggcagatgatacacaaataaaagaacaaacaaataagactttgaaattaaattatacaggtgaaagagtcacagtaaacactagaagtcaagtgaagacagaaaatctattaatagttagagactgtctctactgaggaaaaccttattttatttactgagctttatccattattaacttcttacaaatgaaataaaaatgcaaaatgacccacatttaatagttcttagctaaagatatatgtgttatatttataaagtatttatgatttagtattttctattatgtattattttagtaattggttttatttaacctttttctagaaattaagattaagactattttgttatcttgcccttaaagtttcctatcaataaatatctgcattcaaacacattgagttataatagtcttttataataaaaataacaaaggcaaactatgaatcagaacttttacattaattttaaatgatctaaaaatctaaaatcctggcctaacttaatactggtttcatactaaatactggcctttagttgcctaatgtttactaacttataggtattgagcagtctaatctttatggaaataattactatttcaatataaattactcagatttttaaaaaatattaaattatatttcaagaaaatgaaatatttatgtcagatatgttgccacagcagaaaaatagtactaaagcatttaataacattatgattttctatgtagctcaagtctgcactaatggttttaatgaatcatactaataattacatctaaataccaccatcacaattgccatgtcaacacaaaataaatcaactaattaaagggctacagattcatatgatagtgaagaagtactgcacagaatgtatgcaaatagcaatttaaagatgcatatataaatgcttactcaaaagccatctttaatgacactgaggatgtcaatggattatataaaggtatccatttcaaaagcattgacgtagtttactggtattcgtttattctaactttacggactgctatttttctaaaacaaaaaaaaattttaaatcccacctactggatcctttattctgttggaaagttgaaaataagcaaatcagatgcccagaaaaagagatgtgaagaaataccaactaaaatttatgatcacttgagaggacaaaaaacacaggaagatgtggtcagcaggaacccaacggtaaacccatttttctcttttgagagagagaaagtcatttatctatggagaaaatgcttctcttgtatataccacatcctgccctcccttttttagttatgtatggagaacacattcccttcactcttgtctgccatctctcctcccatttttgctttttctttccacttcaggaagatgttggtgaagtggctatgtgtgggaagaggaagctatttcacacacatttttagtaaccgagaaaaaaggaaaaagttgggtattaacttatttttgtgaaaactaacagtataaatttgttgtcaaaaccatgaatacaaattctatacttgggaaaatggtttgagaattctaccatcaaaaggtacacctagtattatggttatattatggattttttgttgttatggtaacatatctgaaatagatattgtattttcttgaaatttaatttggtatgtttgaaaaattgagatacttatattctttcaaaaaagtcattctttccagaaagattagattgattgtttttaattacttaccaactagcaagcatatgcctgaaagttaatttaggctacactttagagtagcaaggcattgaaaatcattgtaaaagtttcatccacagcttacctttggtatttttattatatactacggtttgaataaggtccctttgataagggtagattgacctttagagttttttttgtccttaatctataaagtgaggtagttataaatacctctgagatgggtgtatgaattacctaacacagtgcaaagacagtgaagcataataagtactcaagaatggtagttgttatggtaatgacaacactgttaacagcaatattatcctgttactccttcttatggaagagacactagcagaatgtggaaggccagtctagggggtggtggatgctgctgtcttccaccttctaattaaaacatagcagttatagttgactagttatatttaggatcacattgaattagcctctcctggtcaaatttggctaattggctggtttcattcattgaataaatcagattataccattgtttacatttaagaaaaccccaaaacaggcaatctcatcttgctgtgtattttaagctttacctaaatagttaagatttaaagattatttcagatgaaattataaacgatttatatgtcaacatgttggttatagaagtttcaatctcatgactttttgcatgactcgtttctttgttaagtactgcagagttctgaagtccaatgtcatgcatagatattataaaactggacacctaggaaacattctaaaacctagagagacaataacatttgaatttcctgaacattgcaagtgtcagcaccagtgataagatttttaggaggtcttgagcttcagttagatagaagatagaaattggaggaatatttagtaaatgacacgagacagatagatacaatagacttgatggggccaagagcagtggctcaccctgtaataccagtgttttgggaggtagaggcaggaggatcccttgaggccaggagttcaagaccaacctgggcagtacagtgagaccatgtctcttcaaaaattaaaaattaaaaaaaaaagtctggactaagatttgatggaagagtaaaagaagcatcaccgaacagatgtcagggggaaccttccggagacctgaaagagggctgtatctatctctcaaagtggtttacactttttgtaataatgaactgatttgaagcacgagttaaaaggttgatctttatgtctaaaattctttctttgaccagatattcttatttttcctttcttattctttaatttctgatgagttcatcttccctctcattgagaatttagatccctgccattcctatcactgctttccgagcctcccttttctttcttcttagcctcgatcccagagtcaggaatttaataatggtccatttggcatccctggtctctccacccattgtcctttcatccactcacctttgcataggtaaatcccaacccccagatgggcattcattcactttctcaacccccttgtagactgcaaacactgagtcatttgtaataaacttcctacgacatttcctgtagagtgtattgcaaatctttctactgttttaaaaaactacatcttatcttctctcactctttataaatgacctttatggtttactctgaagatcaaagccatttgatatgtctcctccactcccttcctctaccctatagaagttgtctttgcctatctttcccctcgcgttttttgttgacctctcctagtccctttcaacttctccaattgttttttctctttcctcttttatcggtttattttcctctcatcacctaccatatagatgttcactaagtttccattcttggatctctatttcttatatatctgttcattttgcaaactatctatcatggcttccaactgcggcacaaaagatttctaatatacacaggcactttttaacactgagtatttgcctctctctttaccttcagattcatatatctacttgcctgttgggcagtccttcctgctacaccaactttcatttgtttaatgttccataatctttccttccaaaccaggtgtttgctctttcccttattagtcccactatccttctccagtttttatcagttaaaaattaattaaagtgttaatttttttctaataagacaattagagtatggcttttccatttgtccctctgcttcttatcctctcttagttcaatcatcctatattattatttcaacaaatattgatggacatttgctatttttaagacttctcctaggcaatggagatacagacataagaaagcccaagcctgcctgtcatgtgatcacagcctgatgcgaaaaagatcttccatgaacgctatacccatgattagtaacttttatgataggacaaaactcaattcaaggtggcttaagcaaaaagataatttattggatcatgtaactaaagaatccaatgtagtactttaagtaagtcatggtaaggtttcaaacaatgtgaccagaaattggtttcttagtctttttcttgacccacttattcttggcaatcaacctggtcacaagatagctggcaataacttgtaaggctataatgtcaccagtttaaatacagcaccaaagagagagaatgcagacaattgttatcttagaggtatgtatcaagcacattgggaacatgcaagaatatactccttctgccaggtggacaccaggaaggctacctagaagagataacagttgaaagaatataacatatagaaaagcttatctgacctaaatttaagagcctggtatgctagttcaaagactttgcccacaccaatatcagcaaataaatctagaaagtcctaggaaggaatcattattcattcttttcatttagccttatctatacaaccaaatctttgtcatctaaagggatagaatagagacacaaacaggtgcatgtctgtctttcaccagccaacattcagtcaataagcaacctgagaccctgatgctagcagctgttgactttatcctgatcttcccttcctttacccaaccaatttaaatctagatggtgcatccaccaccagactgacttcaggggaggaccatgaaatctaaggcagagggtcacttcaattcagatgaaccctcaagaaaaaacttcctggaatgtggaattggtaattattagcctcagcaacactagccgagaacacagaaggcaattagccttgctaccagagacagtgtaaaaagccaaagccctttctcttacccattttctgatgagttgctataaagaaatcagttcttcaatcgttcattttaaaccttaaatatggctaatggttcatgtatttccagtatttaccgaacatcagaatacatgtggatcaggttatttgttcaaggatagtccttgagacatcattattaggaagatcatagcactagaaattgaccctgaacctgtgatttcaacacaacaggtcactgaaattaactgagcatataaaggaagaaaacagcacatctgacaaggtgcaaacaagcaaacaattgatggattagattttgtgcttttcagccaggtgtgtgggcatttcatagagaaaacattttgaagacactctctggaatcctaatttattcaaaagaatctttaaaagtggaagaaggtaatgtcttgcatttcaagggtgtggaagaattaaaagatttccaggcagtccaagtttcaatattttatgggtaggtataggggtgagggatatttaccaatgactttataaacagatatacaaatatatatagctacacaaatacatacaagctgtatgcttataaatggaaaatgttgaggttggtatttttttcttgtagaaagcatatgcatacaaacctaaatatctgtgggctgatatctcagcatgactgtttttaacctacaaaaatggcaattgaatatggttatatgtgtgtgtgcatgtgtgtatgtgtgtgagacagtataacaaacacatacattctattcttaaatactcttaatttgaagtctttgattaactaaaagtgtacttttttatttaaaacaactacttcttttctcaaagtccctctaaccctggaataagggaacacttgaacatcatttatctagtgaattattattttaattaaacatttttaaaaaagaacttctttgctctcatttaaattatttatatgtaattttatagataatctataaaatcttaactaccattttttatggaactataataatcatgatcataataaaatcaactagcattaattgaacacttactatgtggtaaactctgaattttgtgtgccaagtatgttttacatgcttcattttgttcaatccttataaatttcttatgaggagtatttatcaatatattgctttacatgggaagttgaagctcagaaatgctactaacttcaccaaaacttgtaagtagtagaactctctgactataaagctgaaaatcttaactacttcttactggcctttgagtaaagtgaaacccaaatagaacttcagtgagtcatctgtcacagaatccccagcaatacttatctctgctgacaagagcacacccaaggtcctgagttattcagtataagccataagtctgaaagggtacagcctcatctcatggaagcaggttgtatgggaaaagagagaggaggcagcaatgataagaacaaagaatatgttgacatgaggatagcagagagccacaggcagtagaattgtctgagatgaaaaccctcagcagaaaagtgaagccgtgacagcccacaatgtcaagagctaacagaggataagtgagaggtcccaaagcagccatattggattttatcatgttcatacccttaaagtcacactgactcaggatttacccctattaattttaggtattattctcataagcctggtagttggtctcccagcctacggactatttgctagaagcttcaaagacagagaggataggctggcggggtagtgagagtgggaatatgtgtgtgtgtgtatgtgttagtgtgagtgtgtgtgtgtgtatgtatgtgtgtgtgtatgagtgtgtatgtgagtgtgtgtgtatgtgtgtgactgtgtgtatgtatgtgagtgtgtgtgagtgtgtgtgtgttcatcttctagtatcaggcatggagacaagaaattggatcattgaaagtatgtgtgtgtgtgtctgtgttcatcttctagtatcaggcatggagacaaggaattggatcattgaaagtacgtgtgtatgtgtgtgaggaaaagacagaaaattttaaaaagtaggcaaaactaagaaatgataagaatttgggcactgaacaatataaagggggcatgctatatacttttccagaggcatcacggtattatgatgaaaattaattcatatggataataacggattaaattattagaaaaaaagccataattttattcaattttctcttccaaaaaaagaaaggagaggataaaaaatgcaggtaatttttcatcacatttaaaaattttcataaaattttactaaagggatacattttaattatctgaagaatatattgcccatgatatataattgcagatatacaaattttcaataatactacgatatacataagacatacaaactcttacatttatgtagagatgcaaagcatcctatgtcataagtgtagctctaatttaaagtctgttttaaagtggaagaataattaaatatcaattctacatatttgtactgtagtttgattaccatgttcaaataaattttgcaattatcttccaatgtgaaacgaatctcatgtgtataacaacgtatattcaatgcctattactacctaaagtaatcaagaatggggaaaaagctgggtgcggtggctcacgcctgtaatcccagcactctggaagtccgaggcgggcggatcacaaggtcaggagatggagaccatcctggctaaaatggtgaaaccccgtctctactaaaaatacaaaaaattaggtgggcgtggtggcgggcgcctgtagtcccagctactcgggaggctgaggcaggagaatggagtgaacctgggaggcggagcttgcagtgagcagagatcgcaccactgcactccagcctgggcgacagagcgagactccgtttcaaaaaaaaaaaaaaaaaaagaatggggaaaaatacttgactaaaaggtacaactggaaatacacaccatctttgtttaatcaagtaatctttcattttacataaaattaatttctttgttttccctttgggcaccctgttgggcagttacgaatgctgcacggcccttgccatttgttcaggagctcattttattcacaaagacatttcaggtgtttcgtgtgtgttaatttcccatatactttttttcagcctggctaaaatatattggttttgtacaaaagatttcccatacatgtgggaaagcttaaggggcatcttttgtgctctgctatgagcagacaaatataatttatttcagcaacagccattaaaaatggaatgaaagtccttgggcaatgctgtaaacatagaaagcagttgccagatgtttttgaaaactgacacatacacaaaattccactttgaagttttaagtaaataagtcctgactgtcaccacaagtacgtcaccttgattcttactcttgtggtgtgatatacttaaagaacagtacttgactaccagccctggctctacatgggcttctcctctgaatacagggcttcaccggttattaggagtgacacaaaaccaagagacaaagttggaatgcttgatatgagtcataaagtatgtaggtttgtgtaggataccaggcaaactctaaggtgtgccatacttctatgttaagcaatctgacagcagagctgggactagaacagagatgtcatgattcctgctccttctaaaccaccatgcctgccctctcgatggtatacacctgctcccagatactggagagaaaccatctcaatctataattcctagctctagagagataggttggataattaattatgattaagattaggtttgtgcgtgtctgtgtgtccatgaggcctaaacaactggcaaaatctccctttagaaccaaatttccacttaaaattatacccaaagttcaaactcactattctaaaggacgtcatcccacttgtgaaaatggaacgttcacacctaaaaataattaagataattaagatacatgcaaacatataataaatacacaagttaaaagaggtctgacatttgatattacatttgataatctgacttattcataaatccattaaaaagatgagtaattctttgtaggctgcatattaatatgactccttagcagacataaccccactcagaatgtgaacacccaaactagcacaagcatgagattccagtgtacttaaagttagttttcatgttgatatcctttggttgataataaattatgagttcctataggaagctaaaaatgttactagttgttttttttttttttttttttttttttttgagacagagtcttgctctgtcgcccaggctggagtgcagcggcgcaatctcaactcactgcaagctccacctcccaggtttctgccattctcctgcctcagcctcccgagtagttgggactacaggcgcccaccaccactcctggctaattttttttttgtatttttagtagagatgggatttcactgtgttagccaggatggtctcgatctcctgacctcgtgatccacctgcctcggcctcccaaagtgctgggactacaggcgtgagccaccacgactggccaaaatgttactagttttaaagattctttgcaattgacttttagaaaatcttatgctaaaaataaatatttgtttatacacatttaaagctaagtgtacagttgcaacattccccagattttaccttctttttctcccttcttacagtataaaaaatttcatgaggtcttcactctatagttgatatgatgcatacatatttaatgctgttaataaaacattttttcttactgtctctcagagtaattataggtgtcatttggttcagtgtaaagtgccatatcttatccgtgactaatgtctactgttctgttttgtccctggtttagaaaatatctgttgaatttgacttgagtgtggatgagaccaggaaatgacttaattgaaagtctattcaaactatctgtgctccttcgctttagccaaccaggctatgaaagcataagggaagaaggatggagtttgctcatggtaatattggaacatcaaggaaacactctttttgtggccttttacccctgtaacttccaagcccagctggaaccaggagatatcccttttcagatagttcatcttgtttctgaagttaaaaactccaattccaaaagagaattaaccacaaaatttcaaatctcctccgaaagatggggtttagaaatagttcatgggagaggtcaaggactatgttattttttattttgttatcattaatttggctatccactattcacaattttttttacagaaattatgactattctaaaaggcagataacacgctccatcaaaaaggagaaatataccatttccaaaaataaacagtcaattttgccttaagccactgggttttatgaaaggaagtgctagatagtgtggttcattttaaggaaattgtaaatgtttgacatataattttctgtcaagataaagcatttccctcattaaatggaaacaagtactcactgcagtgttcagcagatgacttcctgtatttttctttctctttctacctaatcttaaattgtgcactacaagtagtaaatgaaaaaccaagtattttacccagtcaacgaaactgatatattccatttttatcaatgtttatatgactgacattcaaaaagttttaatttcctcccatcacttgtgatgtttttagagtcattcttaactcaagggacttgcagttcaaactatctcatcccttacagaatgatataaacttcataaactcaacagacacaacatgggaggtaaattcctttcagatggtagaattattctgagaatcaagccaaatgactcctcagcactgagaagaaagcaaatgcctcatttccccctttaagaagactagaggacccataataatgatcaaatgttccataccactgcaatcagcttctgggaaaggcactttagctcaaatagtggtcacttaaacatttgtagtatcagccattatgtctctgtgataatgtgaaatgattcttaaaaatgaacttcatgagaagctcctatgagttgaaatttgaacttcttatgagagaattaagtatataaacatgttcttgtctctcagtacttatttttaagtttcctctactccgtgtgcctccctacttaaagttgttatctgtcctttcacattcaagtttcttgaatgcaggtatataatgatttctgttaacttcctctcactcattttagtctctgagatatgcaactgagccatgtagcataccaaacctctgcatacagaaggttctttttaaaaacttgactgtcatgcttacttgccactgaaaagaacatccttcataactgtcctttttttttaaaccttcccaaaacactgcttactactgtttttcacactgtctatatttttctttcggtctcttttttttaacctgtcccttaaaaaccttcaaatttttctgtctttgattttacactgtcattttttcatacaatgcactcataactttggtatgtaaatgctctcaaattgtacacaaatgtgtgcttatatccttgcattttggggttggggtaagtggaaaggaaaaatagccgtttgcatctggtttcctgatggatctgtgacccctacatgaataagagccattgctttatatgcactttctatgattttacctcttgtctcctctgaggacaaatcattgttctccttctagaatccgatttatctgcctgccagactctgtcccacaggcaactcagtcaaaatatcccaaactaaaactcactattttttcccttccaatctatttcatctcccatgttgctggttttaaagaatgtgatctatgctccctcagttgtttaacctagaaatgtgcaattggtattagattagacttctaggaagtcattatttcttgctgattctaatttttctatttttacaaatttcttccacttacttttccatttacccctgtttaatatggaccttactatttctttcctagagatcactttgaaattctgacaaaaatcatcaactctaccttccctgtccaatatggtgcagcgtgtaatgtacagtattcagaacaagactctgggttcaaatctcagcttgctcacttgctagtagtgtgatatttaagcattattcacctctctgtgcttagcttacctttcatatagagttggtaatagaacctatcatacagtgttgttaccagaattaaataaactaatatatgcaaaggtctcagaagactggcttgtgtcaagtatttgctgatattataataacggtaaaagcacccatctggtcccctactccaggcttctcagctttacagtatatttttcctacattgtcactggggagatttttgtaaaacacaaatatcaccattatcatcatatattgacaatgactgctcattgattttatagaaaaaatgtggcctttttggtctccctcagagatcctctctctaaattcattttaagacttaggctacagcccgctcccatgacttctggaaaataaacatgccgtttgtactctctggtgtgtccttcactttcttcattttttagacttaactatcatcttcccactagaacaagcttgcttatattttaatcctagatcaatgatttccagctttgtaactttgggcaaattctcaaattctctgtagaggttataaaattatgctagacatggtaactccctcatgttgctgttgtaagggctaacacgtggaaagcctaagcaaactagaatcataataaggattcagtaaaatccccaagaaaactctagagatgctggattctgcccttatccttctgttcctgccatgattttaatatttctctgtgagctttgctcgggtccaggcaccctaggctcacttctagcaaataattctgaaaaataattgtttacttttttctctcctatcaaaccctaggttccttaaagccacagaatgaaatacatcttttcttcttcccagtagtctgagcaatatttggcacattatagaaacttaccaaatatttgttaaataaaaatgaataaatatcatttccccagaacagaacagttgctgcagaactgttttgaatgaatggataaatttatgaaccacatcctgctacagcagaaatgagcttcgagctgatttgagcagtgtgagacaatcagactatgtaagtttataatacagtctaaatactttttttaaaaactttttcttttcttttttccttccttcctttttttacatgctgttagtaattaaattcccaattatatatttgccacgtgtatgctcaacatgagatgacattttaatcaccagtgtacatagataaccagtgaatttatttttatttttattttttttttttttgagacagagtcttactctgttgcccaggctggagtgcagtggcgtgatctcagctcactgcaaccttcgcctcctgggttcaagcaattctcctgcctcagcctcctgagtagctgggattacaggcatgtgccaccatgcccagctaatttctgtatttttagtagagatggggtttcaccatattggccaagctggtcttgaacttctgacctcaagtgatccacccactttggcctcccaaagttctgggattacaggcatgagccaccgcgcctggccaactagtggttttttaatagtcacagtaactgattactctcccctgaaagattccaaaccttgtttgtatgccttattaatgtaaattacttaattccagcaaatatttaattttggtaattttgaattgccaaaaacatgaagcaataggctgagctttgacattgtgataacactgagggcaatatttctttagtggataatgtttctaagaataaatgtggcccaatgtttgcagatgaaggttaggcaaaaataaatgtgttactcagaagccttacaaagtggatgcaattcagtttgaattgactatttgcctaagacaccattattgtctattaggaataagaagaggaaagtttggtgaattatttcagataatgtgtttattagttgtccttcttaaaagtatctcacaacatcagatgtgttagtagaaaaagtgctgtgaaactaaacaaaagcactctctgaatgcaaagatagatttacagtttctggatcaaacaaatgtttgggaaaaaaagtacatgtctagccaacacttcctaggaattctttatcatataactttaatgcattataggcattttagaaggcactaaaataaagataattacgattattttaatgttgactatgacttaacacagaagctatgcgttttatactaacctcttttaatatttcaacatttaagaaattaattcatttacttgtttatgtatgtatttattctaggccctctatttcttttttaaatttgaattttttaatgacaaataataactgtatatatttttggagtaaaacgtgatgttttggtacatgtatacactgcagaatgatcaagctaattaacatatccattacctcacatactcgtcatttctttgtggtcagaacatttacaatccacttttttggcaattttgaactacataattgacaaaagttgtatatatttatggtgtactacatacctaccgggtagatattatgatcccattttagagatcagaaaatggaggccaaaaaagctgcctggatgactgtcaacactcaaacactccggggcattgtatttaaacattttctgcagaggaagttttgcttataaagcacataatgaatgtacttaactgaatcttgtccatcgaaggagaaagaagaaactaaagtttaatgaatcaactgtgtcttcagcaatgggatcttcgcttgtatattgagcatctaatgtaattctttccctattgtggtgaaatagacagaattctcctgactttatacatgatgagacagcttccttaaggttaaactggttgccaatgacaggggaagctcattaacatttttttagtctggccttgcagtattatattcaggctgtctccacagattagtgggtcagattgaaaccagaagaccttttagggtcaattaaaatgtttggctttttggatgacgacacagctcgtgttttttaagatcttgtagaatacctatatttgagctttaaaatgtacattttagaatatttgatgcgtttattctggtatgcttattttgaaatatttgcatatatataaatttataagtaaaatatttacatataatccttcaataaataataaatttatatgatatataaattttggtcataaaacaaagaaaggctttacccatgtgttttagaatttgaataaaagttcattttaataactgatattcaatctagtattatgctattagccatttaaaattttaaattcaccatagccaacgactaaggctccagtgaaaataaagatatgcagacaatgaaaatcttcataaaaaccttatgagagccactttccacttttgtgtctcttatgagttctaaaagtaactaaatatttagttagaacgcttaacagtaagattaaagaaaaaagagattaacaagaagcaaataaaatctatggtcatgacagcagagaacctattggaaaattaggcaatcaccttaaattaagatggcaaatcctgtagttaaatcaagattcatttcagagttttgtcattaaaaagaaaagatatctagaggcctggaatatttagacaaattcagtttctatgattattattactatttttggatatactacatcatagaacagacacagttacttttttcacttcctgaatggctatgaagggtaccatctatcatggctatcctcatttttcaaaaatgtttcttaaattgaacagatgtttgcttccctgatattgcgcccaaagttgaaacctagccagaatgtttacttctaaagtcacatcctcttcctctaaaagcttaaagacacatttattaggcaaatactcagaaaagaagttaaattatgataagtacgcagacatatgagctctgtgagaatcactagggcttgacatccctaaaatcatgaaataaaaaccactattccactccatgtgctttaagtcttaggatgataagaaaaatgtgttttcaatctttcccaaaatgtattcagctcaatatgagaatagatataacttgtattaatacttaatcgttaaatactcatgagttctattaaaattctctggcaaaatactaccatgctttccttccagtggactctaactcaagattttggcagagtctgactgattagcaggcttttcccttcccaaccacattactgagcacacccaaatggagctctgggaactcactgtttaaaaaatattactttacaaagcatattaaaggcttgtttagactatctaaaggagatataactcgaggtaatggagtgtaatagagaaatatgaaatgtctttaaaacaaaatcacttaatatggagttatcttccctattcataactatagatgaaagcatgaaattgaacaaatttgtcacatagctcaaatccacttttaaattaaaggagcctccccatgtgtacattgcatatgctcactgaaccacttcatgaatggtcacataagccacagcttaataacaacaacttgcagatgtaagtggtattctctttcactcatcaccatttacaattccatcttcattcagagaaaggctgattagagaaatacagaagatgacttcaagttccaaactttgaagagctctactgaggctcactagaggttctgcttgaaggaaacaggtgcaagcagaggcattcattcaataattgttaggtggatggatggatagacagatgtatgccttctaaagaaatacagggttgtagatattcccaaaggttcaatgactccagacattctagtgatatcaaaaatttgtatctccactgtcacaaagataccccagaattaatgaacttaaataccctgattaaatctatcctgcacaggactaagcacaagtgatcttaataaacatttttaataacaataatcctgcctcactcataatacttgtttcaaatagtctgtctccgtttctctgcaacccacaatttcctaccccattccctttaaaaggaaataataaatattcatttaaaaatggaaatcctcctgaaactctcccagcactatgaactaatttttaacattggctcatctctgtcctatatatagttaagtgtctaacaccataataccaattatttattcacgacagtatcacagattttatctaaggttaaaagacaaagaaagaagaaattagaaagctctttcagaaagacattgtggattcacaaatttaggcttatgaatacattctccaggtagaaacatgagaaaattatcaacataacttcataaatgattctaaccataaagttcttctgctattttttacacagcaatcaatgcactgtagaaagctatattgagtatttacttgatcaaaggaaataaaatattaacaataccaaagtgaggaagacattcttaccaccttctttagtgcaaagattgacaaggttgtggactgtgtccatcagctccagttgctgcttctgaaggacactgttgttggtggtagctctgtttaattgcttttccagctcctggattatatatgtttgacgagtaaccaagccttgaaggttctctttctcttcctttaaggtgtccaactcttccttgtgttttccttccatttctaagattttatgttctaataaactacaaggaagtgaaaataaaacttagatttgaaaaaatgttatacaaaaaaacccttataattcaattggttcctgaatttatttaagatgagaaattttacatttcactgtaaaaatatttttaagtgagagacttaagaatatgtattcttcagaataggagttacacatataacatgtcaaataaaaaataagtaaaccagatattgtcagagtaatgtttgcttttaactatgatttagtttcttggtttccttgggtgtatcttatatccaaggtagctaacttacacccaaatagctacactctaaagaagttatagtataactttcactaaagaaatgggcctaagaggaaacagaatagttcaggaaaaaaacaaacaacacgtagaaactactttttattcactttgcttcatttatttggggttttcaaaacgttaacattgactaaatttcacgatagttctgtgggatcaagaatagtatattgaccatctgcaaaatcagaaataaagagaaaaatatgaaataatcagaaacacaaaggtttatgtacaatgacattaagaaagaaaaaaatctcttattttgaaactgttgaaaatatttttaatcattttaaggatattagaaaatgctcaaaatatgttaggtgaaaaaagaaaaaacagcaatatacattctcaatcacacacacatacaaaaagaaaactatattgacacagaaaccacaggagccaaaagtgatctatctaaagtcacaatgaattcttgtgatttttgataactggtcctgtatcataaccactagcttcctttatttctcaactcaagcttcaggatgaggcttaatgacactacaagttcccaagtcactgtataaatggtaacaaaaggaagactccctttggctgatggtatggtcttctgaaaggagttgggatgctttgctcagagtgttgaaatctttaactgaggcccttccttctccctgagctctttataggatattccccttgtatattgcacattaaaaatgatagagaaagcagaagcatttttggagcctaccaactgactggaaataaaaagcattaacattttatggagtgtctaatatactagttttcctccggggaaaggcttactcggttttctcagttctgttttcagaaggttcaacccgtccttagtttacaaggtgttattaaaatgccacataccagaatgggcacttaatttaccttggagaaatacagcactgaatcattcctttcaaaaaggggacactagggagtgttttagattcaatacttaaattataaaatagagcatgtttgaagagccaaatcttccaacaccaggtactgggggacaaagtgtaacatctgattgtcttttacacagattaagaagtgtgggtccaaggcttaaatggcataaaagactgtgagggaatcgagagaagtccatgtggcagaagctgtgccatcctggtagatgccagaaaccttgtggatggatcagcatggtagatggtgatgatgatgtcaatcatactagtcatgatacctctcatttatgacatggttgctatgtgtcaggtactgtttttttgttttgctttttgttgttgttgtttgtttgttttaagacagagtcttgctctgtcgcccaggctggagcacagtggcgtgatcttggctcaatctctactcactgcaagttccgcctcctgggttcacgccattctcctgcctcagcctcccgagtagttgggactacaggcgcctgccaccatgcccagctaattttttgtatttttagtagagatggggttttgccgtgttggccaggatggtctcgatctcctgaccttgtgatctgcccgcctcggcctcccaaagtgctgggattacaggcatgagccactgtgcccggccagtgtcaggtactgttttaagtggttgttacgagttcaattatggcctgcccatgcttgccccccagccaaaaaaaaaaaatatgtatatatatatatgtgtgtgtgtgtatatatgtatatatatgtatatatatatgtgtgtgtgtgtgtgtgtgtgaagtcccaacctccaggaagtcaagaatgtggccttatttagaaacagattcgttgcagatgtaattagttaagatgaggtcatcctggaggaggatgagcttctaatccactatgattggtgtccttataaaaagggaaaatgttgagagacagatcagatgtgcacacagggaaaaggttgtgtaaagattggagcactgctgcctcaagccaaggaactactggcaggtaggagagaggcctggaaccgagtcttccctagggccttcggagagagcctagccctgcaggcaccttgatccttgatctgggactttcagcctccagaatattcagagaatacatttccattgtttagaagaagaggaagaggaaaaagaagtgtggccagaactactcctgggcattccaaatctttgccaacaaacttgtactcgaagaatatggcaggaaagctgcctgtgaagtcaagcctgaaaaatacctgaggctgctaagactctactaatttataatacctttagtagtgtgcacacattcacataagaaagtttctcattgagacccattagcagaaactgtgtgacttctgcagtagaagtcccatttctgttttgaattgctttcattctaccaataccaagagagaaaggagccctgccctgcaccgatcataaagtaaacccaatttagatagagcttgggtacagtaatatagggaaactgtgatgatcacttattttttaaaaattcttttggaaatgaaaaacttaggcaaggtaagcagtgtaagatgaaaaacaacatctgtaaggggtaggtatgattcatcttcttttaccatgttatttttctttgccagtaactttttgttggagaagttcgtggtaaaacacaaacaaaaacaaaaaacttcttcactatctttattggttaaaagtttcatcccacctactggggtaggcgtcaaaggagatcttctctgtgcccattaatttttggcctttagatctgagaattaaccacgaccagtgtcttagcttattctctgtttactttttatttacttttcttgctagtcctggggtaatgatcagaggcaagatgcccataatttagagttgttaacttataagaaaattgccttttaaattcataggcgttatagtctactagtgagaaaacttagcattacctattaaactggcaagcatgtagatatcaaaatttgaacgttatagtcatataatactggataaaaattctgaattaccattttgtacttgaaataagatgggcactggcctttcagttttcctaatcagtaggtaacattctggtttggaaaatatcatgctatagttataatttgtatttattagttgctaagtgccaataattctgtaaaatataaaatgacactattcttactctagggtttatttttagagaataaaaacctcaaatgaaaatgcagaagctaaaagaaacttctgtttcagacataatactttttttttaaatttttgcatcagtgtttttctgtttatttttgatgtattccttgttcaagcggacatatgcgcagagatagctgctatctgagatgtcagtaaagaaggtgggcttgtttgatttgttttgtttttcaggataacttggaaagagctgagaatggaaagtagatcaaagaagtcctggtactaaaggaaacaattctggacactggcttgtggaaaagatctgcttttctgagtaaaaggaatacataatatgtataatatataatataacgcacattagcacgttagacagaacattaattttcataattcatcagacaacctttaatgctcccttactagcaggtatcaaaagatacccatatagtttgtcatcttagaatagacagtgcatgtaatgtgaaaaagagactgtccatggaactaagaaggctactctacagcacagacattccacaggatttggaaacccaagtaatatgcataacaactacaagcaaattggaaacatgttacattgtttctctaatggcaagtcttaccagttaattatctcttctcatcattttctcatcacatttcttcacttggagcgcccttaataacatttgtacttcagtaattatctaccaactttatttattagggacatttttcatattaatgacaactttttagacttcttcaggcaagactgatctcttcttgacccttccatttcttttgactacactcatccccttttttcatcttctcttcatatttggcttccaaaagactgctctcttctctttgattcctcccatttattggctagtatctactttggaagtcagcccttccttgtcattacttccaaaatggtttcaatgcaaacctcacttgccagaaaactccatataccatctctacttattatcttattcttgtaacacaccattatagttatatagcaatttgaaacctttatctcctttgattcttaaagcaatatagtaacatagaatgagcagatgttacagaccctcatggataggtaagaatcaaatgttttcttcaaaatcatgcagatattaagtgtcagaaccaggaataaaaagccatgtcttctaagttgttagactggaaatctactcaagacatcccactgctgtgtcaatgaacatcctatagtctcatctctttgacttaacacactataatctcttcctattccttttattcatcatgttataccaggaaccaaggcactgccttcacatatccttaatatttgctgctctccatttagttgttctgggagcttatccttcacaatatttgaacctgtttatctttcccacgtataaaaacagaattactttgtcaagtcgatttttaacatctggactagaattttcttaaatactaccctgtcttaatacctcttccattaaatttatgtgttaattttaattatattgttaatatactgctcatatttcattttgtccctgaagcctttcattgattctttactattttcgttatccaggtccgttgggagtggccacctcagctagcatggggatctttatatagagaggttgatatgaaggacaacactgcagccccagtgtcctaaagttagatagtcaaagtagtcagattttccctgatgacagtctcagctacatgtttagcttaggtttgcattttaaacacaaaacctggatggttactgaacaccagtgcactgtttcctagagcatattcagtatgttctttgaagcaaaataagagtttcattgttaagatttagggaggcctatattaaacaaacagtttttattaagatgcttcttttaggattagggttccatggaacaacactttatgaaaccatgcacctaaatctatacaaattgagctagaaatccaaggagagagtttctcacaggagtcttaggacttcctgtttcccgtctttctggaaacactttgagaagagacatgcatagaattctggcacttagcttctatttgaggcagaggtgcactttaatgaataaaataaacaaaataatctgtgcctcgaactttagtaaaaggttctaaatgagtgtacagcaagtcctatttgaagtttctggtagacttctccatacccctgttttacactgccttctccaacatcttattggaaatatttcaaatcattgaacatatcttgaagctttcacagaaaaggatatccctttcaaattgtttcccacaatagagttcttaacatagcagccaatgaattcacagtggtgacagttgcctaagctctatgagtataaatatagcccttcaaacaaggaggaagatgttgaaaatatagaaacctcatttttatctgtctgaatctatttacagatgttccaatattttccactattttcaacatgtatggtgtcaacatgtgttgcaaatatgggtttgtaaagagtaatttttctccccatttaaatacacacagatttagttcaggttaaatttatactttacgtgtctaattggaatgcaataaatttcctctcaaagtctgaaatcatatttgtttggaaattcaaatttggagtagaagcatagatactataagtaaatattggcaaataaatgtaaagtttggggtaaagaagaataagctaaatgtattataaaaaccagcaactaagaaaaaaaaagattgatacatttcataacacagagatgtaatgtttctattaaaaaataagttggacaataaataataaactagagaaaattttgtaacatatattacaaagttttaatatccattaaagagctcatatgagttaatttaaaaaaggataaacaatatagtagaaaaaatgttaaacatacgtaaataggctagtatgtagtcacagaaaaagaaatctagtcacagaagaaatgcaaatggttaatacacacaaaaacatgcacaacttaacttctgaagaagccgagattaattagatggctagcaaagttttgggaaatttgaaagcccaggtactcttagggagaaggtaaaatgtgaagataacttgtgaatatctataaaaaatttaaattatcacatcactaattatagttttgataaattatatatctattaacataaataatacttataataggttataaattatagtgcatctataaaaatagattgctactcattcttgaaaatgaatgaggtatatctgtttatggttatatgtgtaatatatgtatgacaaattattatgaaataaatagtagaaaaaaccccaatgataaaataatctacacatatatgcacatatcatataaacaagtacttgtgcatgtgtgcaattatatatgagtgtacatctgtgtaaacacacacataaatatgcacactctatatatacacatatgttagtatgtttagagaaaacatctggaagagtaagcactgaatttaatctcttaatgatgattctctgctagcaggtggtatggtgtaggggtgtggaattaggggaaatttgacttacaactgtatatgcatgtatataatttaatatacatgtatatacaacaagtttgtcttacttgtttttatttatcatagaaatggaggaaacagtcataggtctagaatggcctgtgcaaatgctatccagaaattttaaaggtgggctgaattagtgaacctcagagtatacaatagtaacattgagtgccatgcaatgggcttttgacaatgcagaatagtggtgtaaacacgatctctattttattcatgttgaaaacgataaatggatttacagtatttaatgtaaacaatatgatttgttttttccactataagtatttttattagttgtgtgtgtgtgtgagtctttgtgtgtgtgtgagtctctgtgtgtcgtatggataaatggcatttgttgggttagagctattgggacatttcccagttccttattcatttagcattcaaaatgcatttaatactaaatatgcttatgtgtagaaaattgtgcccgggagcaggaagacaatgaaaataaaacacattctctgtgtcctagaaggtcacagcctaatagtatggatatagataaataaacatgcacacacagaaacatacatatattataatgtgatcagataagtgaaattatggggaggaaacaggtacagggctatcacataggtcataatgagcaaatctatctggtagagccagagacggactgttagagaagctgacacatgcaatgagtttccaaggatgaacagaaatttgtgagttgaataaggaatgtcaggcaaacatcaaatatgtctgaaataacatcatgtgttcagtgtcatactaacaactaacatgattaaacactgctgctcatgtcaggcactgttctcagtgatttacacacattaactcaatcttcatcttaacttcatacagtacaattattgtcattgttatgttacaaattaggaaaccaaaacacatagagtctatgtaagttgcacaaagtcacacaaataatatgtgacttagtcgattatcccaggaatcaaggaaaagtgaaaccaggcagtctggcctcagagctcatgctcttaactattagcgtgtatcctctaaaaaataagattattggaagtaagtctgcaaaagtaagattatagtgatcatggactgtattgtgtgctaaagaacttgaactctcttctatcagttatagagaattgtcatttggttgagagggaattaatagaggaaaatagtctgacttgcattttagaaagaagactttggcacagcttctggataaggactggagtggcacatagcttaaacccagaggtcactgcagtggcctagacaagaattcatggcagcttgacctaagacatagtcagtgggaatggaaaggatgggacggattagaaaaatatttagaagatggaattgatagcatcaacagtgactggtgagttgtgggggattagggaaagagaagaattaagatgagccttagatttccaatttgatcagaattgtatttcatgccaagatactacggttattataatttaaaaaaaggaaaatgctatatgctattaaatattattttaaaaattaacagggaaaaaaggtaacattctagtatgtaggtgttctatttacaagaaaaagactagaataatataaattcaaaaagtcaccttttttatccttgttataaacaactaatataattcagcctagtttaatgttagaagttagcaagttactttagcattttgtaaataatttatcaaatgaaagatagctttaatttaaaagactatgatttcatttttcatttctttaggcatattaagcattaaatatcaatactgtattttattgcaataattagtaaggcataatttggtatcttgaagttgcacatgtttcaatcacttaaaattaattaacttaataacttcccataactccagctagaagatagatgagcatgtcaaataagttcagtgaattcccaaggtaaaataaatagtttatatcttctgctctaatattagaaggactaaataatgacctatatagtgacaggccaaaaacaactggtctacccctttcttcaaatgaatatttgtttgttttaagagaataacttgacaactacatcaattatacttgaggcctcatcacattgcaaaaatatttttataataattaaggcagagaatcaccatgaacttgaactctaattttgccatatccttagctgtttggtcataagcaacttacttgatttctgtgagcctcagggctttttttaagtgtaaaatagaaataataatacatactttgcaggattggttggaggattggaaatagtaagttaaagcacctggcacagatgtttaccttgtactagtagctatgcggcagctagtattgctcaaactatgtaggaatggccatcacatgtctcgtttcagttcactctgaacggtcttactgaagacttccttaatcttcactctgcatactcagcacaatcaagaaagcccgtgtgctccgtctttgtatacatggggttttgatttcccttcctgtataccctggtgagacagaagggctccttctggaatattctttagcctggctttgcttccgccttgcaaaaagttggggttaagtcagagatgggcgggtgctgggaaaactggccagttgaccaaacctttcgactaacagacccagtcacatatttggttcaactgaaggaaactgcattaggacatcatttcctgtacacctctattccattgttttagaaagcagtaggaaacatactggaggaaactagtgaaagtttacattttgtgtcctactttgtgttcatctcactccctttgtgggcaaggtaaaatattaatgtttcccatttacttaggttcttggttgtgtaattccaattatatggttgagttacagattccttactcccaagtgttgtttctttgaggtaagaaacaaaaccaggttttaagtttcgggtagcatccaacaaaagaaaaacatattgcctaaagagagcaaactggaagctttttagagtgactccctctggactgttaggaaaacaaacagcagagcaaacgttgctaatcctgtttctgctttgtgcttctggccatgtaggggatagagaagtgaatctcatgaggccaaaaatccatttccaatcctacaagtgatgcatttaatttgtcaggatgtaaatcagcaggacctctcagcatgtttgtgtagtataatcctaaccataaaatattcctcctcattttgccaaagcagtggtggaccttcctaagggccagctcactgacttggcggctgaagccccatcttactcaaacctggtaagtcccacacccagacacaacccctgacattccttggggaggaaacaaagcttaatttagataatcccccctgcaaagtgtattagctgatccaaaccagacctgaccaactaaaggcatgttgttgctgcatttcagagatgccttaatgtagaaatagcttcttgttgcatttggaggattaagattcatataaggaataaccagtggtaatcgataaactatttttttaaaacataaacagcttcatgcttgactttgaacctctctccacttaaataggaggagcacatttctttgttgcaatataaattgcctggcagagctcccctaattccattgcacatatgaaaataaacaataacaataaacagaatagggaaagtatgctatgtatcacaaatgggtattttttatttgtataaagaaaaacacttctcttttttttaagttgtttatggaagactatgtctaatttaagaacagatgttctgccaatactccatcacacacattaggcccttagacaagaagatagacagataactatagagatacagcaataccaggaggcatagaaattgatagaaaaataccccagaaccacatgtgagataatgccatacttgaggggtccactgtcgaaaaagaaagagatgtggaatggaagtgtaagatgcatgcaggtttttgtctgtgtgagcacagaaatgaatttccaattaaaacccaaatctctgaatttgtagtgaaatacctatattactagaaaaggaaattgctataatcctgaaaaaattaacattagcaataaatgatgtgatttacacgtgtaagaaaacctgagttttctgttgaaattagaatttaatgagaggggaaagttcatcagcagaaggcacaaatatgtttgggatcagaagtcagattcctttgagatactgaagtgcatggaagccccttctacctgacccagagtggagctcttttgagagcttgcaccctaactcacttttactgatagagcagagagaacaactttaaagcagtttgcctttaaaatataatatttcatagtgagaattctatagtaggaaatgataccagatgctgcataaaaatcatgatgggaagacaagaaaatctgaaatgatccagaattaaggtagaaaggatacatttttaagaaataaagagaaagaaagaaagaaagaaagaaaaagaaagaaagaaaagaaagaaagaaaggagggagggagggagggagggagggaaggaaggaaggaaggaaggaaggaaggaaggaaggaaggatggataaatatgagaaggagggaagaaaagagaaagagacagagtacctgagtacaagtggtgcataaggatggcatttgttttgcagttagggaggagacttttcaggcctcccagtttatgttatggtatcatgacagctcaagggtcagatacagacaaagatataatatgcagatcagtagggaaaaactaaagaatgtaaattcatgctggcaactctttcagaaataaatcaggtggtaacataactactgagagatggattcaaaccaccttaggttataccagtaaaatgaaatatgcagttattaagaatattagagaatattttattaatgtaaaatgacatctatctccaaagaagtcagacttccagactgtgtgtaaggtatgacagaactttttgtgaaaatgatatttatatataaaatgcagcaaaatatgcagctctttctgtatgataaagctgtggtttttaattttcctgtgtgtttttttttgtccttatgctataataaacgtgctattgtataattataaaaccaaacgacgactcagaaaaataagggaaaattgtcatcgttttacttatccatgattcctgggcaaagccttcacaaatagcatcttgaaatatgactgtaaatgtggttcacttttggtgacaaaattaaaccataaaggggtgaccctagattaaggggtggttgaagcatacctattacatacatgtataggtctggttactgtgaaattgcaggagaataaatggtatatttcaacaggattgttagttctagaacatttaatcatgcaataagggtcaagtcctgtcaagtttatttgtagttatacagctaaccccatgtcacagtacaaggataaataaatgtaacacttagaaatacaagtcatacagcatgagtgacccctttcagattctaaaccaacagccaggtttgtatttttcatgcagaagtttaattgtaattgttgcattatgctctacttttagcatgaagttgggaaattcttttagtttgtagataatatgaagaggccatgtgttatagtggaaagatcctgacacctaaattacattccaatttcggccactagcaagttgtgtgaccttggacaggtcactgccttccactgagtctctgttccctcacttgtaaagaacagaactagcagtcctcttaggtgccttcctggtgtggaatataaagggaactctagtgccaccaattcaatggcatttaaccagtttctatcaataccatggtcttcacctcaatattatgcataggaactgaaccttcttcaagttatctagataccccgaagaaaaatcaatgtaatgcaagaaacttgtcctaaggaagtcagtgttttgaattgttcatcatcaatgttaatgacttcaaaataatacactctttcattgtcccagcattcaagatgtctaagttccaattcaatcaactgaaatgattcataatttataaaacaagatggtgtgatgacatctataaagctaaccaaagaaatttactatgtccaaagtaaatggctgtaaatgacaactaaaaaaccaaacccttgatcagctttataggtaaattattttctagaaaaaatatacattttccttctctctagtgctatatttctgaattcaaaaacgctgtagctttgtaaaagcctaagaattggggtttgagtaggaatttaagaggctctattctctgttgttataggttttcattctgctgaaaaatgtcaatattttatgtcactttatttagtcatagaatcaaatttttgtagatatggtgagatttgaactactaccattagagaaattaatgctaaaagttatataaagcaaatatttcaagagtatcagcaacaatattaatttattcctgacatactagctgaatttaccttaagctctcctttatttttatattaatattaatttggctctatatttcatttttgtaaaccacctcaaccttatttgtttaagagttggcagagaggtgaaggatataaataagtacacacagaaacatttttggaataaagcaatcctcacctgtttttttcatggatcttcaagatttcatttgtctgttgaagaagttgcttctctagcttgtaggtggataatgaattctccagcagctgtatctcaagtcgagaagtttgatttagtaccttaagataaaagatgaaaatatttcaaacttcagtcacgaatcaaagaacttttttaagttttattttgtcgttaaatattttttcaagaataatttaacaaatggtttaccgccgggcgcagtggctcacgcctgtaatcccagcactttgggaggccaaggcgggtggatcacgaggtcaagagatcgagaccatcctggcaaacatggtgaaaccccgtctctactaaaaatacaaaaacttagccgggcgtggtagcgggcgcctgtagtcccagctactcgggaggctgacgcaggagaatggcgtgaacccgggaggcggagcttgcagtgagccgggatcgcgccactgcactccagcctgggcgacagagtaagactctgtctcaaaaaaaaaaaaaaaaaaaaaaaaggtttacattctacttatattctaccaactaatgttttacatgcctttcagatattattttggtttgagattgaaattgcaattgaacaaacatattgtgttttaggacttctgtgtcctaaaaccctaggatattctcctgtgctagttgcttcatatattttatctccaatatctgtaagtgcacgttagtattaagtacaaggtcttagatattgtgaataattaagaataactaataggcatgtaaaagatacctgccttggtggatcacctggcaaaaaacaattagaaatgtgcaaaattctcttgacatagtttagaaagactcattatcacacatttatagaacgcctatcacactaggtaatgctagcctttccggatatcatgaccacctatcaaaggagaaattgttatcatcactttacaaatgagaaaactgagcttcagacagaagcccaagttcacacaggaaccaagggaagagtggggtttcaaactcaggtagttttattctgattctgctgctttgcaaagaaaattaaggagacggtgagtcaaaccaatctgaggaaatgaaatgacccagaacccagattgtatgagagacagattgttctcatcctttcaacaccactattactactctggtggtcctctagaaactgtgaaggctcaattcatcttgaatcacaatgacccatgtgtccagctgggccttattatgacatgagtctgtgagctgtgcacctaaacctatcattctccaggcaaagaatgcacactccagtcctagcagatgccttcaaattgtgtcaatgccctgttcctgactctttcttgtccttccctctctttactccttaagggaggtataaaacaaagaaagaagataaattaattttaaaagctcctcacattatttgaaacattttttaactaccacatctttcctaaaactgcttatttaaaaggacctggaaatacttctgccaggtcaatatcaatgtaaagttcctctacaaatgatgccattagagccgtcctccttttctgcagcgtctctaaatctaggattacatcagatgcacacagaaagtctactcaacatataccaacagggccaggtgtggtggctcacacctgtaatcccaaccctttgggaggctgtagcaggtggcttgcttgagctcaggagttcaaggccagcctgggtaacacggcaaaaccccatctctacaaaaacatacaaaaattaactgggcatggtggtttgtgcctgtagtcccagctactcaggaggctaaggaaggagaatcacttgggcctggcaggcagagtttgcagtgagccataattatgccactgcactacagcctgggtgacagagtgagaccctatctcaaaaaataaaataaaataaaaaacaaaatacaccaatagaccctgggctggacttgggctacaggaatttgcaggagtaggggatgtatttgaagggagcaaggcaggaactaggctgaggtgagagaggcaaatgcctcagttgcaaaacttaaaggggtgccagaaatctcagtaatcaaggtaagtaatattttaatgtaacatttttaaaattttacaattaattcaagaaatccacatttaacagaatatcatttaaaaataaagacaggatctgattctgcacatgtatgatttggtctgatgtggtctcacttgcctcaccctacagtcctagccccgcaaggggtggaacaggagggtgaggaggggatggggcagagaatggtgagatggagcatttatactctaaaaaagtttaaactgctatgactcatttatacagtcattagtaaggatctgaaagcccgtctaaaatgtactactactaatcatattcatgtttgtaaagggtttcagcgttttaaaaaacattttttctattctgtattatttcatttcaaaacaaacaatttgaaggtagagtttggagtagctcagtggggataaatggtagagaatataaatattggagatgcacaagatataactttcaactattaaacatattattgtccaagtaagatttgtatttgtttattgagtgacaatttataaaataatgaaatagggaatgaaacacttgtatgttttggtgacatttagaacaaagcttggcacagagacaacactcaatatttgtttatggatactcagtatttgcttatgaggtacattgtctcactaaatcaagcatatcatatgcagttaaatgaaatctattttctttcttattcgccgtactctctgatcacagttcctgacattctcagacaccaaaaattttaatttccaaaagacagtaagtattctcctccatgtccattgagaacaaaatggaaccatttaaaattgaaaacaaagctgcccatatctcagtctggagaccactacagttcccagtttgtcttccttctcctacttgccctacctcaagtctatttgtcacacagcatccagagggatctttttgaacacataaatcagatcatgccatctcctttgcaacatgctaatggcttccctttgcaattagaatgaattccaaagccctcagcctggtctgaaaagacccacgtgatcagaaccctgttcacttcttgtttattatgctccaactacacagtcttctttctgccacattgactagccaaattcattccaatcttggaagatttgcacttgcagtttcctctgcttggcatgcccaccccttcctagatgcatggctgatttcttctcatcatcttagagagtccctttctggccaccttctttatagtaataccttcctcaccctccatcacatcaccttatttaattttctttacagaattatcactattgaaaactatcatatctattcactcatttgctgtctttctgcccctcctagaatgtcagctgcacagaggcaggaaggctcatctggagtcctctaagcctccagaccccctgggggcctaggacactgcagcgctcatagctgagttagatgacattctgggcaatggacagtgagctgtctttcaggcttgagtcatggtcacagaaagggtaacagggccgacatgaatatcaagttagaggtcagtgatgacagtctaaatctagagcagcatctgaatataggagaaggaaggagtccaatatcagaagtccaggctaaatgccgatctaaagatcagggcagtttagagcacaaatgccaatccctcctcttctttccccatcaccttgaccccattgctgctttatttcaactctctccactgatgtattaaactaggtctgaagcgggcaaccaagagaattgcatagcaaactatgataaattgaccactttcttgccatgcgactatggaattcgctgcttagcaatagttgaagtgttccattaaaatgacaaaagacatttccttcttagcctaaacacattccaaaagcacatctttggggaaaaaaaaagaaaatttttaaataagaagaaggaaaaggagtaaagcgtatgtgaaacatgcccctcaaggaacaatttcaaagaataaattttccaaaatatacctaagagtaagagagacataaaacctgaaattgaggatttacgggctacaaaattttagttcttttttttaaaaaagtaaacatttaaaaatgaaaattattagtttccaagagaaagtgagctggaaaatttcacccagctccctttaatattttcaagagtgcctctgatcctttaaattaatattaatgctaaaagtcagagattgaggtagaaagaaaatctcttttttttagagacagagtctcactctgtcacccaggctggaatgcagtggcatgaccacagtcactgcagcctcttgggctccggtgaggtgtgcccagcaattgtttgtattttttttttttttgtaaagacagggctctgccatgttgcccaggctggtctcaaactcctgggttcaagcaatctgcccacctcagcctcctaacgtgctgggataacaggtgtgagccagcgtgcctggccaaaaatctctttcaacgactcattaactttgaaataggccctgtttttagggttatgtttccttttgctttatttttttttccaaagaaaaatttgtaacataaaatatgatgccttggcaattaattctaacagaagaattaaggttgatacatgcagagggaatgagagagttagaaaatcagcattttgcaaaatgattgaagtaatttacttggttaataatggacaatgtgaccaagtattaccctacaggttatctgttaatttcctagggaaaaatgaactatcgagatgcagtgatatggaggttataaccctaaccaagttaaagaacagcataactaagggagtggcaatctggcatatgtgtctcctgaagagatccaataggaagtgaccagtaattccacagaacacctctgccacaatattccattcaacctaaaccagtctttagactcaacttccagtttacagaaaccataggggattgaagggtaaactaaaggtcataataaagaaatattcagacaaatgcagaacgtgaaatgattgacaaaacagcccagtttcttaagaatgtcaatatcagggaaaaaaagtagaagactgctccaaatttaaatggactattaaatcttgaaaaacaaaactcctataaaagttttagtggaaaaatgagaaaatatgaatgtagaaattagataatcttatggaattattgttcatcttagttgtgatgtaatatataattaatattatataactattacataatattctctatttatttatatataaatatattttatttataatggtaataccctcattatatatgtatatattataacataataatataaccctatattatatttataatataataaccacttcatttggttacagaatttaatagagataagacttatattacagacagagaactgtgggtagaaataactctcccaatacagctaatgctcagtagagtcagaatgcaacccagagagtctatctccggagtctgggttgtttcccacaggcttatcgagtagctgtaaataagcagcttccctctggttagtgacaccctctagtcactaacaactgctaccaaaatggcttctttcaagtcgccatgaggtgctctgcttgttgcagctgatggcatccaactctctctccctgcccctgccccctaaattagcatcacgagtaaggaaggagtccaaatttcttatgcttctcagagtacggaaaagaaaaacaaacaaacaaaaaaacccaaaaaaacattcactcagtgttcttagttgggtcagacatctttgcagtagactgcttctgttcaaagtcctcttctgacccatcagctatttgtgggtacctattacaatcaacacacaagcctcagcatattgccctcaggcttggtgacattgggctgaaacctgcagagattaagggactaaaacttagtcaatgtaattatttcacaagtatttattgagagcctatgcaccagtcctgttctaaatcctgtcgatagagcagtgaacaagaacaagacagaaacatccctgcttcttaggaatttatatcctagtgcaggagttggtcagatttttctgtaaaggcccagacagtaaacatcttaggcttggtgggccaaatggtctcttgtgtaacaatttagctccaccattttagtgaaatagcagccatagacaacatataaatgaatgagtgcagctgtgtccaataaaactttatctacaaaacaagatggctggtcaaatttgacctgtgggccataggctgctgagccctatcctagtggcttatcaaacaattttcctaaaccttgtaagaaaactaattacaggatattttccttagatgacccactaaagagtttgtttcatcatttcagttaaaagattcatgctcattgaacaaactgttcctgaactgcctaatacacacacacacacacacacacacacacacacacacacacacacacacaagtgtatatatatatatatttaaagatagggtcttgctctgtcaaccatgctggagtgcagtggtgtgatcacagctcattgtaaccttgaacttcctaggttcaagggatcctccagccttagctccgtgagtaactaggctacaggcacgcattaccatgcctggcttttttttttttttttgtagagataggatcttgctattttgcccaggctggtgtcaaactcctgggctcaagtcatttttccacctggctcttccctaaagtgctgagattttaggtgcgggccactctacctggcttgccttatatttctaatgagtgctattgaggtccaaacggcagatgtaatcatttgtgatgtctgaaaagatgattaaatgggattaaacatgcaggaaatatattaggggaaatgcccacgaggaaaaattgggaggaagccagaggaggtttggagaggcttcagaccgggatggtctaattacaggaaagaggagagggaaggaagaagagttgggtggaagtcttatccctcaaggcagccgtgcaacagttccagcaaggctgatgaagagcccctagccaaagtcatgtgtcagtggacttctacagctcccaggagcaggcctacatatccctgccacaatgagtggaagtgactgctggaaattgtggtctctggaccaacacagcaatggatttcagagcacagccattggtgagcactggtcaattatacttccgcaagtaggagattggaaaggtacatctttaaggccatgaggaagggctccacagatcattaatttgactgaaagttaagaaagaaatgacttagaagcattttgccacattaactcaaactcatgaaggtaaagactgctttatttgttgcattctaataggacctattaaaacatcttacatcaaggaagtacccaaaggcaggagtggttgctcatgtctgtaatccaagcactttgggaggccaaggcaggtgaattgcttcaacctaggaggtcgagaccagcctgggcaacatagcaagacctggtctctacaaaaaataaggaagttagctgagcatggtggcacacacctgtagtcccagctgctcatgaggctggagtgggaggatcacctgagaccagaaggttgaggctgcagtgagccctgatcagccactgcactccagcctgggtgacagagtgagaccctatctcaaaacataataataaaagataaggaaataaacataggatggtatatcatctaccttatagaattcattattattattaaatagccaatatatgtaaaattacttagaactgaggcaagcatggattattagaggcaaattttaaggcaatttgtttgtctgttagtttccccaaaaaccaaatttgcctgagaaagaagtgagaaatagaatgacactataggaagtgacatgaataattcctcctacaaaccccttcatattgtactcttggaaagaggaacttgaaggccaagagatattggtacaaactgataacagagtgagaaaaacactgcaagccagactaagggggaaggaaaaggcatggtggtggtttctgattcttgccaccatggccagcagagttattcagatgtggtcattactggtatctttcctgatcatgacacttttttgagcacaagaggatcttaaaatgccattggcatgaacctgtggctttctgcattttgttaagtcataaatctagaaggtcagcagaagattagaaagcaataagttaattatttcataacatcatcatgtgaaagctagtgcattaaaatatattggaaagacattgtcatgagttcctgaaataaactgaggacctgaagtcagttttaggaaaagcaacacttaccactgtgaagccaagttagatgaatataggaggaaaaccatgagagcatgcctggatagcacagaaggatctactggttttataaatgcttattataaatgaatagagtgtatggaggttaaggaataattcaggattacttttgtaaacttggctctgaatcaggatttgagttcacttgagtgattatgtctaagcagaacatgtcctgttgcaatagttcaaataagtagcacgagggtatacatttacatataacaggttcgaagcatcacagctacaaatagcataagcaattggaagacatgaaaatgaaagtgaaaaaaacacataggcgtcacttcttaaggtagggcataatttgagccattgtcatccttttctacttccctctcattgctacttgtgatggatttgtgatttttgaaatgttttctgggtttcagctatcttaaaattgttctcactgtatctaataaactttcattggtctttgatagtaagttttggctgcttcgtataaggagtagttattctttttcattgaattttctgtaccattttcaataaagtacacatcttctggccttaaggatgcagaacaatttatctctcaataccttacatagcacgcatcttaacagtttggagattaacgtgctaacaatgggacatttttttttcccacaactccaactgctaggtagacagagattaaaaaacaacccaagacacagtgttttaggggataaaaaaattaaacaagactctgccatgtgttccagaaaagttattgtaatagaaacttatacaaatttcaaatatgcaattaagtaggatatattgtgtatttgtttttgaacatgtgagagtattttgtaggagagggtgagcattctgttctaataaaataaaataaataatacagtcacattatttataccacaagaaaccaatgtgcatatattatcaaacttactgtgacaatgaatgattagataaagtcttgtaattttcagggacaatatgtagttccgtccatctcccatgttcatctgatgttgatgggcagcaaaaagtattttccaaagctaatgtgaatcactgccccaatgtaatcaatacttaagttcttattcaattagttaattattagtgttactaatcaagggagatagaaaagaaatgagtaccccagagtttgaatcccagattttataaactagctgcatgaatgtgagaaatcactcaagctagtgatttctagctaaaagatctatctatctgctctaagtgattttcataaaaaccatgtgtgcacgggaagttatgttatataggttttatctgtatcagtcatcattgctatttttctttaaataccaatctacctgtgatgccagtatcgcaaatgaaagaaaatagaaatcatgttgcaccttatttttgaacatatatatttcagctttcatgtcagaaatcaactacattgggatagaatcatcccttgggtttcagaatggtaactggaataatgattttcatggctaaaagggaaccaagagacaattaaaaatgacagtcatcaaaatgatagtcatcaaaaatgatatttgctatttgccagtaaactatgatggggtgtttgtgacaatggtgatcaaaggatatccctagtttttactcgttggtactcaaataagtacatcattggccctaataggtagatatatgtatatacacacatattcctcataacttcatttgagattgtcctttctatctgctgaatgcacaaaccgtctgcaggtgcccttatggctgcagcattaccagagacaaaacaaaacaggtcaaaaatgcacaacaaagacaccaatctgactcaaatggttactttgtttgacacatatcatatcacagttggtagctgcagtgcttatttgaatttaaacattgatgaggtcctttgctagctctgttttggcaaacatatgcaaagctaaatataccaaccctcattagatcaaaaaaaacacgcatagcatgtcaggcagtcattgttgttattaccaataaacaaaaatgtatgtttccctaatcacagtgctgaaatgtgctctgtgtttatggagaaagctaaagaaaaaaaaaatttttccttgttgagtctgtggactctggccctggggtgtacctgggtctcaacatctgtcagctttctggtctgctctgcagtctgagagaggaggctggttcctatctccagcatggtagccgtgtggttctgaactgcattctgctgtatctgggccatctccgacttcatgttttccacaatgtaattctcaagctgcaagagataaagaacaaaacatattacattataagcaaggcctcccagttcgggcatgtaatatttacaataacaaaacaagacaccgctggcaaatcagccatctggcggggatcctctacatctctgggagttggagaaatgggagcagagcacacaggaatccagttgtcaacaaattcctaatatactgatacatatatttataatcatcacaatcataatgacaatttgcacttggatcacactttcccattgttgacattatccatttagcctttatagcaaagatgtatcacagtcagctttattgttttgtttattttatagatgaaaaaatagaatcagagaggccagtgataaacccaaggttgaccagcaagaatgcagccaaattcacatactaatttaaatctaattcttggtgctctgatttttccgttacaccatactgaccacttatctcagaaaaattcagcctcctgcttccatttttgtaacgataaataaaatatcacactgctttggggaaatgggatgaggagtgggaggaaggatgatgtccaaaacaaaaacctttaaaggaatattaaaatataggcaatgatatatgaaatgagctgcaaagcctgagagctagctgtaatcattctccatgctcctttgcaagctcaaaaataggtactgaaagtacaacccatatagcagtatttactcctcttgctttgggtaatatttagtcctttatggtgccatcttagagaacagtatagtgctaaaataaatggtgccatagggaccatggagaatcattaagtgacttactgcaaggggtcctattaggtacctgggaaaataaagctgaacatatgcattgtttgaaaaatacaaggaaacctgcacctccctgtcagtgcatttaattcctccaccactgtgtggtgactacattttattactctactacacatatagggaaattgcatcccagagaaatcaggtccaaggccacacaccacaaaatcagccagacttggacttgagcactgaagtccttaactctcataccaacactttcaaccacttgatagctatgacaagtcgtgcttcacaagccgggttccaaatcattaacagctatgtgatttttactgatttagtgaaccataatacatccactatttcataatccatagtaaaattattatcatgtaataaatatagtctaaatgtaaattcccctttgtaaagctttggcagctcacttgctaacatcatcccttgcttatttctatttatcaagaacaaatctgtcccatgctaacaaaaatggttttcaatcaaactcttattattattaatacattctaaattcattcttggccaatataagataattccccttcattcatttttcccccaaattagacataggagggaaaaaaattcaacctataaaagtttattataaaacaaatacaaaatatattataataaatctctgaaaattatcaaaatgtaaggcctgtaggccaaatcttgactttattccaattgaactaacatatttaaacaacaagaggcaggtagagaaaaagagggtaggacagagtaataaaaatttgtcattttggattccacatcctatgttccctttttcctaatagcattctttaactttcttttgggaagttatcgttttgcccttcggaacaaatgcttcaggtagagttgtcccagcctagcatcacaaatgagtacaggttctaacttgtcaagccagaatgttctgctcctgcttcataggtgtgaattgttcaagaatggaaagacatcacaagcaaggccattagcctcagttctcaaattttatcaaactcatttataaaataactttgttttcctctgtggttaataagctggtgacatatgcccaatacagttgatgcccgattttgccaccacaaaaccagagtcagcccaaaaatgaagctgactcagacagatgttagataaggagattagatagatagatagatagatagatagatagatagatagatagatctatgtacatacatagacacttggatgcatagatagacacagagtcaggtgattccttttgagcacctggacctagctatatttttagctagttccacccttggacattcagttgtaagttgcatgatctaacagtctcccattgagcagccaaccttttttccccttcaatcacattgatttagatttttaacacttacaaccaagattttggattgttacttttgatcaatgtttagcagaagaaatttcagggaggaaaacgttaagagaatattccttacttttccagggaatttgaggttatacatgagtgtaagtttcttaaaaaattacagataagtctccattataaagataatagctatcatttatagctgacagttatcattgcctactatgcaacaggcacagagctacgtgttttccttttataatcacacttaaacttcacaattatatatgttatagctgctttatagatgagactattgaggctcagaaacccccaaacaacttgctcaagaacaaacaaggattcaacccacagctccaaaacccatgttgttaacctctaacctatttagcctagcactgatttgttatgctatgcattttattatatagctcttaaagcttgagtgttcatcaaaactacatggggagaattttaaaatgcagatggaggtaaaacacaccagaaatctttaagggcatgtactgggaaactgtatattttataaagcttcccagtgtaattcttattcaggtaaagaatcagtgcatctcaaagtgtggtccatagaacaactgcctgtatgagacctgcttgtgaacagtcagccatgaaatgaggagtttgcaccaggatgtaaattatctaggtcactaagcacactgtttagttcattcacttgatgtatatatatacaaacacacatgcaaaactttctcattgaagaaagtgatgctctagtttatattctggtgcaaacttcttaccatgtttcctaaatgacagcaatgtcattgagtaatactcatttaaaccatcaaatttactttgaaatatcagattccctgcttatcaagaaatctgtctttctatgcaaattttcctcctgagagagttcactaatcagtgagctccaatacaagatctgcttgataattgtacatcaatttcttatgcagttggttagcagtagtctgttcccagagtttgatttgctccaggtgtaataacaatcatgtaccctagtcttcacagggaggacaccctcagcataggtggctacatcaaggttcagtgtctttgtatcagctgttgaccattctgtactattgtgctttttttaattataaaagttaacaccagcaaagcaaaataactatttcatgctagcattcatcacaaccataaagtgcctctcagttctgctgaccctgttgtagatataaagtaagtctccaacctacactaaaatgctcatttaggctgctatgatgagtagcatgaatatagctctagttaattattttttaatcaaatggggctgctttctccaggagtaactgccttttaatgcaaaatctaatgccacacttaagtagcaagaaccagatgtagttgatttaaaggctggagcaggaggcagaagtcaaatatacaatgtgtgattaataaggaggactgctttcatcttatctctaaacattcctctgtagatgtataactgtgaaatccatcttgatgtgccatagcagccaggttcagaaaagatttgtaacaaatttgattgtcttcatatattccctactggttttaaaatatgtttacagaaaatgacagccacctcaaggttcaatattttataaacatctaagatgtgaattttaagcctagaagttgctgaccacaagagctaatgagttataatgtaggagtctctcaacctgaataataaaattatttgactatactgccatgccagagttttataagttattgaccaaaatgctaggaagagaatgtgatttgaaatgaaatgacaaacaataaatgattactttcaagcaaaaaaaagttgcatttgttaagtgatttaatatttgcatagcttttgtacacattgtctgacttcatccttataccaaacttgcaaggagagaactgattccattttatagttagaaatccgaggccttcagtgacttcatagaaatcaaagaaaagccagacatcaaagaaaaatctcaactctatcttctgatgttctactagcctcagagttgcgggaagtgttctgttattggactggttggctggatgattagttgactgataatttcaattttagtcagctattgcatattcattattataatatattataacatacacaatatattataatatttataatatttattcctttgagaaaaacatgcatcactagagggggattactttcacttggtttcactatagtggagaccaagttaatttgaggtgggatgagaagccctagggccaggtatgtggaaagtttatttgccagtacttttaatagaatggaatcattaaagtcctctcattagttcttacctttttttcttagtaacataagtttattttgtctgctcattctattttcttgccaaccattgtaaaatacaacaaagggaataacaataatacacaaagcctctacaaaggctagatatgtaccagcttttacaaatacgcagttcattgaatctttagaacaatccaggtactgtaagtattattttccttatttcactgatgtctaaacagaggctcagggaagttaagtaaactgtctaagatcatacagtgggtttttggcagagctggtatgttgctttgaggctagattgaccagtagcttgtgctccattctgaaggaatgtcactcatcaaacacaagcatattgttaccaatgttaaaaacaaattctgataacatacaatattcatgcacaaaatatgtaaaaatgaaagctacagaaatgatgaggtgaaacttgttcaaagattgaccattttttaatttatacatttgcatattgattgatggctgtaatatcttaggaaatgttacccatggtgagaaggcaaatatccagtcaactgtatgaaaagtcttagtattaagtaggcaaagaaaacatatttttaagaaggtaatataatcagccatttgtagttctatcataaatcacatgcccctgtcttttgcccaatgaccaggggagaactgatgctatcattctccatcatgagagagaattttgggagagcttttactagactctcaaaacccttgcgggcttcagtttcatgagaaccaaaatctgtgtgagattatgacatgtcttgtatgtgaaatgcattctgtatcatttcacttgaagaaaccacttcaaggggtctcttaaaccagagcatatcttaaagcacaaataatacaatttctccatgtaattcttaagaaagtaacattttaaaccctataaaaattgacaaaggcattgttcacttaaaatatggtgcagattaaatggaccttcattggatgttggtgcatatggcattactcagttatgacaaaacaaccatgaaataaagcaaaagggtaaatatgggaaagcaataaaaaggtaaaacaatgcaaaaaatgccttaaatgttgatggttttatctaatctcattgttccataaatcaatggcaatatttaaaatgcaactatatctaggtttatggccttattaaaaaaaaagacagctgaagccaaatatattattttcagggatttctattattagatctcccaatatactatttcttttatgaaatggagaaatataattgtctttttagacaatagatctatttagctaacatttaaaatggtttctgtgtggatatacatgccatggatcccatttctcattttgatatctgaaagaatatttactatttatggaagaaagaaaaccattagtacaagagagctgaaagagacattaaatattatgagctccaaggatcttgttttatagatgtggtgactgaggttcagagaggttatagaaagcaaggtgaaacagctaatcaatgtcagatgtcaggtcatggcccctctgtgtgtgggaaacccaggctcacatcactaggctgagccaacaacaatggctgtcggtaccttagacccaccccacatttctttcccaattccctggttcctgctacttgctttgcctttgctgattcctgatttggatctcccctttcgccaactcatgctccatccatttcaggggtcttgactttctttgctggactctgttcttgcttcctaccattgatacccatcagctgccccctggtcattgagcctcagcaaccccttgattttttttcttcagatgcatcacctcacacatggcaaaaaacagaaccaaattctaaaattagttcaggcttatcaccccctgtgtcagttcagtttagtcttagcatatatgtggtaagtgtgtgctgtgtactaagcctggtgccaaatgctacaggtacaaagagttgagtctagcaggaaatagaaacacgtgaatgagtcatttcaatagaattggtgaatggggtctgcctctgactatgtttctttctgtaaatattctttctgcttgatagggagatgctctcagatactgatactaataatgtgagtggatgtttgttactcagcctccaaaggaatagtagcaacatcccactgaggcatatatagaagctatcaagggcaacccagaaaatcccataggaacaaattctcctgccattgctttttttggtaatgattcttgtgggaccacattcttgtggctgctgaaagttgccaaagtcatttacattgcccctagagttgggccaggacccaggaaagtcattctctctttgcataagcgaatgtctcctgtgccaaaacacattttactaacctggcacctctcttctacacctaccttctcacactagtaaaatgtcagagtcatggaacctcaagcatatttgcacgtctgcttaattttttcctttacctttttttaaaaggcacatggcatatagaaagcacattcagccaggagtcaggatatctggattttaatccaggtactatcattgatatactccatgaatttggagaaatcacttaaacactttgggtttaagttcttcatctatgaaataaagggctggattcgatcatttctaatgactcatgaagctctcaaactccttgatttaaaacttcctttataaagtacaagagtctataaggtttgaatattaatttattatagaaaattgaaatctgaatgtatatatctataaaatataacatacatatccttaatggcagtaaagaaacaatgatactagaaacaatagcaaagccctggactggatcatgtctccatagcaggcacatctgttttaagataaagagctagaatctctgaatcgcttaatccccaggcaccattctgtcccaaatatattccttgtctttctccaacacgacttggctttctgtctttaatttttatcacagtgaacggcaccattaccacctatctgttcatccaagccacagagaatcaccttgattagtcttttccttctttttctacattaaatccacaccagatggtgttgcttttttttttttttttgagagggagtctctgtcacccaggctggagtgcagtggggcaatctcagctcgctgcaaccttcgcctctcgggttcaagtggtttcctgcctcggcctcccaagtatccaggcacatgccaccacgcctagctaatttttgtttttttagtagagacagggttttgccatgttggccaggctggtctcgaagtcctgacctcaggtgatctacccacctgagcctctcaaagtgctgggattataggcgtgagccactgtgcctcgccctctgctgtctcttgaaggctgcctaggtccatccctctcccgcttccctctctccctaccaatatcactttattctcacagtcactgactaaggtcagactctcatcagttttcttctggatttgttaatggccccataactggtctcctgactccagacttgcctcctccaatccatcatccatgccatagccagtgggatcaatctaaagcacagatttggctttgtcatgtcactgttcaaactctttcagtagcttctactacctgcagataatgtcacaacactgtattcgtcatagatgattcttaacaatctggaccccgaccctcccaccctacatgtactttatgctccagacataccaaatgaccacagtattttcatttcactaagcaaacactctttttgactcatgtctttgcatatgactttgctccaactggaatgcttcttttcacatttattctcccttttcttgggctaggtcctatttttcaaaactcagttcaagcttttcctcctctaggaagcctctcatcaatcttctctctgtaatacccttcttttctatttctagagcacctgtacctctgtttttcataatagccttattcaccacccttcctttctacttctggagcacactgtgcctctgtttttcataatagctttgctcaccatcccagtataagttccttaagcacaagcactacctggttcaacttggtaccacttcctttcactgcctggcacatagtggggtctcaataccattttgataaataatttaatgcataaatgaatttgtgtatgaaaatactgagtctcccattgtgagcttagcttagttccatttgtttctctaagtaagaaatatcatattagcaattatcaatgatccccttttgaatggcaaaggaaccagcattaatgatgtacatagctctgaaaacaaatatcctcactttgtggaccacataaacccatcttgtcttactatgtctttctactttgctattcccaaacatctcgactatgagtcattgtttaaatcaagtaaaatccatgaaacacattgaaaactaaccatgtcttaatcattgcttcatacataaaagcaaaagaagtaaaacttaatgctgttcattgagactgcttataacataagcatgctacaaatgctggactgaaggtatcaatgtcctgcttgccttcctgcctgcctgatgggtagaataaagaaaggaacaaatcctctcaacgagagaatctaataagtctttccagaggcagtcccaaaggaatatagaagggagggcatacatttcttttgtctcctttaatataaaaaaaaatagccttatggcaatgacactgcattccagcctaggcaacagagttagagcttatatctgaaaaaatacagcctggaaaaattgagggctaggggataagaaaggactctgggaagactttgagagcatgcaaggagctgtgcttgcttaggcaagatgactctcctgcttacctcctgaaatgtgcttcttgggaaatcaagaaataaatcagtcagaagcaacagcataccattaatgccataccacacacatgcggcaagggcacagcatcagagttttaatatgggattcaggtagaaggcaaagacagataatttctgtgcactttaccatattttcagacatagtaagcataagatttacccatttaataacatatataagaacatatgttgtatgtacgtatatacaaacatacacacaaatacatttgcacaattatgctcttgtacacacatatatttccctattcccaacctacatgtgtccagttctacattcatgctttgtagttatgttcatttcattgcagtttattttcttaaagatccatttaaaatagccaacgcatcactcacctttgaatgaggtgtatttgatgtaaaatttaatcacttcagaaaatgcccattaatctgtcatggacagctccagtattctgcctaacaacacagaaatctttttcccaaattctaaaattatacttagatgacagaagaatggaagaattaaaaagcaacttggtatgcattgtttttataacaataaaagggatctttttttaactaaacaagatactgtttcaaacaaaattgcaaacatgtctccctttactgtaatgctttttagtttcttgcttatctgaaatgcaatttaaccccctgcatgctacacaaaatacattctgtttcacttaaaaagagaaagatttgacatttgaactacagaccaccccagcagctagtagattggggggattgatggggtaaaaggctctccaccagataattcttctaagaaacattttctgcaaaccacacttacttctcctctgacaaatggcagcgatgcaaacacatagcttataatgatgatcttttaaaagaaatcttctgcattcaatgaaacattacaggacagatcatgaaatttaaatacccagcagatgatataagatactcaagaacagaagtttgaaagccttaacaattaagggatttgtcgatttttcaggaataccatgactaggtagaaaattgtcatcattttactctggtattttgtatgaaattggaaggtattaacacttaaaatcaaatctctttcaataaaatccttcactgttcaacactctgactttttaggctgttattaccttttcatttatgctacatcttttcttgcttacaatgaagttgctttgttggttgtctttctcttctgaaatatcttgtttatgggtttttaaaattaattttctttcatctgcttaaataaagtaaaataaatgataaaagtgtgtgcatatatatgtgtatgcgtgtgttttctcccacaatatgagattactcaatggaacatatagtaagtttgtacaggcataaaactgtcaatgtcattgtataataaacattccaaagcattatgtgtgaggtccaactaatttttttctgaataatatttgttgagtagttcttatttaaattacccttggtccaagtactggaagaattattaggacagaaaaagtcattcaaagcataagaaaggaataatgattgctgacatcttataaatgcaataaaatccctatttttttttttctccctttgatcaaaggactagagacagtgggcattgtttcatctttcacaaaggccattttggtgccctggtgatgcttgttacatcccaagtgctattggatgagagaccaaattagcattacaatgaactggcttctctgagaattaaccatacaccacaagagaatgaaacgaagcatgagtaactgcaaaaatacctgctcttgtgactacacatattgccagaggaattttgtaaaagtcagttttaaagactcattaatctagttttggcagctgtagatcacctcccggtgttcctcctgatttagtccccatccccaacaagctgggagaactggatactttatatattcattaactgaaagaagcctgggctaatttattggaaagtctaaatcctgggttcttatgatcatgaaatgtggataatagagaccagaaagctgccatacctacttaacagacatcacactttgacatatttattttggatgttttcatttttagtaagaaataaattactacatataaaatcaaggtcccacaatcagaatataacctttattctgaagttgatgtgggctttttctccataggtttatattcaaaataatatactgtctggtacactttcatgatgtacaaaaatgttaccttattgcatgatttcttcattctcttatttttaaatcaatattatgtttttgagacttagatatattaacagtattgttttactgtaattacaggactgagttagacttagtaattctaactgctaataaaacattctcatatcccaacgcctgacttactccgaagagaggagtacaatgtctttcagattcctgttaccctgagttctagctcagacacaagaaggaacaaattgtttctcagactctcacaaagcccccagggtctcttctctaaggatgtgaaggaaagctgtgtaatgaatcttcccctatttaaatactatatctcaagaatctgaatgaataatttttatatttggcaaatagttatttcccagagagagcaattagggggttgagaaagaaaggaaacatgttaccagaactaaaaattgattctatagttattctcaaacataaattactacattgagtttaaaataaccattaccacaattataaagacagctcccccaacttcctagcagcattccattgaatagacaagatagtcttgattttaaagtgcaaagtggcttcagtatactagctttccatggcttacaaacaaacaaaaaccatttctgttcagcataatacacagtacacaaaatgatatatttagcatgttctcaattatggtaagtatattcagacacaaatttgtatgcatttgaaaaagaaaagaaacactgaactgttaatagtgacgatctctggctgacgggaatacaggtgaattttattttcttcttgaaatggtttggttggttttctcctttctttagaaaatgagaattcaattttatacccagaaataaaataaagaactagagaaagaaagaaatgtgcttggaatgcattcattcttagtaggaaacttacaaacatctggcaaagtttagtggtggcctggttggagaaattctggaaaactctgctgccctccatagacattccccactggctcagccagttttcctcgtctagtcttactccctacctgccacccctaattctctggtttcataagaagtcaagaaaacaaacaaataagaagaaataaacaaaagagccaaaacagccgcaagtaggtctttaccaaggggaaagtgctgtgtgcaaagcctgtaacaatcgtctttgttttttgaatacttcttgtggatcagccaatgaggtaaggtcttgaggttcttcctttaattatttctcacagcagccctttgaaataggtatggttaccatctcagaccaatgaggtggcagaagtgatgagaagttcagtaacatgatcaggactacagagcccaaatattgcagtcgatattcagactcaagtctctttgatgcccgggtcactctctttccgctttattcagccccatgttcttggttagggcaagaattacaaacaggccctttgctgcccaagttcaaacagccaaagtgttttgtttgactagcacattatttttaaaatatggtttcaagcctttaacaagagtatgtaatctctagttatccacagcccatacctctcttggatataaaacttctggcccttttagctattaaggtcagttgcccagatcctaatggcatttgagttgccatcattaagcgggaaatgaaggcacctaacatttgatgatcaccgtcaggcagtaaaaaagtcttcatatacttgttgtccttttaaaaatacaatgaaaagtccccctcaccactctcacgcttagaaatactgaaagaatgattgaatcaacatgtggcaagacatttgaggactttgtaagcccagcataaataagaaacataataattttatatgacaagttgacttattctttcctcaggtccatagtgacatgctatttatggccacattaattatctttgctgaaaagcattagcattttctttcatttactcaaccaaaacagagacatcatcttcacgtgcatatggattagtatcatgtttgttctcctgttcattacaccataattccttcaaataagcacaaatatcaagcaaatatggattctaacattattatatgcacataatattagagcatattctcatagaatgagctctaatattatgattttttttaaagtttactaacaaaatccaatcaatattcaaacaagccatttttctttgggaaatagtgttttcttctttactaaactaaaacatgttgtactgtaaattgaacctcctgagctggaataattttatctcaaaaatgttttggttgttgaaagcaaagttatgcttaaagaaaatttgcagatatatatatatttgtatagaatcttaaattggaatatatatagaatatatatagatctatctataaatatagaatatatacatacatatgtatctgtgtatctatatctatatctatagaatatatgtatatattatatatcaatatagaatatatgtatatattatatatcaatatagaatatatgtatatattatatatcaatatagaatatatgtatatattatatatcaatatagaatatatgtatatattatatatcaatatagaatatatatatgggatggggtaatagacagttcatgtttccccttgaaaatgccatatcttattaagtatgtataagaacacggaatggtagtttaaatgtcagcaaagacaggctggcgcagtggctcatacctgtaatcccagcattttggaaggccaagacaggcagatcacctgaggtcaggagttcaagaccagcctggccaacatggtgaaaccctgtctctactaaaaatacaaaacttagccaggtgtggtggcagacgcctgtaatcacagctactcagaaggctgaggcaggagaatcacttgaactctggaggcagatcaatgagctgagatcgcgccactgcactctggcctggatgtcaagagcgagattccgtctcaaaataaataaataaatattagcaaagacacacagatacatacacatatgtagatgtgcatatgtattatacattttcacatactttcttatataaacacatttcaatgagcatttactcagtaagttttatatgtgtcctatgctaacaggcaacgtgccatgaatacataaatatgaaaaagatgcagttcttgcttagtccctggcaagtgagaaaaacaagtatataaacagatatcattataattagtagctgttaaagtggaaatattctctacaagattgtaaaaaatatactcaaagtttataaaatacatgacacttttattccatattctcatagagaagaaatacagtttcaaggacttcttagtaaattcagaattacttagtacaaacatgtcttggagaaatacatacttcatcagcctttttttctgtcctgatgtgcattcccacccagggctggctgttctcataattcatagctttaatattaaaattgtatcatcatcattatctccaggaaaccatgaagcccaaacctgatagattctaggatctcattgaggccttttgcattcttgacttcttaaagccaagggttctcatgtcacagagatgtgtttaatatgagatgtgttatattaaaaagtctaatgagtttactggaaaaccaccattatagaaaagaaattatacatttgctttttcataattctcaccattttttttctgtaaaaaaggaagagtcagagattataagtaatttcccagaagacatacagttacatgaggcttacccagcttgtctaggattgggctaatccacaccatgcctatcttcccagttgtaagaatttctcatatcaaaaatagagaatctttgcaatctacatgacttcttccaaactgggggaaatgtcttggtgaattcccacaggcaggtagaatgttgcggcatgaagagctatttttaacatggtgctatggagagctcccagaatgtgtcagcagggaacctgagtgctttttttttttttttttctcccacttgtcagccatatgaactccaaggtcttttacttctgtgagataaatatttctcatcagtaaagccatcaggctaattgtacctgtcctaaacatctcaaaagtttcttgtaatgatcaaatgaaataatacatgtcaaaatgcttggtcagatgtaaggtgccatgtaaatgtcagatacttatacttcgatgtgggtaggttggaagaagcagtttgagaatctattagaagtgtgaattctctggtgtaactgcatatacagttatcaataagaagacaatgaacagctaatactagccaccatattattgctttttccaagttctgatttatatttacgtgagaagcagcacatgagaagcagtgtttgagaaagaataataagttttggactctgttagctctaagctggcaactggctagctgtgtgactttgagcaagttgctttccctctctgtgctttagcttctgcatctagaaaaagcgaagaataatgcatctgtatcatagtattgtttgaggattaaataagaaaaatcataaatatacctaaattgaaaaataaaataacaagcttcaaatgggaagaatgggattaaactgcctcagtgggcatggatgtgacagatggcattggacagtaaaaaaaataataataatagaaatttgttacagaggcctagcttcctaatacttattaacactgtgactatgaacaagccacttaactactctaagcctcaacttcctcatctgtaaatataataatatctacatcaaagcagttttgtcaagaatgaaactatttcattaactgtagctataaaaatatagtcccctgactgacacttgctgactgactaatactacagttacgcaaatctaagtatctttccttttaacactatttcagtacatctatatactacaggctggccataaagtctataggtaataatatcctattgcattttaatgtaatgtcagaaagccatttactatatatatttactaatttttccagccttaaggccaccagtggacttactcttttggaattttttatatagcaagcaagcatccacaaggatgtttttagttatatgattaaataaagaaatgctaaatccctgaggtttatgaaataatacaatggttaatattattattactacgattttttgagacagcgcctcactctgtcacccaggctgaagtgcagtggtgaaatctcgactgactgtaacctccatctcccaggttcaagcaagtctcctgcctcagcctccctagtagctgggattacaggtgtgcgccacgatgcccagctaatttttatattttcagtagaaccagggttttgccatgttggtcaggctggtctcaaactccagacctcaagccagccacctgccttggcctcccaaagtgctgagattacaggcgtgagccactgtgcccagcccgatggttaatattagctgttgattgtcttctcattgataactgtaaatgcactcacaccagagaatccattcttctaatggattttcaaactgcttctcccaatctaactacaccaaagtgtaagtatctgacatttgcatataaagaaacatcttgtataacacgtgctagttgtttcaaaacttcaaagggaattttctccttgagcaattttaatccagaaaaacctgtaattatgatttcaatgatgaatagaccacaaagtgctaggccagcaattaataaagtgagagactgcagtgaacgcagttcctagatgtctttcagaaaagaactgtgcaggtaagaggtgtagggagcaaggattggaggaagattgcagaagggggaaaaaaaaagacattctaaacattatagttaacacaactacctgaacatctgacttcaaggaatgaagcatagaattattcatattataaaaatattcatcaccttatgtagtacacaagggcccagaaagtaacaatattgcaagcatttaaggtttttattaaaacttcctgataaattgataaatagactgataagctgaagcatttcaagttactgatgatactatcaatgcaatggtaagacaaggcaaatatgacattagaataaatacaaagcacatttattcatatggttcactaccggaaactcagcatacttgacaatgggcagcctcaaatggtgctctcccccatgagaagtagtgccttattaagacagattgatgtttagaatttcataaacctcaggggcttagcacttctttatttaatcttataactaaaaacgtccttgtggatgcttgcttgctatataaaataattcccaatgagtaagtccactgagatttctgagtttcctgtgactctcaccattaatgcatctgcaaccaccatggtattgggcatgaagcaataagctgtatcctcatctggggcatgtctactggtctaacatggaaaggtcatgattccatgagcattgggatttcgtctttcaatgggattgtaaacaggaagaggctctccaacaaagagacattaaaatactctgccttccaaaacattcagatagatgcaatcactagaagagaataagattggttcttctcaggaaaaaaacataaacataactaagtcaggttaaagtagtggttttctcattttcttgactgtgacccacagtaagaagtgcagttttaattaggacaagaaacaaatacaacacacacacacacacacacacacacacacacacgattttgcctgtatacacaaatagaaataaaagtttcattaaaaaatactaaatccaattacacagtaaacactagaacccaggtctctgaccctctgatatttttacaatgtttaattttatttcatttgtacaaaaaggcttgactcaatccatttttaattttctcaacttactgtggtcataatgttcagttacaaaacactgaattggaaattgatgctcaaaatattatttattatgttatcactatatgcccagtaatgtgctaaatagtttgctcacatcatagcatttagtcctcaaaccaaccatcagagatgagttttactaaatctacttcatggacaaagcatctgagattagaatttagctctgcttgtgcagacaggaaatgggagagcagagattagaagtcagtcttttctaattcctactcattcaaatactttctaattcttatcatattacaccaccaaaaagccaaaagttgctacttcagggcagactaaacagaattctggttaaattagcacaaaagtatctctgtacaattaaaaaaatataactggcaaaacctgaaatacgtttgctgtgtttttttaagatcattgtatatatgtacaataaactcaacacagttgtccttagaacatgggctcactgttttttatccagaaagcttgttgtcattatttttaagttaacagttgtgaaacttaactgcgtattgttacttataaacacttcaattggatgaactcaaactgattattgaatctaaagacaacatcaatatggtgatcagcttctaagatggtccagcgatccctacctcatggtagttataccctggcatagtcccctcctgcattatatcagagttgatctgtgtgatcaatagaatatggcagaatagatgctatgccacttcaaatattgcattgtaaatggcactacaggttctatttgcattctgtctctctggctctgtctctcgggctctgtctctctgatcactcattctggggaaagtcatactgtaagaaaccttatggtggagagacccacatggtgagaaactgaggccttccaacaacaacgggggaatagaccctgcagccccagtcaggtcttcagagattgcagtccctgaaccagaatcacccaggctaagccatccccagatcccgaaatctcacaaactatatgagatgataaatatttgctattttaagctacatgaatactttggagacattatgggtttggttccagaccaccacaataaagcaaatagtgcaataaagcaactcatacaatctttttggtttctcagtgcataaaaaagttgggtttacactatactgtggtctattaagtgtgaaatagcattatgcctaaaaaacaaggtacatatttaatttaaaaatgctttatggttaaaaaatggtgaagatcaactgagacttcagtgaatcctaatctttttgctggtggagggttttgtcttgatgttgatgactgctgactgatcagggtggggtgatgattgctaaaggttggagtggctgtgacaatttttaaaaataaaacagtgaagttatccatatcaattgactgttcctttcactaaagatttatctaaagcatgctctctgtctctctctgtctctctttgatcactcactctggggaaagttatactgtttggtagtattgtaaccacagtagaactttttcaaaatgggactcaatcctctgaaaccctgtcaatactttgttaaagaagtttatgtaatattctaaatcctctgttgtcatttcaacaatgttcatggttgttgaccaagagtagattccatgtaaagaaaccactttccataagaagcaactcctcatctatttaaggtttatcaggagattgcagcagttcagtcacaacttcaagctccacttctaattctaattctcttgctatttccaccacatctgcagttgcttcctcaactgaagtcttgaaccccttaaaatcatccatgagggttggcatcaacttcttccaaacttgtgttaatttggatattttgaccttctcccatgaatcactaatgttcttactggcttctagaatagtgaatcctttccagaaggttttcaatttactttgcccagatccatctgaggaatcattgtctatggcagctttagccttctaaaatgtatttctttaataagaccagtaagtcaaaattactccttcatccatgggttacaggatggatattgtgttagcaggtataaaaacaatattaatattcttgtgcatctccatcagagctcctgggtcaccaggtgcattgtcaatgaacagtaatactttaaaaataatctttttgtttgagcagtaagtctcaaaagtgggcttaaaatattcatcatgccatgctgtaaacagatgtgctgtcattcacgctgtttggttccatttctagagcacaggcagagtagatgtagaataattcttaaggaccctaggatttttgagttagtaaatgagtattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttataagtatattccttatacttatttcttaagaataattcttaaggaccctaggatttttgagttagtaaataagtattgtcttcaacttaaagttaccagctgcgttatcccccttacaagagagtcaacctgtcttttgaagctttgaagccaggcattgacttttgctgtctagttacacaagtcctagaaagcatcttcctcaatataaagttgtttcacctacattaaaaatctgttgcttagtatagccactatcatcagtgattttatctagatcttctggataacttgatgcagtttctacatcggcacttgctgcctcaccttgcccttttatgttatgaaaatggcttctttccttaaacctcatgagccacaacctctgctagatgcaaacttttcttctgcagctctctcacctctctcagccttcatagaattgaagagagttacgccttgctctggactaggttttggcttaaggtaatgtcgtggctggtttgatagtctatccaaactactaaaactttcttcatattagtaataagcctattttgttttcttaacatttgtgtattcactggaatagtattttaatttccttcaagaacttttcttttgcattcagaacttggctaactgcttgttgcaagaagcctagctctcagcctgtcttggtttctgacatgccttcttcactatgcttaattatttctagattttgctttaatgctagagatgtacaattcttccttttacttgaacactcagaggccactgtagggttattcattgacctaatttcaatatttttgtgtctttgagaatagggaggcccattgagagggagagagatgaggaaatggcccatgagtggagaagtcagaacacacataccacttatcgatgaagttctcctactcatttgagtgtggttcatggcactccaaaacggttacaatagcaatctcaatgatctcaaagatcactgatgtgccaagtgcagcagcctcccagctacttgggagaccaaggtgggaggtttgcttgagcccaggagttgaagatcagcctgggcaatatagagagactctgtctccacaaaaacataaaatttgctgggtgtggtggcacgcatctgcagtcccagccactcaggaggctgaggtgggaagattgattgagccatgggaaagtcaaggctcagagagccatgatcatgctattgtgttccagcctgggcaacagagcaagaccctgtcaaaaagagagagagagaaagagaaagaaagaaagagagaaagaagaaagaaagaaagaaaaaaagaaagaaagaaagaaagaaaggagaaaggaaggaagaaggaagaaagagagagagagaaaaagaaagagaaggaaagaagaaagaaagaaaaggaaagaagaaagaaagaaggaaggaaggaaagagaaaggaaagaaagaaaaagaaagaaagaaagaaagaaagaaagaaagaaagaaagaaagaaagaaagaaagaaagaaagaaagagtcagggtcagtggctcaggcctataatcctaacaccttgggaggccaaggtgtgcagatcatgaggtcaggagttcaagaccatcctgaccaacatggtgaaaccagcctgcccaacatggtctctactaaaaataaaaaaattagccgggcatggtgggcgtgtgcctgtgatcccagctactcaggaggctgaggcaagggaatcacttgaacccaggaggtagaggttgcagtgagctgagatcacgccactgcactccagcctgggtgacagagcaagactctgtcaaaaaaaaaaaaaaaaaaaaaagaggaagaagaaaggaaggaagaaaagaaggaaggaaggagggaaggaaggacaatgaaaagaaaaaaaagaggaaaataatcactaatcacaaataaccataacagataaaatgataatgggaaagttctaaatataatgagaattaccaaaatgtgacacagagacacaaagtgagcatatggcattgaaaaaatggtgtcaatagacttgctcgacacagggttgccacaaacctttgatttgtttaaaaaaaaaaaaagcaatatctgtaaaatgctataaagtgaagtgaaataaaacaaggtaggcctgtactaaattttggtataatttgttaggcaaccaacagataatcgatgcaaacagttacagcttgaacctggcgagatgccatctcaatagggtttttatgtatgtgttacatggtaactttaaggctggaaaaggaaaaggaaaaagagaaataaactaaataatcagtgtagtaggatcaaagtgtttacttttaggctttcaaatcaaactacacagtgtggactagagtctactgatgcaatttctaaatcattgagactactaatcccaagcagccaataaaataatttgtcagtcaatctgtgaatttgtcagcatctcttttcactcttgttctccccagtcctcagctattttgaaaatcacatctcattggaagttgaaccagaaaaaagaagaacactgaagcttacatatgtgttctgctactctttgtggtttgtggtggaggctagttagactaaatttgaaagttggcaaaattgggcaccataatccttcttcaatcccctctctcttggtgctgagcattcttttttttttttttttttttttggacagagtctagtcctgttgcccaggctggagtacagtggcacaatcttggctcactgcaacctccacctcccaggttcaagtgattctccagcctcaacctccctagtagctgggtttacaggcacccaccagcaggcctgtggtgccgggcattcttatgctgtcttccacctgcctaaacccctcttctatggcatttacccaggactgcctttccccacaataacttctcattaccttaattcacataaaggcatgaatgaatggtttccaacttattgctcttctggctgttttaattttctaaaagatgctgtttgctcaattaaattctgaccttttggatctcagggagccttataagctgaggtgatgattttatcattgaaaatatatgtatcatacctatgtcatatggaccaaaagtgaaattactagaaaaaaaaatgtgttgtatgatattaggagtgttgttcagttatttatagatttaaatagaaattttcaacttcaaaactattgacacttagggcaaggtgatgtttcattgtgtgtgcatgtttgtgtgaggaaatccatgtgttatatgtagcagagcctcagtttactagataccagtagtgcctcccagctgtaacaagtaaaactgtcttcaaatattgccaaatgtccattggtggcaaaatcatgcccagctgagaactactgatataaataattgctaccattttgagcaagtatgtgtgtgtatttaataaagggatataagaaaaaaatgtcgggaaatgtggggttatttaggagatgaccattctcctggtgcctctaaaattacaatccatgtaatagaaccaaatgcatttgtctaattcttatcctgtattctaataaaaggcagagattgaaactattagtttcatgtttaactctattatttaacttatcagataactaagatttggccatattttcaaaacagaaacagaaacacaatgttagagctgaaatgatcacggctgctgtttctcgaaatgtctgctccttaaagaccatggcccagagaaagaaagtctcacagaaatgcagtgacacagtaacgattagaatgcaggtctatgaccatctgttctccagtgaggaggaaacaacaaaagatactttcctcttggttagtagctcaccgacattacattttcctctggatttttgtgttatatacgttatatgtacctaaagccaccaagcagaagacgtgagcgtgactagagtctacgccaggtattcacatgacctaaaggtaaggctcaatttctctgcctcagtctcctcctctttaacatggggctaacaacacgaaattattgtgaagtactttgaaaactattacctgcaattaaaatgtgatttaccttattgtcatgctaaaacatttgagacatttatacaaatggtgactacatgcaagtttatctcagacagaaaagtgataatcccaatgctgtcagaactaaatttacaaggagtttatgctgttgctgtgataaggtgctaaaaatgacctctttgacaaagtgtaaatccttctccatttcctaacttttcagtatctcaattacctactctcttaagtggtcattaacttcaacactatttttagtcaagtacaaaatagatttttttttttttgaattagagagtgtatttggaggagatctgaagaaaacatacaaattttgaaggaacactgtctttttaccaatgggtttctaagtcacagcatcttatttaagattcagaggttgaattttaaaatatgctgaaacatgaaaatgatacaattgaccactctggaaactggatagcaaatgcagtgctgttgggtttgagtatatctgtcatgttggaagaaggaatgagaggtggattgaaggagtgaaatgatgtagtccatgagggatcattcacagagacatttcctctccaaaaagatactatttaccacttgagcctgaagaaagaagtgagataagttctacgatgatggaagtttttctttctaggggctctcttgaatatattctttaatgccttagcaagtctgatgaactgaaagatttaccatatttttctaagtgcctcactttcccttcaggtacaacctgggctttcaggaaaaatctgacttattgtgtcttataatgaagtagaaagacttattaaaaacagagaattaagtagatgaacataatgatctttttaaatgacctctcattattctcttagaagaaatgacttagttaagaagaagagtcttggaaagatactgcctatgctagcactcaactcgtgaaatgcttctttctccagtgaaagtcagctgtttggttccctttccaaagaatttctgaacttagcaccacttcaatttgctgctctaagaatattgaccttaattcccatttaagagagtgaagggttaggattaatgtttcttttttatatatgctgccttgcaaaaccctttccatttactcataaaaagggcttgccaacctttttttattgaatggataaagcccaggttatttccatcttaaaagtatgatcaaatatagcagtcgtaagaaaacaggagaccagaagagccaactgcaatagactgtaatataatgctatagactagtttatcagatatctttatcaggaaattattataagattagaaagtataatatttacatttaattgtattttacacaatggcagttctcatgaggaaatataccttaaaagaagaaaaacaaattaaactaacatgttcacatgcactgtatattctggcaggaggtcatcacagagtcttgcagattctgtcctgcccaaggcagccagccaagggtgtaagtgggggacgaaatccaattcactttgagctcactaaactccaatgcctgttgtaggactgggcggttttctaattctctcaaaagcattatatgggctactggtggacacttctggactatttctgtctggtcgcaaattgccttctgtctaatggtctaaaagcagtctgtctctcttagaacaatctatctgacaaaaagggagcacatggctattggccaaagaattgacttgcatttcccagactgacctgatcccaccctcagtccccagaagggaatggagaaacctactcttcactgataaaaattctggtggaaatctggatggtatcagatggtatttagctagggagataagaaatgcttaaatctggccaggcgcggtggctcacgcctgtaatctcagcactttgggaggccgaggagggcggatcacgaggtcaggagattcagaccagcctggccaacatggtgaaaccctgtctctactaaaaatacaaaaatcagctgggcgtggtggcacgcgcctacagtcccagctactcaggaagctgaggcaggagattcgcttgaacccaggaggcggagcttgcagtgagccgagatcatgccactgcactccagcctggtgacagagtgagactccatctcaaacaaacaaacaaacaaacaaacgaaaaaaactatcaggataaatctaattatttatgataaaatttagcataaataagaacagaaattgccagttatagaaataaggttgttgaaaacccttaacaaatatggcagttagtatttttttaaaaaagaaatgcttaaatccttcttttgtccagcaatggccttgttcccttgaggtaccctgtggaaatattaagccaggggacaatggtcaaaagaaagctaaattctacattattattaattgggattttgtaccaaatttcaatacagagctctcaaattttgctgaagtataaagcctagtgctgaagtgtaagaaggccagccaatcctccactgaaactaacattcaaatattagtattttaccatcctcctcccaaccacaggagacagacctgatatgtgtattgagcacacatgagtgaaggcaagaagagtggacgagggacgttagccaggctccatattggtttaggactgccaccaagggtaagggtgggattgggcacctcaaggaaagaatggaatgaagcagagaggaaagtaccagcaacaagacttggacctcactgctcaggccacatggaaataggaagcatgagaaacactgagaagctgccctgataagagcacaggggaggcccagagaaagggccgtgttcctgagtgtgcagttttaaagcagcttgcccctgtcttccaggctatatggtcaatcattgttctagaatatgacccaattggatttgtatattttactattcttgagattgaaccaggaaagggcctatgggaagagacctcttgctttctttattcaggtactatttctgttcttacagatttttatccctattccttttttccaaacatttcccttctttaggaagcacttcatgagtatgtaacttctctaaactatcatgtcatgacatttaaccttaagaagtagagcacagcattataatgtccctcttgttccatgcctaacattctgtgcctatgtttccacatgtaatcaagttgagaacattgcaaaattttaaattcataactcttgccacaagttgctcgccatgtggttgaaatgataggatccatgtatgtggtaacgtgcagcaaaattttaagaaataatttcaatatggaagtatggggaaccctgagttcttttccaggagagattgctgcaatttagaggggaggggaaattgtttatgggaaaggtaaaaattaaactcaaacctgattagtgttcagggaggaggaagaaaggaattgctattagaaagaacagatcttacaaagggatagaagacagaaaatgcacacttgtttgtttgtttttgtttttttgtgggttttctgtttgtttggttggttggttcaggaggagggagcagtgcatattctactccagccatagcagagctttggaaagtggtgagagatacggtaaggcctagccaaactgtggcagctatttaatgttggctaaaggcaatttgaattttatcccactgaaaaataagaaaatctgaggatataggccttcaagtctgactttcggttctcactaaattccaaaatttttacatatctattattattattggaaacattatttctaagctatcaacatgtaatttgtggttcagtgtgtctgggaaacagagtatttctatgatttttgaacttagagtttaggaaatttccaattttgaagcaaatattctcttagtgtcccaaaagatcaagtacatttttttttcttctaatgcttggtctgcaccattccatctcaaatcacagctcatcactgattacacaaatacttacaagcagggcccatttttagtaggtaatgaagtgtaaggatgaagcttaaatgatgcaatatacccaatgtctagccttacataaataaataaagggccatttgtttcatttcacttcaatacacacttttgcaagggaacgttctatttcttttggcacacacaaaaaattctaagtatacatcaacattttttaatgttgaaatatagttttgcttttcctttattctaaaataactatataataaacatactggacattttttggtgctttgttcaacaatgaacaggccgaatttcctccccagatgcctcgtgacattggcatatgcatagcaggaaacgtacacactccaagtcataatcctgtctggataaatctgccatgtgtgctgggcaagccagacctcattcacctgttcatactgacatttaatccatcaccaaaccttacctagggactttctaaagatagtaatctcactgaaggagaaatgtacagattgctactctttgggactattttaaagtattttgatgtttggagaagtggaagaagagaggaagatacaagggaagaaactacacttgatgtagagttaatccatttaagcttcagagcctaccttgtgatgtaagcgttgtctcacctatttccagaaaaggaggttaaagccaatgttacatcacaagtaagcagtgtagataaaatttgaacctgaaaatccctggctcaaagtccaaagctttcaattacacaatcttgtcaagaacgtaaaaacagatgagtgcattgaatagaagaaaagatggcccaaagattaatatttgtaaatctcctctaatatcttggttaaatttaccacccaaaataaacttcaatattgtcatgaaaaaaaaacatatcagttgtcaaaattgactccattgcactggcatacactgcagcttaagatatccaaatgacttagcagcagagccaagcgaatagttgaaaaatcacccactgtacttctaattgaaatagccaatctgtataatatgcactgtaaaatatgacttttccatacagcatttgaagcagaattcagatagattcactactcaattaaatcagccttcatagggtttagacacacttgaattttttggtttaaaaatggtgaagggagtgctcttttatactttgttgttgtcattatgattattgttactttaggaaccatatattttaatctgcaactgcctctgaaaatgtctattcacatttttcaaaaaagaagcaagtagtgagaaaggtgcatttagaaatattaccaactctcaaatctccagtgagcatctgtgtatagtataaaggcaaaatgcagatgccactgatatgttaattatcctaagagaaagaaggtattatgtacctaaatacagttgtatatatgtataatgtgtgtatatgtttatgtttatacacacaccatatatacctaactatactctatgtacactgttacggcttggctctatgtccccactgaaatctcatctcaaattgtaatctgaactgtaatccccatgtttgggggttgggacctgttgggaggtgattggatcatggggtggtttcccccatgctgttctcatgatagtgagttcttgcgagatctgatggttttataacgggctcttcccccttcccttggcacttctcctaactgtggccttgtgaagaaggtgcattggcttccccttcaccttccaccatgattgtaagtttcccgaggcctccccagccatgtggaaatgtgagtcaattaaacctcttttgtttataaattactcagtcttaggtagtatctttgtaacagtgtgaaaatgaacaaatatatatatatatacacatacatatatatatatatactctattatatataactgcttcaagactatttttagtcctacagtctattcatatttttctaaattttcaaaagttttacaaactctgtttctattattttatatataaacaatgttaaaaatattcagagcaatggatatttagggatgagggatgggagtcatccaccctgaggggagatatattttttcatgaaaactgcttagaattgtcagggcctgataataaatgcagaccaactattagttggttttgttactgtctttaaattatctccttaaaaggcagacattcatcacctgcacctagagtagaccacctcaattgctccctcccttggtaggccactagctgaaggccttctaggagaaagtcatcacgtctaagtgtcttgtttccttagtggaactggaagtacttactccataaggctgccttgacaattaaataaattacaattttgaaagtggttagaacactgcctgagatagagcaagcattacagcactgtttgtttaagtaaataaatgatatttatgaaaagcctgatgtagcagtccgccaattttatagatgaagaaactgagtctcagaggaggttaaaaaaaaaagacatcaaacagaaaatgattgtggtttaaagtaaagatattgacactaaacctgtacccattctacctctcccacacaaacgggatcatggctttagtttttattgtgttatccaattattgccttattttgcatatttacttcccaaattatttgtgtacatatttttaacctatagctttatggtatttcagagcaggtgcactgaagtatggcaagagggaagatgacagttattaagaaaaagtgaatttattcaactttttaagctactaaaagcgtgcaaattagattgttattgttattttaagaaaaagaacattatgtattgaaaaagtatgcctttccaagaaaccactaaccagatgttggggtcttgagatatcccaaagggatactggtaaaaaatgatgaaagaacttccacacaaaaatctaagaaagcgcgcacacatgttataactatgaatattgtttgcaaaaatttaacaaatctgcttcatcatcagatactacagccccgggatagcctggtctggaaatgtggtttaaggaagaataaaaatacaaatagaggaaaaattactaggaaaatgttaacacaataaattaagtagaatagagaaggaatgccaatatctaaagtttattacacacatgtgccattacctgtgtggtaatggactattcagtctttgattctattcacaaggcagcagttaaaggctacatgatataatcaatcaactagttatttgacatcgaatgtttattgagcgtttatcatgtgcaggatgtttgtgtgtgtgtgtgtgtgtgtgtgtgtgtcctgcacaaaaacacatctgactatatatacgtatatatatgtatatatagtgacaaaatacatatactatgcatacacattagaagctagatgccattttgactgtttggatttttttttccctgaccttacactttaaaaaaaatttatttcttaaagcaattggttagtttttataggtgatatagccagtgtgagttcaccatctatgaactgtagttttctttattaagaatattattgtttcaaccaatagcatgccaatactttctcattttatcaaaactggaaatgtgtctccaaaaaatggacctattgctttctgaggggaaaatcttttctactgcatatcatccccacttatccatgtatctttgctactcaagtagggcagagccacagagaacaaaagacaacgtcttactttagtgatggctgtgtaggacagagaaccttaaaggaccccaccactctcttacctgtgtttgtttataggggttttgtttgcctgtgtgtgcttgcttaatgctttgcatttgcaaagtaaaagcaaggtcatctctgttgagaagcttgttgggtactccagatggattttgctaattcttgggaaggcctgaagtttagataagtggagactgtagaaaagttcaattcttcctgttactgatttctttagtgttttaactccatctcctagtgggcagctctttgttttatgttgctgggtggatggccattggctctctttctggttttattggaagtttcttcaaatggctgtggtaaatttcaatgaacttttttatcatgctcatttcacttaatttggtagttgtggagttccaagtcaaacagaaatttcaggcaaaatgctcaaaggggaaaaacttgaatccaaatcagcaggacttaaaagcaacactgtgtgtgccgggaacttgcccagagattaaccctattgaatagtgacaggcagctatgacattacctgtcaatgtttgcttctccagagggtcccaagaaccacttcatgctcactgaacccctgcttcatagcttggagcctgagtaattggatatctttgaaagagaagagtaggtgccctcgtggaggcaccatgctgggtcttggcagcagtgtgagggcagccctgaagaggaattatactcatgaagactcctgaattccatctttgtgaaactccattcactctgttgcttgtttctggcaaactgagagcatcctgagaatgggtcaaggatctttcaagggaatccctgctagcaagattgaatcacatttccaaaagcaaactggaacaattttccatgtcagaaaggatcgttatgacaactgtatactgggacagtgggcatgacaggaattggagatggaaacatagttttccaaaagaaaagcaagccctacagggtattaatttttcaacttagctaaggtttgttggctgatcagagtaaatgctgcttctttgcctggtccatagctttttcctgctctttgcctattcttcctctatatgtgagtggtcaagaacattttgtaagacatagaggaaagacatgcaggagtcttggcaagatgaatgggcttgatttatatcaggaatttttactctaaattattgactccgttatttcttcctgcctctatattctgaattaacccaaacaataggtcacctgctacttttaatggcaaaacccacaattacttctgcaccaatttaatatttcagatagaataagagaacttaattattaaagagtaatggaagaaatatattaataggtcataaatctggagaaatatgagaaaaatttaaaaagaaattttgacacagcatttataaaacttccccttccctattacatttttattcttttctttcaacaaagtagattacaaaaatgcagaatattttagatacatcacatacaatagcagagtatccaagtcgagctgcagtgtgtgtaaatcccatatttgtcacagagaggtctgctgtgcttttctacaagtcgggcactatagcaaattcccagttactatgtatgtgctccatagcaccagggtattgcagatatccaacagtgctgtgctgataaattttgtctttgaaaaagaaaaaaaaagtccctatttatagcatttcccattttccatggcataaatacttcccacacagtagacttcaagctaccaactgatgtcactaaacacagagctgggaaaaaaaaatgtgcataattggctcttgtaagcctatgccagtctcccatcaatatacttggaactaggagacaacttagaaattctctacccaaaccccgaaagttttggagtaaatgaggtggaatgatttgtgaaagccaagcaggaatggccaagttgggaatagatgcattattcctagttcaagctcctttcttctacactaaaatacaacttatgaatttgcctgtgcatctgtatatttcaatctgaacaacgataaatgaaaaacagacaatgagtggttggttatatcttaaaaatagatgtaaccaagctaatacattgaagcaggcactggtatttgctgaaatgctatctttatttctccttattgtacttacctcctcacatctgtccatgtcatctggaaacttacaggatcaagtctacactgtacagaaaccaattactgctcagcagaactgagctccagatccctttctgtctgaccacagtgcaccaccaagattttctaatgtggcttccttcagatcagtatgaagcagcttgtatttttagtgaccacagagaaatggctcctttggacttcatctcaatcaatggttgtgtgggtctcagccaaaaagaaagtgattcaaagcagagctccaagaaagggctggatgtacacctgaaactgaaattgctggggagaacctcaatgccaaagccatagccaaagcaaaagtccagccttacaaactgagcaaacatagctgtgtcagagaacagctgtaactgagcttactcacaacaggacttgttcttcttgcaccgaattccaggtttatcacagcagtaacatttgtggcagcaagtcatacttcaagtcctggtggttgttgagtgtgaaggtgttaattataccgcctgtctaggtctgaattactttagaggcaggcacttaccgacacacaacacctttttaaaaacccatagaaatcttgaaaatttttcagcctgaacaggtacctagaagagacattccaacatcaaaactttgggagaaactgttagactatcaggggaaactccagattttatatatgaaaggttgaaagattacaaactttcagaaaggagggccagaattctcctcaagggacattagccctgcaagcatattgttctattgtttagttggaaagcttttcaggagctgatagagattttggagcccacagagattgttatatttcccacagacctccctatagtacctcacctttctgtaatctaatgaaattttcagaaggagacacattaggcacctgtagctgatattattcatctaaacttactcttaaaaataagcaatcttccattgcacatgtggtaacataattaagggtgtcaataatcccttaaaaagacacccaaaagggtttgtatttgaagaggtggacatggtcatccaaaacctgtggagtctaaggtccaggatttaaggttcagcttgcaagtcttgaatgattcgtttgactcagtggttctcacttacctctcattagagttgtctggggagtgcttaaaaaatgccaaggttggcatggttttgttgatttgttaagatactcaggtgactctaaatatacatacaggattaagaacctctaagtcacttttctgattctcaataatattctattttaaaaaggaaaaataacatctaactttcaggaacctacacagacattgcatataaaagttcttcataatcaggaaggatattacatgtatatgtattatctgtgttaattacaaaaaaaaaatagactttgctatatgagaagttctatgtttttacttataacactgatatttcttgatcagtaagtgcatagaactgttctgtaggtaacttttttcatcctttggtagcgacaagcaatctttctttagtaaacgtaagtttcagtgttttgtagtattttattggggacttataagaggaaaaagggtaacaaacagcaaaaatgcttttggagtcttcctcatgaagtctttgcccagaccaatgtccagagtggtatttcttagattttcttctagggttttctagttttaagttttacagttaaatccttaatcttgagttgatttttgtataaggtgaaaggtgggggtctagtttcaatcttctacatatggctagccagttacctcagcaacatttattgaatggggtgtcattttccccttgcttgtttttgttggttttgtcaaagatcagatggttgtaggtgtgtggcttaatttctgggttctctaacctgtttgattggtctgtctgtttttgtaacagtaccatgctattttagttactgtagccttgcagtatagtttgaagtccagtagtgtgaaatcaccagctttgttattttgcttaggatagctttggccattcaagctctttcttggttccaattgagttttggaatgtcgtttgtttgtttgtttgttttccagttccatgaaaaatgtccttggtagtttgataagaatagccttgcatcggtaaattgctttttgtagtatggccattttaacagtattgaaatttcttatccatgaacatggaatgtttttctacttgtgtgtgtcatctctgatttctttcagcagtgttttgtaattcttgttgtagagatctttcaccttcctggttagctgtattctaggtatttaattcattttgtggctactgtgaataggaccgcattcttgatttggctctcagcttggatgttattggtatatacaaatgctattgatttttgtacattgattttgtatcctgaaactttgctgaagttgtttatcagatctaagatcctttgggcagagattatggggttttctaggtgtagtatcatatcatctgcaaagaaagatagtttaacttcctttcttcctgttagcatgccttttattttttttccttgcctgattgctctggctaggacttctggtactatgctgaatagggatggtgaaggtgaacatccttgtttcatttcagttctcatggggaatgcttccagcttttgcctgttcagtacgatgttgctgtgggtttgtcatagatggcttttaatattttaaggtatgtaccttcgatgcctagcttgttgatggtttttagcatgaagccatgttgtattgtatcaaaagccttttctgcatctattgaaatgatcatgaggtttttgttttcagttctgttgctgtactgaatcacaattattgatttgcatatgttaaaccaacctgtgtcccaggaataaagcctacttgatccggtgaattagctttaacggtggactgaataaagaaaatatggtacttatacaccatagaatactacacagatattaaaaaaaaatcagatcctggcctctgcaacaacatggatggagctggaagccattatcctaggttagttgatgcaggaacagaaaagcaaacactacatgttcttactgttaaatgggctaaacactgagtacatgtggacaaaaagaagggaacaatagacaagagggcccatttgaggatggagggtaggaggagtgagaattgaaaaactagctctcaggtattatgctagttagctggatgacaaaattatctgtatagcaaacccctgcaacatgcaatttacccatgtaacaaacctgcatgttgtacaccttgaatataaaataaaattggaaagaaaaaacacatttatttacaagtacacagcaagagaaaaaagaagagaggctgccttaaaatttaaagtacttcacaaactgctggtagcccttgagttgagcatccaataggtggtgtttcaatggtgtatttgttagagataagccaaccttaaatcacataggttagaaataagccaaccttaatgattaagaacgatgactctggagtcagcttgcctggagttgaatcttactcaaacacttaacttcaagtgtggtattaattgtacgaatgataattatacctaagatttggaagaggatcaatacatatagagcattcattatagtgcctagcatatataaagtcttagcaaatgttagctattattatacactaacacagtctcgaagtcagtaactagttaatacaatttgcagagtgcctttctctgacagactacagggtattctcttttggaattaatatacagtaaaaactgagtaatctatggtaacgtgatataattgtattatttttgagagtgtattaatttattaaaaacaagttattagacacaaactatgtgccagctactgtgctaatgctaggttacaaaaataaatgatattcctttaataattcttagtttagtgggctaaatagacaggtaaactataaaaacccataactgaaatgtgtgcacagcactgtgaaaacaaaagtaaaacaccctaagtagtcgggaaaggctccacagaagggataatttttaaagcaaaccttaaacaaagtggtagaagacagagaaaggaagatactaaggatcaaaggtgccaagtatgagcaacgttgatgaaatgacctgaagatattctccaagttcagattcctttgtttgagttcagatccctgctgtattgaaacaaaataggagttgctaacttcttcacatgaattcttcctcttttgtgcctattgttaaagcattattgacataaaaggccaaaatgctagcaagtacctttctgtgtgcactgcaaaatccctgggcagcaaaactttcaagcaaataattcttaaactgaaataacagtttatacttgttgatcatttgggagaattataatattaccaatggtacaatagactatttgtaatagtaataaatagtacgatagcacgaatcatactatagtacgatcgtactatttatttttgctcaagattgtgaataattgacactaacattgattattcacaatcttgagcaaggataaaccgaaaaaagctttgacagagaaaaaaatggtaggaaatgttgaaagaattcagattctggctgtgcatgctatttaaagacttcattccaagcaatactataatctctacctaggtttttttttaagattaaattttgtattataggaggaactattgatgctgttctttacttttccccacaactttaaaaataaatttctttgaagtaaataagtaaaatgtctgaatcccaactcctttctaaattttcagtgtcttaaagaatattttgggaatctgttatatatttctgggttttggtcgacctatttaagagtatgaataagttagacaataattgccagtaatctatattaattgtttctcaagtttgctcaatttataatgagatgaaaatttttttatgaagaaactaattcatattttcacaacttagtttttagtaacatgaattgcatacaaatcataattatgagtaacaaacggtggtctcaacagctttggataaagttcctgaaacaaaatattatacagtatatctgagaccgggcaacatagcaagaccctgtctctacaaaaacttaaaaagaattagctggacatggtggcatgtacctacggtcctagctacttcagaggctgaggtgggaggatcacttgagcccaagaattttaggtcatagtgagctatgattgcaccactgcgctccagtttaggtgagagagcaagaccccatttccaaattattttttaataaaaataaataaataaataaataaaacaaaatatcctagtcaatgatcaatatacctgaaaggagtcaggttccattttgtaaacagaagcttattctgagccatccttctcaaaacatcttagctcgttgtcatttgaaaaaataccccaaaccgcctgattataccgttcctgtacaccacttttatggactttgcatagcatagtctctagagtggacctgctttattgcagaattttcaacgcacacccgtgaatctgtaaagagattgagacagtaacattctgtatcctggcagagattagtggcagagccgaattgattggctgaagagtatggagcatttcctgtgttattttcctgctgctaaaaactctttctgcaatgtatggatcaaattaacactagaagttactcctttaatttctttgatatgaaatagtaaagtattaccagaagggcagtttcaaaaatcattattgtacacttttgttcaaaggagcctgacatattgtttatttaatttgaagatctatggctatatggctgcatacacagtggaaatacatttattcacacagttaagatagtctctgaggattcagatggagcaaatggacccaatatttcaattctacatcctttatagccatgatgacccagtactaatatgactttctaaagcacaaatgtagtgatatgaaaataaaaatttactgagcctggaaagctgggttctaatcatgactttgctactacctagcactgttaattgcagccttttatttctgtaaaaaatgaggacaacatgttttcttcctatctcttgggtttgttctgatcatggcaaggactacgtgctatgtctgactgcccagcaatagtccttggttttctttgagttagatctaggtctgccatgcataacatgtgggagtgcggttatccaaagttagattagcctgggaaatgaagagaaggataattctgcagggggacgggaggagtaaatttggtatgtaaggcaattacacttcacaataatgaatgtgacaggaccttgacaggaatagcaaattaaagaagattcttagtctctgttagttccattgcacatgttccactgggggctcttcacatctccagatttgagaattggcttgattttcctgaacatcttttgtctgtttcagcttacagtaaggccaaacagaggataacatataacaaaaacaattatatactgccaaagtaaacctctgtgcaaaagagtaggtttgtagctctttagaaacatataaaatataattagggatatttagggacatatatatgtatagcacagagtaaattcaaacaacagcgttttagaaaatagttgtggctactccctccatctaaaaatatttttgacccaggcaatgtggcaagggtgctgtaccatccctctgtacattcttcattcttacattccagaaatattgaaccataaggtttcttcctaaaaaaaaaaaaaaatcatgctgcagtaagctctttgagagcacaaaattggcattttattgttcctacttcctttccaaaatgtctggtaaattatgaatttcaaagcctgtaaatctaaactcaataactgcattccctttcaggttaactggccaaatacaacaaaaggtgaattacccataataatttttaacacatcattcactcttcaataattcctagttccttatttttaatctaatactcagaaaacttatttccaatatcagtccacatttctaatatgtatgtgactattagaaaggggcctgcaagtataaacttgaagtttatgaaactgagcacattggaacctaatactggccttgtaataaacaaaaatatgcacttgtttatgattggaaagcaggacgtaattcattgtgactgtgagactctgaccattcagttcagtctggtttaaaatattgagctgaatactctgaagcttgtcttgtgctgagtacagatactgagatgagtgttacaaagtgacgttctgaagctaatgaaatagttgatattgtattgttcaaaggtggtaaccaaaatcatacgtgggattaaatcatcagacactctgtagtttcaagaggatccagaatgaatcctcaaagaattgcttagaaaatggtacaggatgatcagaaaatagaaggagggttttactattcatgtatttaataaacacataaataggagatttctgtttacctggcattatttaaaatattttacaaataataactcacgtaattcttagaacaactctttgaggtaagcactaccattatacccatttttcagagagaggaactgagtcacagaaagattcagtgacttgctcaagatcacagatctagtgagaggccaggctaggttctgaatctaggaagtctggcttcagaatccatggtctgctgcctctgctacttatcccttcattattaaaacggagggacagaactccattattaaataactccattattaaaactctgagccttgtgactcagagtcccaatgtgtaatatttgctatcattaaacatttttaaaggttgtagatttaaattggcataccagttactaggtactattgcaatgaaaaaagttttaatttaaaaattaattactactaaagacttactttaactcacaaatgtagatgtccaaacccagaagaaatctgtggccctaagatgtatattttcacatctctggttcccatcataatgtggggctgaatcttctgggtatgggagagcaagtttctccgaaaatgtgacagtcatttttttgtctccggccccaggccacctggaatcctggcttagtctttttattttcccatttatattttgttaatttcaaaacatatatgtgtttattatacattcatgtgttgggccaggagcagtggttcacacttgtaatcccagcacttctgggggctgaaggaggcagataacctgaggtcaggagtttgagaccagcctggccaacatggtgaaaccccgtctatactgacaatacaaaaattagccaggcgtggtggcaggtgcctttaaccccagctacttgagaggctgaggcaggagaatcgcttgaacccgagaggctgaggttggagtgacctgagatcatgccagtgcacaccagcctgggcgacacagtaagactttgtctcaaaacaaacaaacagacaaaaaaccatcacagagtgtacttacagaatcatagatgggatagcctagtatacacctaggctgtatggtatagtccactgaacctaggctacaaacttgttcagtaacctgtaaccacatgttagtacactgaatatggtaggcaattgtaacatagtggtgtgaatttgtgtatctaaacacagaaaatgtaatgcattgccctatgatattaccacagctacaatatcactaggcaatagtttttcacctctattataatcttatgtgaccaccagggtatatatggttcctcactgatggaaatgttgttatgtggtgcatgactgtaatagctgtaatcattcaaagttgtatttttaaaaataataatctcctccattctgaaacctttgagctaacagcctgatatcctggtatgcgaaatcccataactttctttatgtttatacatataaatatttgtgtattaatttgttttaaaatatccttgaggataatcttgtatataattatatgaatactggcatttttattccagtaggatagatttccgaagttatgtgtcatattgcaatcccgacaaatttcttttcacaataatgaaataaatttgcacccattccagtgtattagaatatgtcttttcccatatgctcaaaagcactagctgttacttatctaaagttttgtcgatctggtagaagaaaaaaattatattttattgtcattttaatttctattttgactaataataaggatgagctcctgcttattatcatccattggggttacagatttactgagatcatgatgttcttgccatttgattaatttttctcatcagtttgcaggcaatttttgtatatgaaaaatattaagccattaacacaaatctatctttattttttactttgtttatgtcatttttgccatgcaaatatatctatattggatatatgtggcttctgagtctcccactttccttaggaatattaactctactcctgttcttctcacaaattattttagaatattttaatgggattttttgtattcaaaattttaatctatgtggaattagtttcatatgtggtataatgtaattttattcattccagaagaagagttgtttttgccaaactgttcacttggtaaataatctttttattactgaattgaaacgccacctttgccatatatgaagttcccatatgtgtgcggatctatttctggtctctctgtttcattccatggatctctttgtctaatctgaagccaaactatattgttttgattatggcagcagattccatctttttaattgactggagtctaacaatgggtaatagtgactatttgaacaagttatgcattctgtagagtaaaaaagttggtgttcaactcagaaactatacaattttcacaccaatcatgttactttttcatgatttttttcccatcagtgcatgctaacttcttaactttttaagctgtaactatttattataagcattattttttaaaaaacatctgagtgtgaacattctgaaaaaggcaagactatagagaacaaatatagatcagtggttcccctgggcttgagagggggagaggggactgactgcaaaagatttggagggtactttttggatgatggaaatgtctatatcttaattttggtagtaattacatgacattacatttgttggagctcatcaaacagtctacctaaaaatgtgagttatattgtatgctaattatatctcaatacatacaaatttaaaaaaattttaaaagtgaatgtgaaatatgatctttttaaaaaaaattagggggatgggttgggtgcagcggctcacgcctgtaatcctagcactttgggaggtggaggccagtggatcacctgaggtcaggagttcgagaccagcctgaccagtgtggtgaaaccccgcctctactaaaaatacaaaaattagccaggcgtggtggcaggcacctgcagtcccagctacttgggaggctgagacgagagaatcacttgaacctgggagacggtgtttgcagtgaactgagattgcaccactgcactccagcctgggcggctggacgagactccatctcaaaacaaacaaacaaacaaacaaaaaaatgggggatgaacctgacctacttcctgcaatagatggagcaaccgtcttgacttggctttaacctgctaagacaaaacaaaagcagaatcgtaagtgaaaatatatagggactcctgccactaatgcattttgactttcagtctttggaagtaatccacatttgacctgttttacctctgcaaagatttttagagcccattcatcctgaggaaatgatacaggtttatagattttattacagtgcccgcaagcattcttgggactgtgaaagataccggtattttcctaaagctaggggttagagctggagagctgatcctcaggagaatctaagaagcaattttccacttgaagaaactgagattgtttagttatggttggcagaaccatggagctacagtgttgtcattcccactttctctagttttgatcaatgcattttagggaaaactcttctagttgactcttactagaatatacaagcaagaaactaggctgtctctcagagaccagaggtaagaggcaagaaaagattaatgagcatttttgcagaaagccagcgccagtctcagttccagacagaaggccaggaggttcagcacagtgatctattgaaatagccctgatggtacctacagatttaatgttatcagagtttatcccagaggagttagttttcagagtcagaataaggagctggggggagggaaggagactaagcttaagagatatcatgacaaagcgcctgctttttctcacttgtgaaaatgtaggctatctggaggtaacatgataggagccatcttggattagcagattgtcactaacgctatttatccacatatcctgaagtgcagaataaatctatgtgatttttattgcccaaaccattcagtcttcaggatgattttgttaagatttcctttctgtatttatatttatatttatattggattacattaatttttgtactcattatttggactggataacagcatattaaagcaacgtggaacattaataactcataaaaatatgtagctcttcctagagcttccttatggatttttttcctcttaaaaaccctaaggataattaagtttgacatagtgatccagttattttttttaaaaagcagtagctctctatctatagattgaagaatatctagatgatattataataaatgccataaggtaatatagaaaagagcactctgcatgttggaactgtccaaaatagagtgagctgccttctgaagaggattcctagaaatgtccaatgtgaatctagaggcttttatctgtttttcatttattcaccatgtcttcattgagtacttacaaactcttaccgagaatgtagttaagatatttcatgctgggggataggactggactccatgacctctatgatttcttccatttctatggtttttaaaacatatattttatatttgcatgtgctacatgtgagtatagactatgtaaggatcaagtcgaggtatttatatcaccttgagtattatttctatgtgttggtaacatttatatgcatttacttccatgtttccatatttttgttaagaattttcagtgtattacactaggccatatataatccacaagtttcatgattctacttctgaatgatttctcactgtatctttgccaattaaagatgacggtaaacatctttatgagttttcattgatttatggaagtctaacaaaaaatggcaaatataaatacccctctgtaatatttcactttggcctgaactgtaaataaggatattttgtaatatctacaactaagatatgttgtcacttctatatgttaggaaataagtttaaaatatggagaattatttatgtatgtgtttctttgaagcataacatagatttcactttaactttgtcagttataccattcaaagacataaaatcattagttctcaggagcaggaaaacagttagaatttccaagaaaaagataggatgtacttcttcatcattgaatgcccagagctagacactggggataaaagaattggtctcaaggagattatcaaggcatttttcctcctcattctttagtgagtactctaattcaacaacattagaaaagacacttatgtcctgttatgatattaggaaaagtgattactgggatacaaagtgcttcagaacctgaatggtaaagagaaaagcttgtctcagtagttactatttgatggagagaccatgatctgtttattcttttgatagtgatagagctaatatataatgataacttgatgaccttatcaactagtagctaaggctcttgtctactttggtaacatgacaagaaaattagagattgactaaacatcatgctgggaaattcaaggcaggcatttgtctatcttcagtatggctatttatcctatccaattagccaaattacttttcattcatctgtgcattttggcccttgtagatattgacttaaaacaccaataggcatttaagtccagattctcaaacccaaaataatcacaaaattattataataggtaaaccaaaattatctttagaaatgggaaaaatagagatatgtaaggacattaaaatcaaacataactaaaacccgtcctttttagttagccttttttctttttcttttcttttctctcttttttttttttttttttttttgagagagggtttcacttagtcacccaggctagagtgcacaccatgaccaaaactcactgcagcctcaaactcttggacttaaaggatcttcatgcttcagcctcccaagtagctgggtctacaggccagtgtcaccatgcctggctaatttttctgtacgttttgtaaagacagggtcttgctatgtagcccaggctggtcttgaactcctggcctcaagggatcctcccaccacgaccccctaaagtgctaggattataggtgtgagccactgcacccggcccttcttttaaaacactgactaaaaacagccaatacttacagttttatttcctactattttatgagattgactaaaagtaggtagaagctgttgaccggcacttcagcaactctcctttctatctagtagtgaggatgttcagtaagggatgtgaacaaatgttgagagcagaaagaagaaagggatgctgggcagggaactatagacctgtccttagtaactatagagctgctgtaccttaaatgactatttaatggcccaattggtaatttttgtcacttgctttcaatttcttcagtaatgacatgagttacccgtagaaggaacatgtcattactttgctttttaagttagcacaagactactacaaaaccatcattcctagaggaaatatgcatatatgtatttatttgtttctcatgtctttctccttctgaaaatgtccccaaggccaatgtgccaaggatacctgaaagccctagggcaagcaatatgaaaatggtaagaactggaaaatgttaggctccaataaaacaaagccagatgcttttgactcatacaaatatttcccttttcttagggtaacatgaggggattttttcccctcaaaaatgttgcttgtgtgtgtgtgtgtgtgtgtttaatttccatccttatataagtcacaagtctgtgataactcacaaaaataccagctgtttcatgaacagaactttgttgttgaaatggttttcaaggatcacttcttttacagcttccaaatcatggaagctatatccaagttggcagctctgctttcttctaaccttaagtagggactggggagaccggggaaggtggtcaaaagaaccatttgggtctcagaaccagcaagtcaactcttcatactggaaacattttcccatttgcttccatttttcttaccccttttcagtcctataatcttgcactggggtctgttgaggtcatattattagctctcaatggccacatagaaatccaactagtggagtcccattttttcacttaaaacatttccttctgagcaaaacctcatcaaatgccctaaaaaacctacttgttcatacacggaaggactttggtttcctatgattcaaataccaaagttgaaacaaaactaaattgaattattaccagattatcagggtttggctgaatctttgccctgtatcatgatgcagacagattctcctgaactggcttgctcccaggtgctgacaataactctgagggtattatgggagggatagaagtgttaagtatctctggatgatttgtatgtattttaagcatgcagctacctgaataacccacagtcaatatgcccaaaagagtagaaacagtttttacaaattttgttcttattttatgtcaggactttgattccattgaaaattgtaagttttagaatagtttttgttagtgggtgataggtacattttggttttcttctgcttttgtgtgtgaaaatttctggcaagtcaatttgaaaaatgcaatttaaatttaaatgttaaaaatccattttaagccctattatttcaagaaaagcatgaggactttactcaaagatttgcttggttgtaaaggcaaatcatttataagttttaaaattcttttaaaatttaaatataaatgttaatttttttcttttctatttttttttttttttttgctaagtgtgaaaacactctgtgaatcaaatattttgtactttttgcagtactcacaagtatggaagttctgctgatgggtcatataatccttgctctggtctcaaagcaaacctaaaactgttctggacagagtggtacctagctttttaaagttttaatctccagagaaagctaagaatacattcatgtgctattacaaaaaccaacatcatttcttattatgtttttcaagtctgcttttacagggtggaatggtaaaacaaggaaagattacctttcagagaaagagtaatcgctatttctctaggaatgggagcctcagaagacactgggacattttcagtattccatagctctagatgttctaggaaaatcatgagaaagattcttttggagctatttcagtggctgtagtacttagccaaattagggtgtaagaagttcaggtaaaatataaaagaaattagaaatgtgtttaaaccaagcaaacaaatttaaaaacccacacttttcggaacctccattcgtattccagaatatccaactttcactggtattctaatattacttctattggtaatagtgtcacaatcggtgggtattactaggggtcaatatttgcacaggagaagagggggtcaactttaggcctgaagtcctcacttcatctcctattccagaagcttctcttcatgttttctgaccttctttctgacctataccttctccatcatcaacaacagtcttttctagagtcagtgacataagtcaaggactgtgataggcttggagatggttggcattttaaagaaactttctctgaaaacaggacttggttccaagaatgttataacatgttaagtaaaaaagttatcagaataaaggcttgtaattttcattgtactatcaaaaactattttctgctctggacattaattagtatgaagagatacacacttctctcccaaaattgtttatgtcagtctcttaattttgacccattaaaaacgcatcatttaaaatataggtgattcacggtctcacagagaagaaacagtaaaggcctttcaagatcctttgcacaaaggaagggtatgggcctgtcataggatagtggctgagcccggctcctgattccaaccctctcccaggaatgccccagggtttcagcctcaaaccctttccactccattaaaagaacatgaatcctgataattcacatggcacagtgatgtgactcggaagagtcaacacagtggtcagtcacacccgcaaacaccacaattgccttgagatgccaatctcactgaactgaaggagccaggtgccacacttgttgggtagaaagggcttagaaaacatcagggtagttgagatgttgcgacacaactggcccgcattacaggagagttcagcatgaaagtataaattagagcgctaggtttctctccctctagaccccatcttaactagaaacacaatagagccacatgcacaccatcaaaaggagagtgggactttttcttaacatgtaggtatttattaaatacaaaccaattctgttccaaactctttttctgaggtaggacagtgatcttctagcctccatttgtgggaagtcatgtcaggaaagaggagacccagctcctttcaaattgtctacacaaatacatttcaaagtacatttggtaagttaagtctccatccccaaaagaacgagtaaaacgaacacatcttgatctcacaacaaagtggatgaattcaatagtactttttctggacaacgttccataacaacaagatgtttagttcagtttattccctgctatagtctgaatgcctagaacaatgccttccacatagtaggtcctgtataaacaggtgatggacacatgaatgaaagttttttcacagcagtaggcatcaagcgtcactgtccattggaaacaataattgtcaactaggaaaaacaggaggagtccaatcactgcttcctcagcaggcagcagtattaaaacactcctgcacttcacatttctttcttttttttttttttttgagacggagtctcactccattgcccaagctggagtgcattgtcgtgatctcggcacactgcagcctccacctcccaggttcatgcaattctcctgtctcagcctcctgggtagctgggactacaggggcctgccactacacctggctaatttctgtatttttagtaaagacgggttttcaccatattggtcaggctagtctccaactcctgacctcaggtgatccgtccacctcggcctcccaaagtgctgggattacaagcgtgagccaccgtgcccagcagatatttctttttaaagtaacttgaaatgtaaagatttacactagatcatgctaggaaatggcttatcggcttatcttcttcaaaaacacatgaatgcaacacctccaccccgcacacaccccacaaatgattgcttttgacacaaaattccactttctaacctttaatcctgctgttaaaacgttacttttggaaatgtgttcctggtgctcctacaatcagctttctagcttgctgactggcatagcgttttgagtccatagactttgctttttgacaaccaagaaccacataaaatattcaaaacagtctttattgtcagtacttcttattcatacaccatttttctaccgtttagcacttcattttgggtaatccattaatagcaagtgatcttctgtcactaaacaagaaaaaaaaaaactgtggactatttcatttccgcttcttgtcattaattatatttttttaaagtgtaacattcagatacaacttcttttctctgttttttcctccaaataaaatactctcacaggaccactaaaatgtgagttaatcaaagaaccactgtaacaatcttagctgtttctacaggttggaatagtcatttcattttggtagcctttatgctgttgagtagatcagagagatgagataatacactaaagatctgaagtgacctgcttttaaatcctcaaaaggttaatgcataactgagggcaatgagtgggttgattgataggcattagccaaagagtaagatagttgaacttcacataaaacttccattaagttcaactgtcctttgatgcaggattattttatttgctcttaataatatgatgaaattccttgcggaattcagatttgaatgtacacataacactgcaacaaacatatatgtttatatggatataagatgtgtgatgtttttagatgtctctcaatgctcattttatggattctatttctctaaaaaaatcagtgtgtaaagatctaaaaattttaaaaaggaattcacgatcagtgctcaaaactacaatatcttggaaatgtgatgtcctttttttgccttcatgcttattatgttggataaaataatagtcagacaatgggtccctaattttgcttccatcctcgccacctccaggatttaaaaataatgatggaaaaattcaatcagcacattgggtgattaatgtctggggtgataaagagcaaattgcttcattggctgaagaatgggactaaaaaactataaaaactcatcacttctgaagatccaatgcttgcatgctatgttgatttttaaagaacaaattggtatttgagtagaacaaactcattttttaacgcactgccaatcctaaggatgtttcaggttgagatcttctgtgttgaaagtccacactgactcatcactgtaatattatattccagcccaatttgtggttgcagcaaaaagataaataacagatgcaaaggcaaaccgagtggatcctagagacccttaaatacgacaaaatatttgtccagataaagatctcagacttattattcatttcttcacttattagataaatgtgtatttagcaactaatacatatcagttactaagatagcatgggagggtacacagaggaagaaagagcacctgctcccatgctagcactagagagttctattaattttacagctgttaacttgtttaagcctcacagaaacacaatgaagtggatatttttatacccattttacagatgagccaactaaagaagtgacaagttaagtcactgccttaagcagaccaagtagtaagagtgggcagaaacctaattgatgggtagcatatacctctttagtccatgatccttaatctctaaaccactgccacaataaagaaatataagaataaaaaataaaatcataaattctggttatgatgttcttaaaataatttatatttaaagttattctaatctttgagccaggaattacactactaagaatttatttcaggaaaacatttggagaaattgataacgttgtacatttagtacatttagtaatgaacatttcagttttgtttgagaggatgaaaaattggaaataaccatatatcagttgaattgcttttggatacaggtgagaataacttgattaaagtggatcaaccaatagttgtttttcagcccataggaatttctgaaagggagcttctagagtgtgttcagtagttcagaaatgtcattaaagatccagaatcttttattgttaaaactctgttatgattgacatagtttttttcttaggtttcattcctcatggtcacaagacagctcctgtagctccgggcatcacatcttacacaaagacaagaagaagggcagtttctccaagcatgtctatttttcatcaaggaggaaagcctgttcctggaactttgttatttgcgatgattagccagtttggggactcatacctacaccttagctgcaaagaaaactgagaacgtgaataactgttattcggcctctattatgggaggcaagatttgccaacaagaaagagggagaggctaattacactggcaatcagttgggcctggcagaaattttggtgtctaaaaatgaaatatccgtatagtagaatcttatgctgatatcatcaatgatgataagggtaaagggagtatcacatgaaaaaaaatcaagttataggaaaactgatgcacacaaaatatatacaccaaaatgctaacacctgtctctttgtgataggattagagggatattttagtttcattgcatttttacatactatctgttatttttaaattagcataagatgcttgtactattttaaaaatagggatcctttccattttgaaaaacaatttaattcaaagggaaaaattattttatatcaaaatatcaatgttccttggctctgcttgaaagcagagagttgagtagtgaaaaaatgaacaagatatttttatcaaaatttgttttgcattactgtcatgaagaaatgaaagacaagaaagaaatcaagcaaaatggccactggagaattttaaaattggaaaaataaaaatgttttgttaagagatgatgataccaccaaaagccttaaataaagggctgttgcaacttaatatattggatatattgctctatggatttctcctcctgtgagaatgccttccactcttgccaagatcagcttcgtgccggccacaaaaattaaaatattttaaaagagaacaaaaatactcttattttgtagagagtaattcacagtttcaactagcctgatgatatctgccaatattttagtgtttggttaaaacaaatggctaacagttttcttgagtcactgatcattttaaatcattctaattctatggtatacataaatacttctcactgcaaaaatttcaaacaccatagaagaataaaagttcaacccgaaatccctgtttcattgcctccaaagatccttggttcgtgtccctccaaagagataaccactgttaaatttaagatttatttcttaagatattttctatatattcagatttttttaaacctcagttgaatcatactatacaaatggttgtgccatgtccttttttaaagatcatatgtattggacatctctctaagccattacatgtagatctctctcaactattttttagcagctgctaaatctgtttaaacattcttcttttgatggacatttagattgtccccagtactttgctattataaaagatactgcaatgaacattttgtacatcaattttattcacttgggtagatgtgtttgtagaatctgtcctagctgtgaaattgctaattttcaaggtgtgttcatttaaaattttggtagataatgacacactgctctccaaaaagactgtaccaattacacactccaggcagcagtgtttgaagaggactgttctttctatcttcagcagcacagaacttcagcaaacgtggagggaaatcattgtgattgttttaattcatatttctgtgaatagtagtgacattgaacttctttcataaatttactcaagtaaacatttatgctaatagcagtaccttgcatttatattgggctattatttcttgagaacaccatgggttgatgattccatgttatatcagacatattcatctataaaaaatatatattaattgtagtaaattttttaaatgccagtacatatcaagaataaagaaaaaatcacctacaattataccacatttaaataattgatattacagttttttctcattctattatatgcaattatatatgtatgcatataatgtggatttttaatatgtgatgtagctttattatatgtagagctatataggaggtatttgtttataaattgagatcgtactctatatttttaatattctttttctccttaatggtatattgcaaataaatgtactatattatgtttttatattgcaagttgaacatccctaacctaaaaatcccaaatctgaaatgcttcaaaatctgaaaatttttgagtgctgatatgatgccacaaatgaaaaattccacatctgacctcatgtgacaaatcacagccaaaatgtgatcaaaacattgtttaaggaagaacattatttaaaatgttttataaaattacccttcaggctctgtttataaggtgtatataaaacataaatggattttgtgtttagatttgggtcccattcccaaggtgtatgattatatatatgcaaatattccaaaatcagaaaaaatcagaaatctgaaacgctcctggtcccaagtattctggataagagatattcaacttgtaattagtcttcacactattgctatcctatgactatgtcataaatgtgttagccaggtctttattttgtgttgaacttataaattatttaaattttttatttaaaataaaactgtaataaatatccttgtaagtaaaatttgatattcctctcaattttcttcatctactgtaaatcaaattattggctcaaagagtataaacattttgaagtcttacaacttcaactcatattttaaactgtgtgtttgggtgtttatgtttaaataatttctactctcaccagtgatgtttgagagtgttcatacttctatgtccttgaaataataggaattaaaatagtttttaatctttttcattaataattaaaatataatatgtaattggcattcttatagttaaaattgatatgaaagattttatcatatgtgtttgagtctaaccatttgtatttattccccattaaatttcttcatcatgttctttgtctttttatattcagttgctatacactttcatgttgattcatgaaagctctttacatagtaaagacagtaacatctgtcttcggtttctttcattttttaacatttatctctttaataaatctgacatacacacaaggtacagatttaacaagcaaaaatgcatgacaataggcattaaaaataagtattttaaaaaaattggcctagatttagaaatcttgttatatatatgtgtaatatatactctagagtgatattttcaagttattagaaatgaccatcaatagctaaaattatataaaattcccttttgaggatcccagaatcaaactacatcaattagtaggatctctgagaaagtttaaagtacctgaataaaatataagtatgtagtctttcgagtctcatattatgttgtggagtaagataaggaaattcaaatcctgatgtgttgtgagcgtcagcaaatacttttctgtgctccctttttgtcgtttataataatacacatgaagaataatgatcataactatcttatatggtttttaaaataaattatgtaaagcacttagcataatgattggaataaaattgttactacgtaagtcatcatcatgaatgttaaataattatttttatatttacaaagaagtccttctaccattaaatcctcaaaaaaaaaaaaaagcaattctacataaagtctacctcctttaggaaattccttaagtcagtttatatgtgatgaaagcctgcagtgtattggtcttttgagaaagaccatctttgaagtgttggtgactcagattgatgtgttccttcctctttggtgttcattcttagaccttggacaattgaaacagaaaagacatggccagagggcattcttctccacaatgacgcttccacagatttgacccaaaccatgcatatggccctcagtaggcggattttatttaaatgaatgagattgttctatgtttaattcatgatacaagcatttaaaaacactctgatggagagggcagatcaaaacagaactcaatgtagaccatgtttttttttttgtaaattgctggcagccctttataaaatgatagaataccaaaatgcataattcaaaaaaatctacatatttaaagctgtatgtaaataccgaggatggatgaactgcttttgaattttcactcactactttgtgactttcatttttgttcatcattgacatggcttcatgcacaatttaaaagcctgttttcaaaagaatggggatggaaatgttgtgctttagtgtcttgagaatctggcagcctacctggacctcattcaagggctctgcacccttagcccattgcagggaaattggtggttaactatcagagaggaaagaaaagacaacatgaaagtcttctcagaaaaacacatctgagaaagctcaaaggagtaaataatagaaaacagccaacactcagtcatttggggttgatcacttggtttgtttttctttcctctccctcctactccctgccttttggtcatttcactgctccttggcacttctacgagaggcggtgtgtatgcagggtcaagcaggggaagggagaagatcatcagtcaattttgcatcttgctagttgttccagagaaagattggacagaaagagatgaccacaatgaggactggggattatctgtaactttcaaagaccattgttcctccattattatgaaaactcagcagtgggctgcagcctctcttttatttattcacacatatggagaaagcgaatttggtaagcactggcatatagtccagaactcagcactgaaaataagagtaatgtacagaaatgctattttcttacaaaaaaataaaaatgatttgggtcaggcccaattagatatagtcaaaatccagctgttctcagggtttatccagcattagtaacattgtggtattacaataacaatataaaatgtgctttcagaggtgtttttccatttaattcactaacttctaaatgtttgctattttatccatatgtttctagtttgtgtacatgggatattttgtaaatgtcattttgcaagagctatttgatgttcaagaaggctctttggttattgttagaaagcagaaatcatgatttgtagaggaaaattttataagtttgaaaagattgcttttgaggttttgcttcccttcatttcccttgatgtattttagagagaaaaatgtgttcctccgtctgatactaaaaagagtcttcgtgctgaaagtagaaaaacaaagtaggagatagggttgggagggtgagggctctgctgtctttatgaactgctactgttcaaagtcaacccatccaactccttgagaagtacaacttcagcaatgaaagatgtttaaatagtgataatggatggcaaataaaggaactcttatctttggaattttggagtagacacaagcaagcagtgcagatttagtttaaggcttacccccaaagctgaactttcatgttttatagatcagtctctgcttatgtgcttcaagaacacacaatgaggctttagaggcttggctaatcacatatcaaaataaaactacagcactttatataaaaaccagtaatttgaggtaagattattttctgttttcccacaatcacagtgtcaggtgaatgaggacatgagacactatcacttaaaaagtattacaggcagcagaataataaattatactccaacatttatgccttcatttgctcattcattcattcagcaaatattctactatcagtagatcctcctcaaatttggaaagctaaagtaaaaatgatcatagacaaagcttatttctattattatgcatgcaactcctctctgattaatccaaaggcaactgatagatgaaaaatcaaatggcttcagatgtggcaagaaatattcttatctgatgcaaaggaattgtttatttaaaatagccccaggctttccttctaactgttactaaaccagtggccccaaagtcaattctgtcatctctgattaatataatagtgtcacatttccatcaagaaaatatcactcttgcacagagttcttagcatttttcacaatcagactttcttactgcagcttgtctgttgagcttggattcccagagcgcaacattctgtcaggttcaccaatgggactcaggccagttggttctggacagcctcgctccaggtcccacagtccccaggacccaggctcagtggctctgttctagtctgttcatctctgctcaaatcagttcagcttgaacagcagtctgggctctcagttatcccttccttgagaagttttctccccatcaaaagtccctaattttcttactgctctacttttaccttttcatagacagactctctaaacaccaagtcagggccaatgagattataatattttttcctgaacatatatttgcattttaattatggtcattttcatatgaaaaatgccttttttttttgaagacttttctgaagtccattatctttagcactttatttctttctaaagtttcggaaccctcacttagaattcttgtatttattttaccttcttttctgtttaactagacagtgggcctcatgaaaagtaggaacataatgattgtgtttatttgtgggtcctgtgcattttgtataatacctggcatgtaataaatatatgtgatgaatccatccatccatccatccatccatccatccatccatccatccatccaaccatccaagatttattgagccagatgctgtgctaagtaataggaaagttatgccagacccagggggaaataatcagggccaagtgggcctcttgatgcccttcaaatcacactccactggcagctgcttacacacttgtgcaggccagcctggacaaaggtcagaggggtcaagcacaagcaaggacaaagttcacaaatcagtggctcctgacaccatttgaaactgttaccttcaacttcaagggtctaatactcaccctgccaagaaaccttttaacgctctaaccccatagtttcctccccagctagtgtcccactgcaattggcagattttaggactgatcttctaagaactagaaagtccctaggtcaggtcctaaggctctggaatgcccttcctcccaagtgctgctttcttctacacaggccaacatgctaaaaggctcccttttacccctacagtccgcaggtgacctatgagcatcaaaaacttgtgttttctaaacctctatttccttcgttctgcagctagacactaattgttttggtagaggaaactgtcttgtctgaaaagctaggttatttctgacctctgaaatcactaggaaagggagactgaaaaaatagattaaatcaactcaaaccctctcatgtttcattaattatatataaaagtaactttcagattatgactaaaataccagaacatgtgacttaacaaacaaatggacaatgtggtagtttctcctgcaagcgcaaatatatggtcagcataaaatatttaactattacccattaacaaagtgaaatcttagcttttttaaatgagatttcagtaatttgcagttatatttctcaaaaactttgcccagttaccatttgtctcttacttagtattattaagctcttgagcttcataaaatgttacataactgtttgtgccaagtaattcctattttaattttttgtaggtctctacaaccattcttattttaaagatatcatgagctaaataacactggtttctgtggatttgaacaaaatcataggataaaaactcaaaatcctgaggctttgattgacctttttaacaaatatttaaagatgttttaaaaaatgtgtaagaaaattcacataattctgctatttttgtttttgtccaaggagagaatggctagatatgcaagtgatgaaagagaaagagcactaaacttatagatttcaatctctgcaaacactagcttacaaatggtattttgcctcccatgttgactccaaattatttcagctggtattgtacaattttcaaagaccagctaaatataagttgtattaatatttaaataaacattgtttgtttggtacacctttattcttaattccacaaatatatctttagtttcctatgaggtataaggcactttatctcacctacatcattcaatgaaattgataaaaagacttataagaatatgtacaaaataaattcagagcaaaaatacacataaatagaacgaagataaaagactatgtaaaaaatttgaatgcagatatgcagatagaaaaaattatagttattcagattggactataaattagcttttaacttgttgaaaaccaaagtaaaatgaaatcagtaactggattcctattatttaataaagaaatatatatcagtttacatagaatgcttttaatggctatttaaaaataatctagctcaaactgacacagcaaataggagacatattggctcagatcactgggagtccacagccaaggtcagcttcaaaaatatttgatccaactatgcatttggagaagttatcaagaatctacaatctttctctctttcttctataatctgcagtgttgagctttatcctaaagctagtttttctgtggttgtatggtggaaggagccaacagaaagagctacatgctttctccttcatgttagatcagggtttctcagcttgtacattcttgattcttatttgggctgaataattagtttttctttgaaggatgtattttgcattgtaggatgcttagctgcatcatcttggccttgactcactagatgtaagtagcatcccccaaatgtgacaatcacaaatgtctccagatattgcaaaatagcccaagattgagaaccgctactgtaggagaaaggctctctaggcaaacaaggggagattttcgcagaagcccctggaaaacatctcagttaaaagtgacctaaattgcatgtccatactgaagccaaacattgctaagaatagaaacactttcattaggactaattgaaccaatcaagtccctggcgatagaggaagagtcagtttctcttgaatcatgggcttcatagggaagagtgaattcctgaacaaaatcagggatccattagaaataaataaagggataatggattcagggtaggcaatcaacagcactcacaagacaattcctcaggaaaaaaaaacaaaaacagactgattctgatagtatatgtacacatatatacattgaacatatgtatacatgtatacattcaaaagaaattagttaagtcatcacagaggaaatattgagaaatgtggtcatttatttaaatccgcattgagtatatcccatattccaggccactaggtgatagagtcatggtgatgagcaagatgaatacatcccctgccttcattgaaccagtgaaatatacacttgaaagagatcattacaaaaaatatgatgagtgttgtgttgctgggtgccatggaattattacctcactttgcctaagagtcaaggaagggctctttggtatttgcctgcctggttcactctctatttctagcagatggaaatgtggatggctcatagtaggcttccatgaatatttgttgaatgaataaacaaatggatactaaaatattaagttcctatgatgtgccagggagtgcttcaggttaaagagaaagcagtgaacaaacaggtgggaaaagacaggtaaaaatcaactaaaaagatgtggccaatatgtattacaaaactagtctggcttatgatgtaactaagaacataagtatttttctgtcatttttattttatcaaaagggataagtttactcagccctgggtgaaacagtgtcaggcatatgactattcaatttactcttaagtaatttagcctatgatcactttaagttgcaaatatattctcaatcaaaaaattgagtggccaatcccgggtaattatgaacacattaaatttgacttcgtgttaactcttcttcctggtccccttggaacagcttcaggctggaaggcagacctgctccctctgctccccagccttcctgcctcgaatcttctgtagctattttgctcctgactcaggtaaaatggaaaacaataaagccaaaaaatggaggtatgagggaatactgttgggactgtagtgaagtgagtgaggtacttgcctcaggctcaaaatttaaccaaaaaaccctcagtaaccaagataaataagatttagtgaactattacatattaaatattacattaaattaaaataataaatattaaaatatttggtattatttaaattaatatgcattaatttaatgaattactatttattaaaatatttaatgttgaaatattaaattaatattataaaatttatatggaaatattaattttaaaatattttaatgaaatatttttaaaacaaaaataattttttaaaattcatgatggaaaaatatcaacatgttaaataaagacaagatcagtgaccatgacttggtgagccacattagagcgggaaagaaaataatttgtaatatgatggcagggcagttagtcttgcagaaggaggatggaatttagagatatgttgtaggtaagatggtaagaatgagtggttggctagatgtggtgaatgctcaccagttattgggaaaggaaacataggaagaaaagtgggtttggtggtggtgaaataaattcaggaaaaatgaaggtcaagttgagattgcagtacctgaaaatcttcatctgttcatgattgcagagggcccttgatccatgggtatagggtttatgataccttgaacagcattaatcgttctgctaggaaccctaaatatacactgaagggagaatgctcaaggatagcagttctttgggatcaggatgggaaggagtaagtgggcccccaaacaagggaatccaagtgcacagcttctggcagtccacattgatccagagatttaaaagtaggctagctacaatgcattattatgtattgtatatttcaaaatagtcaaaagaagattttaaatgttctcaatacaaaggaataatgattatttgaggtgatgcctatgttaattcatctgctttggtcattccatgatgtacacatgtacagaaacatcacattataccctataaatatatacacttattatttttcagtttaaaagaaaagaatttagtgacattaccttacctgtctgtaaaagggattggaaaatgtaattttttgtgttctattttcttcttacaaggtagccatcagcccaggtaagaaaaaaatgagggtgataattcagagaaagcaagtatggggataggaaaccagtaacctcatccaaaccaggcaacttgttaagattgtctgaactaacatcaacctttgagacctagtatagcacttcccacttccaagtgcccatctgagtacttctaaatgaagtataatacctctacaaaatgaatgtaaatctttaaattatttggacatctcatttgtctgctaaagggagaggaatctatgaatagccactggttataagaagaggtttgaagaaagggaaaagtatgacatcactttccacagagctgccactctttgaattttgtcaaactggttacaatattagtattaaaaaatggctttgaacacacaaaacagataattacagaatgcaggcctaaaatacacttcttgctggaattttaattctgagtggttgctgaactaggtaggtggttgtcaaatttagtttactctgctctgatcaaggaatgtgggttgcatcattcaaaaccaacacgatttaaagatatcttgtaaaaaggagtagtgctaaaattagttgcttgtcagtgattctggtcaccatgattatatggtaaagtatttgtgaacatggcatacagaaggggttatgtctaagtggaaggattttctcatagagcaaaactgttgagcaagacttgattttgaatgatctggaatgaaagaacccaataactttgaccattatctaggcttgtattttgagtcaactaagattcttttagtgacattctaccctaagtggaaaccattgataactttataaaatgaacctgaaacctttcaaagaccatactcaagtttcccatcatagagctctgtatgtcaaaccaagtgtgtgagtttattaaggtattcccccattgccagaaaaggtttactttacccattaaaacctcactcaaatagatatcaagtatctcttatatcctgttacatgatgtaatttaagtctgaaaatacccatgctttgctttaaccagaaatttaaaatctttctcaatggaagcaatagagtatatcactgataaggtaaaggtgatccagtaaaaggtcacaacttagccccttctggacaaacaataaaaagaaatttgtctgctcgcatgttatgtggcatcaataatccagcctattttagcacatcaaatcccttctatgctttgaagccaacctttccctatatccagtatatactaggtagtcatggagggctcccccttgcaaagtaattataacggagctataaaagtaagaccagaagtaaagtgaagaaagggcagacagatggttcgttgccatattgtccattataggggagtggagaagtttacttaatttataatcatgggataatctgaagggaaaaaaaaaccccacaaactctcttttctctgctgtcaaactacagcaatcaacatagaaaacattttcccccatataccaagcaatcaatcaatcaattctgcaggggaaatcagctgggtgtcttctagttcaaacctgacactgtccacctggagacaccatcaagtgctcagtcccacaaaactgcccccttccactgcagacaccaatcgcaagttagggcctctggaacttctcaccaactggcttcaagttggagttcccatgattccctctgtaggttcaattaatttgctagagcagctcataaaattcagggaaccatctacttatattttctggtttatcataaaggacattttaaagaacacaaataagcagccagatgcagcgatacatagaatgaggtctggaagggtcccaagtgcaggagcctttcctctggggtgttgggatgccccactgtccaggcacatatataagttcttgttcaccttcctgtaggcttccctgagttcagctgtccagaagttctccgtaccctgtcctctttggccttttatggaaacctcattggacaggcaggattgaagcatggacaaccatgtagaagtgtgattggacaaaaagggtataatctaatactaatagactgagaggggaacccagcaagacctatctgttgaagttcttcttggcctctctatgcagcattccttcctccagagcatggggcagaacaccttctgaaataggggtcttatgacctacagacaaggtgggtcagataatctttttttttttttttttgagacagactctcactctgtcctggagtgcagtggtgtggtcttggctcactgccacctctgcctccctggttcaagcaattctcccgcctcaggttccccagtagctaggactataggtatgcgccaccatcttggctaatttttgtatttttagtagcgacagggtttcaccatgttggccaggatggcctcaaattcctgacctcgtgatccgcccacctcaacctcccaaagtgtgaggattacaggtatgagccaccgtgcctggagagaatttctgtatggccagctcaaagacagagaagattagagtatatttttagtgtctatggccttcaggagaaataaaaagggacatgggagttataagccagaaaccatggataaaaacctatatgtatgtgacatatatatcatatcataatatcataggttgccattatagattcttgctaagagggaggagtcattgtacccttgagagaatgatctgatatcatgatgtcaggtagaatggatgggaaggccagttaggggctattgccattgttatcacatgctacagccccaggaacatcctaactattatctggaactctgagacaagtgagaaaagggcaacattagcatttgccaaattccttctctttggaaggatgacttccaaactttcattctaacttaagtcttcttcaatcaaaaacctctgcagagccattttttttcatcccccgttattttcattcctgggaataatttagcatctgtctacatttaaatgttacctttcccccaaatagattatgaccaccctaggaccagttaaatggggcttatctcattggagagagctacaaattcatctgtgggaatgaattctggccaggaaatatctgaagggcatattactttctctcttcaacaaaaagcaagaagttaggagatgggacagaaatcttctgtggctgtgaattttagtcagtttgtttcaatcctgagatacttaaacgtaaggcatttgcaacattgaacaacattgacatcttaaaatcatgtaagtctacagtgtgaaatgagggcctcgggggacagggtttccctcatagtcttgtaaaaattacaaatacacctagtaaggtaaatagaattgttctgtctctgcaaattggcatttagatgtttatcttctggtaacatgttgtgacctcagatcatgcactagaaattaaaatttcacagcctcttcaagagactaaagcatcatgacacactttttcctttttacatgagatatatataaaccagatatttgtttctaacgtagagaaagtttagactttttttatgccagagaagacaacatatgcagtgaaaattattgtattaaattgggtggaaaacagtaatttactttatcttctctagataaacccccgtcaccattttaccattttccatgacaactgtatttagctgagtacgatataagctttgcaagccaaaagcattacagctgcctttctttggacaccatcaacaaaatctgttgaaaaaagttgagaaaaaaatgggcacatgagtgtctgtgttctctcgtttgtgatgataccaagttgcttagtattccgtgacattcaactgaattttgtatcggctgggaataaaacaaccgatatgatgagacatgcagctaattgggattggcaatttccatgcttctttagatatttgtagaaaattgtaaagatgaagtgcaatatttgctgatatatgtcaaaactatctggaaaatccagtaatgaacaatgggagataaaaaagaataatggcttttgaagatatatgtaagtagcagtttatttgtaaatgacaaaggagtaaaagggtgataaaaatctggctcatgaaaaataaaaactttggatccaacatagaagcttccattttgctcatataatggaatcccagttggggccagccatggtgggctccagctcttccttcaacttcccagaactaatagagatttgtttctattcaaagttgcaaaactgtctaggataagtactctctcaaaatcaggggaaaaaatcccagcctctggaattatttgatgtatttagttatttgtgcaaaacgcaaatacatatcttttacttctcttctgatacagaaagttaaaccagtatcctaaagccaagaacaaactgatatgtgtacatgtatcaatagtatattttctaggtctaaaatcggtcatgatcccccttcagcctgtcatgcacacagatgaagaaagacagtggggaggattcagagacagggagatgatggggttcaggactcagtgaaactcctattttgatagggttcaaaacacagcttctagccatttgaggaaacagcagaagcaagaaggtttctctgaccttctcttgcccttctcccctgaagcaggctttaaaagaattctctctgaccctttctctgaagtaggtcataaaactttcattccagaggtgcccattctgtacccagagggaaggaaaggaacatccttatcctcaaagctataaatgccaggatgaatctgcataaacaggttttgctaggtccccccagtttgttaccattagatcatacccttttgtcctccaatcacatttttccatgactttccactcttcatcaacctaagcataaaaatatgtgcttacttgtttctttgggtcttcatttctgaaagtccccatgtcacttattaaataaagcttattaagtaaatttgtatgcttttctccgttaatctgtctttgtcagttttattttcagatccagccagggaccccgggagagttgaggaaaattttcctcccctacagagacaaggagagagagacagggagttaacatgcaaatcgacccaacaggacaaacttcaacccagccaaagctttgggttatctcaaagcttgtcttgtgagttaaaatgatcagatatctaggtttgactaatttcgtagggttttaatgcttttaaattgctattataaatagatctcatattgcactgctatttgatgtcaaccactacgctaaatgctttacattcgtgacttaatttaatctccgcaaacatctcattagttaatatgtgcccattttacagataaagaggaatcttaggtttagagaggattagggcagaagccaggatttcaactagggtttctttgactcagataccatgaagcttttacagaagcttttaggatttctataattgattttgttcattgataattgcctatgactcctacaaatttaattaataagcaattactttttatctgacttgcaacctgaaaactatttgtatctattattatttataggtgcaaaatgaaggacttccagtgctactgccagtattggaaataatgcctctgataaacagctaaaggagtgaacctgtgcttcaagcctcccccagttcaatgtaaaaagtgtttctaatccttggccaaggtagtcgtgtaccatacgtgacaaagcctatcagttcttaggaaaaaaacaacaaaaaaattgctgtttgctttattcctgaaagaaatcagtagaatttaatactatgattgtgtgtatcgaaggcaaacattataggttaattgttagttgtctctcctctatttactttacttttccatcataaatttgatagaacaagtcgttaaagttgtacatcttcccaatcagacggagaagaacagcctcaggtctcatatcctctcatatatataatactctccttatcaaccctggagaaaatgagaattggccaaaacttttgttatcaatctgttatttaggtcagcattcatatatggtccatggaggatgaatcacaagatattgagtttagaagtgtcctctaatttcataaaacacataagaactttgtaagattaaaaataatagtttgtatcatcctgtttttttagctctaaaagtatgcctgtctatataaaaacatatagatatatatgaattccctaccctgctaatcatcaaaagaaatgatttcatatgaaaattatatttattcactaatactcctgctaacatttatatttgttaattaatacataaattgaaatttatgcaaaaattattctccactggtttaattctttattctaccagaataattcttctatttggaatttaaaaacatatatccataaattctggcatttctatctcatcagtttttgtagaaatgtatgacaatattttattttatattggtagagtgaaaacgattttacatattactaacattttctattttgcacggaaaactttaaaaattcatcaaaaggtaaaatgtataaccttcatttttccaatagctgttagcatttctcattgtgagtgaaaaattgtcttgtcttttctcatcaaattgcaatggaagtagtattagtcacagtttgcatggaaatctgccagtaaaagaaagtcaaaaacatttctcttcaagcctaataaaaatgtccagtggccttttgtgaagctataaagtatgactcaagataccagccaaaacaaggaaagaaagaaaaagacagtaaagtctcactttttctgtaccacttacaagtatcccaaagctatgttttataagagaaattcgacttcggtgtctctatctatcctcccctgagctaggaaaggaaaagaaaaccttccccatcacaagtatacaaaagaggagtcttgctggtaaggttagcatctgtcaatatcaggtccggtgtgaaagcaaagccgctctttgaattgtttgcttaataagatctccagtgaatggagtttatctgcagcttggggtttcacagggaacacaatgcttcgtgtgcattattttagataggaaggaagttagtttcagtaaagcaagagagaagtgataggcttatcattttattataatttgagtttttgcatagaaaacagtgagttttctaacattgtccataagcatgataattcatgtatttcgtcgcagccatctgatttttctctgggacattattatttgtaatgacttctattcattgtttgtgttccatttgtgaaccactgctatagaattttaatgagtttcatgttaaacaccttttagaacacattctttcagtcattctatagagagtaagaaagcccatccatacctctaaaatttactaaaatctactacaaatgagaatacttcattccaattttaagggtaatttcgagaaacataaaatcgttaccttagtctactgaaaactccatattcagttccaaattctcagcttcctacactaattacaggaactgctacaatgtattatgcagttacatggcaagcaatctgattccccatttaaacttgtcggcaacctgggaaagaggtatcacggttctgatgagaaaaccagggatcagagagtctgagcatgtgcccagtgacatgcagttataattccaatctgaacctctctgtccataaacctcaagttctctcatgccacattgcagttgtcccatagtgttcacagaataactttcacaaaaacaccttttacaaaagaataaatacatttctgggacccatgatacttaccatggctaaattcagagcacaactgatactaatcttgtttccttggtcaggctttggaaatcttggttcgtggctccagagtgtcttccagttgcatctcatcaaagtttttaacataatcgcccacatttgtaaatttgcttttagtctcaaacattcagacacctctaattatcacaccaacaacacaaaaaggcctgaactaattttacatctagagtttccttagcattcagtctcatttaaactttttacttaacccaaacaaatcggtccattaactgcccaaattagtgtttagatgttacctaaaaataataataataatggttttactcaaatatacatattggaagaaaactgaatttgtgcaagcaggtctaaatgatacgtgaaaaactctatagtaaacattttcgcagagaaatttgcagttacctggtgatttcaggttgtatataaagaagaattgagcaatgtacttcttgtatgatctcccatttcacaaaagggattaatattatttttaccaatggcttaatgaagattaaagtgctgatgtgctggagtccgctcatacctttaagagctgtatgtgcacatctcttcacaactctgcattcactaaaatcaagctggtaacctgaatttggccatggtaggagtatttacaccatgaaaactgacagactataaatcaagcctactttctcttcccccctacttagatccagttattaaacatttactagcacaatactgactaaatgagataaagcgtcaataatgaatactgaagtgtgcccgcatggttgcaccaggtgcagggagtgctgactgctgaggacttatagctgtaccttctctgcagattgcccttagctaaggggagttgacttgctcaggattatgccccttccacatcagacagctggatggatgtggagatacaaagacctgggcccccgaaaggccattccagctccgcagcgtcttgtgggattagctaagtggtctgttggaactgcatcatagtttaacatttccctttgcctagtcctgctttcctccctctgagaacaccccccgactcctcctcactccctgccactaaaactgtctgcacaaatctctctctgtctcagagtctgtttcccagggaatttgacctaagacatacatgtaacattacctagcacacagtactcgaaaagggtgtgagtttctaataacatatctgtaatcattctttcactgtaccttagttctaatctagttgttagttgttagagttagaggaaatgatttcaggtaccttttccttttcctttctttttttttttttttttttttttttttttctgagacagagtcttgctctgtcacccaggctggagtgcagtggcacaatgttggctcactgaaatctttgcctcctgggttcaagcaattctcctgcctcagcctcccgagtagctaggattacaggtgtgcaccaccacatcgggctaatttttgtatttttagtagagacagggtttcaccatgttggctagactggtctcaaactcctggcctcaagtgatccgcccacctcagcttctcaaagtgctggaattacaggagtgagccactgtgcctgaccccttttcctcttattaagttaaaaaaaaaaattctgcattggacaacacaaccaaataatggctatgtacaatcttagttggcttcaaaatgctaaatctgaatcaagtcattttggaggccaagcagacaattggaaattcaaatccatttaagagtcagaaaaaaataaaatggttaaacttgactctggtgataaaataatttcaggagttcatcaaattttggttggtgatcttcaaacacatctaattttgaactaagaagacactgtactcagggatcctcaactgtaacacgaatgcaaaattgataactccactgttccgagaagggtaactaacaggatgtttctttagtaatcagattagctgatataaaccttctttggtcaatttcaaagaaaaaaaaattgaatgtgatggccatgttattcccctcctgagaccacacaggacctaagcataacacatccattgggaggattcaatgcaaaccacaactggaaaacattgggcagccattcacagccacccagtaaaataatattctatgtacattcttggttatgcatgaatgttatgatgactgctacgggattaattattttatttggaatcataatatttctcagaatcctatgaggaattttacaaaattaagccataataattcatatatttgttatacattaaaacacaatatctcaaacagattagaaaaactattctttttttaaaaaaatatttttcaagacagagtttctctcttgtcgcccaggctggagtgcagtggcatcatctcgactcactgcaaccttcgcctcccgggttcaagtgattctcctgcctcagcctcctgggtagctgagactacaggcacgtgtcaccacgcccagctaatttttgtatttttagtagagacagggtttcaccatcttggccaggctggtctcaaactactgaccttgtgatccacccacctcagcctcccaaagtgctgggattacaggcatgagccgctgcacccagccagaaagactattcttaaagcattcctttctatgcattggaaaaatcacattgaaggaatattgtttggtatctgatttctagtatggaattcaggctcagcaatatggtgaccatacgctactatgggaggttactatcttgatttttttctgtttattcgctgacttattacttaatacagacaaccctgggcaagacagtagagaaggcactaaggataatgagagaaatttagaaaggttattcctttaataaaacccatagctttatggaagagccccacatgtatgaaaacaaattcaattcaaaatagaggtaatttagtggctatcttcccggcatgcttatcttgcttttctagataacatcacactgctcctctacatcctttatccccattatcctttccatgttactctgttggctcccagtcatagaaactaaatcccttgacacatcagtctcaaggtgtgcttgtgagaggccgatcctggggttatcccaaccgaagtttcttctcttttggatctggaaagatgtgaagcagaggctgaagacagttactttcccacaacttgcataagaaagccaaagcaaaagaaaatatgaaatggtttccaagctcttgtccaaccccaagagctggtttccatcactgatcccagaagcaatcttggtatccttttcaacaagcttgagttgagtttctccagctctcaacagaaagtgctcaccaaagcaagcatcgggaacagctccaggttttgtggggccccaggcttataccatttggtaatcctcttggaaaatgaaaacaaaattacaaatgcaccaccaggtataaaagtgcttatttattttgaaggaaaaggaaaaataaaagttactggacttctggggactcatgtctctggtgctttacaaacatgcttacacagaattgcttcccagttgcaaactggcttcccctcccacagagaattctacaacaaccagcaactccttggacacaaaggggcctgtgcgcgtgagggatcctgaaggtcaggcttcactcactgccagataaatctgcctccagcagcacagatgtctaaagtacagtgggagaataaagagagaaagggcaaccccagtaccaggaaaggtttctcagaggggtgagcactctctggatgattaatcagcattctaaaacagaaagtgggcgggtgatccaaggttgagtgaattatttgcactaagttacagtgtcaagaaataatcgcatgtttgaggaaagtttatctatttaaacatgaagacacatgagaaaaaaagatgattgcagagtggcaaattgaagaacctctctccatataatcctagaatatgctggttaattttgtgtttttccttcccccctctactcttcttcctccttgtattcactttcctggactttgatcttctaggagggaggatacttcaaagccctgcttccagaatttgtatgtagagcatacgccttctattcttgggatagaagattctccaccaaatcccactattttgtccttttccttaaaataaacatagcactcaaaaagggaagaggataatggagcacaacaataacaaatgatgttttacagcaagatccttaagacactaagaagcttgagaggaataacaaacactactctttttcaatataggacctatgtcaccaaaagttcaccagtgtggtgctggatggagttgtgtggaaaaccagaggattttttttaactagagggaaatgaccctccatatatttaaatatatgtgtatgtattaaaaagttagcatcaaagcaaattgattcaacttttcacagaatttacacaagaattctaacatagaaaaagaatatgggtccacactctgttccccatgcactcccttttcctgattctgattttaaaacatcacttagcctgggatatagtgggcttggtgagtcctgttaactgtactcaggaccagcttgcattagttaataatactcttaaagctaaagacatatttgtgtgtgttctggaggaatgggggttaggggctgcctaggggccagggctgaattttgtttcaacgttcctgcactgtctcattgctaagtgtcactaccctatcagacatcctgccctgtcaagctgtaatgccaactcaagacatgcatcagagccagctcttgtctgttttgtgaagcagatgctgtttcctgaacctcatctgtcctgccctgtaccagctatctgttgaggtccctcttcctccctgtacttgcagacgctctcctgaagatgctcttgtctcttcaggacagagtgagacacacatgggcttgtctttcaggtcaatgtccagtgttgtttacttttcttgctccccttgtccataacatttctgtttgattctcccctccctttgtccaagtaagatcttccacaataattataatcatgaagggaaggtctctttcttcctcctctaggtttgaagctctgtatgaatggtggattgttttagactgtctctcagtatagtccccaggtaagacctgggtaagaccaagttcctgtgcatattgatcttcaaatttgatcttctctcaataggaggaggaggagaaacgggagttattatttctagtgtcatttctggggaagacacagctcctaaaacagaatgctgaaattgggaagacagtccttagactaagcaaggcattacaggactttgggaaggctaggctccctgaaggcgtccacctggtgagtagatcaaggcaaagggatccctgcgttacaaattgaagaagccatattttgaaaggcagcttatccagtaggaaaattttcaggaacaaggcagcactgtaatttccatatggcctttcatgtgacctttctccacttattaccaaccacaaagcaactggaattgatgtttaaggagaaagaatgtttcttcgcaagctacaaataatgaaatgtggtatatagctttccttcccagatgacattcaccttttatgtttccatctattacccacatctcagtatacatgaattcagttcgtgtgggtataatgtctcccatgtgtctagctcatgctgggcaacttgagagattacaaaagagctacaagctccagagtctaccctatgggagacaagactgacccccatgagactttttaatgcaacaatagactttgcaaagtgcaatatcctatcctaaaagacccatccaaacagaaacaaacagaatgatgctattttcaagtgtgtctgagaaaatgtaggttttcctaagggtctgtcttcagctccttcatttggtcatcccacacactgttttttgatgatctcttgctttctaatttaggtttttcttggtcttattattgtagtagtgctggtagttttttcattttgtgtgtgtgtgtgtgtgtgtgtgtgttttcgagtgctataactaaacaagaacaatcacagatacctgccagtgcttttttaagcaaggacacgttgatagccacagcatcagtagctaattcacctttatgggaatcccatttgttattttgacctcttggctcattctctaaccaaattggcaaaattcccaatccacccaaaggtattataaaaagcattcatcctattattgtcttctcttaaaccctcaggtaaaatgaaagaaaagtgattcattcaatattgcctttcatccattttgaaaatttgagtttatttccaaatacactaggaacaattcttttggacaagagggttatgctattctaaatcatatgcatcgggccatgttacatggtctgagagtgatttaaaagcaaaaacaaacaaacaagcgacaatcaatagttatatttaagacgcttaagggaatggataaccaagttatttaaggataactaagtaccaattgctcaaattaataggtgcttatatgtcacaatgtcaagctgtgacatgattctttgcctcttacagggccttgagagaaataggggttgagtcatttaaagcatgaaggaacacagtgaggcactcataagatgagaccggttactgcaggcgagtgaaacccggacttcccggggaggctctccaatcaccatctcaccacttaacagttcagttaacaaatttggacaaaaagcaactgaaaacttcatccttaatgatcaaacccccttgaagccgaagtttccaaaggctttactaaaagaatgggtgtcactaatcaataatgacactgagcgggacactcccaaggagcttgctttctgagagatgtttgttaacccagcaggaagagtctgcagtgaaatgcttcttacttcagggttaattatttgtcttttttctccagagccaataggagctcaaagaaagaataaaagcctattgctgagctccaggaggaaaaaaaaaaaaaaaaaaaaagtcgactctgctgggttcccagcaactagttagtttttggattgcttttgtcttggtgagagagaaattcctggagtgtggtcaaaggatcgtcactgtttttaatagagtcaaggagttttctgtagactaatattatttttgaaatgcaggcttccacaaatcttttgttttaggacactctgacagaatgatggtttattgtgattaacataaaagtaaaagcaataaaaaggtaacaaaaagaatcacatagttgggtcaataaatgggtaacatttcatttctgagagaaaaaaatccatttgtcatgtgggtgatttttcatttttaaagtcacaggttaagtaataacatacatatgaatcaactttttggttagaatcttacttctgaaacgtactgaaagaatgtgtgctttttttgtttgtgtgtgtgttttttattagaatttttaactaattagtatacagaaaaaaagtccttgaaagcattttaactcctaaggtaatgtttaatgttcttggaatttcacaagaattctgaatataattctaaatgaaaatggagtttactattaatgaaaaattagtttgggacaaatggtctttactgatgttttaaatatgagagaatgtttgcgtggttctttctgtaccatcctcgggctaagtactcacaatgcagcctgcagcaccttgtcacattttactatcacttttggttcacatggctgactcccaactatactttgagctccttgagggcagagttcatacctattcactctttctcacctacaatttaaacaaatatttttctagattgcatccgtgtggtaggctaaataatgtcccccttctaaaccttggaacttgtgactatgttaccttacatggtaaaaggaaattgcaaatgagattaaatcatccaggtaagcccaatggaatcataaagtcctttataagagaaaagcaggagtagtaaaagatgtgatggtggaagcaagaggttatactgatgcagggaagtagtggtcagcgggtcagggtttataggtgacctctagaagccgaaaaagacaaagaaatctattctccctttagggcctccaaaaggaaccaactttgcctacaccttggttgactacatttgagacaatgtgttacagcagcaatatgaaacagcaatacagtctgttattatttggtgcactaagattaactattctccttgagttctctgatgaacctcttggtatcacatattcttagaaaaggcagcaattatttgaaaggtgaaaattcttgagtttctaagttaaacttcctggattcaaagctcagctctgtactaattgctatctgaacttggtgtcatttaacctctcaaaacctcactctccccttggtaaaatggagataacaatagttcttatagaacaggctattttgcctctgataattaaataaggtagtgcatgtgtgtgtgagagagagacagtgtgtgtgtgtttagcacattacattgtatatagtatattggtcagtgattttggtttataattagaaaatgtaagcataaaaaaaattgactgtgtctaataaatcaccttgcaaaaacacagattttggttggaagtcacttgtcgtgttgcccattacaaatgacacacacctaggttgtcacagagcagaggaggaattttctaagtgttcacttttccaataggtttagtaactgaggacagatccagaacacaacacacttaagctaaagtgacttcatctttactctggctctcttagactgcctgagttctcttcacattacatgtcctgccaggtcccggagccttgcacaggccacatgccctcttccaggaatgtcttcatcttactatcaacctctttcttccttagcaagatctgcaatctctgtgacgtctttcctgccttctcaagctcctagttttgaattccagttctcccaacatactgtcataagaatctccttaatgcttgtatctaccttcctaccagattttcagggaaactactctgtcttttttttttttatcatcaaagtatcatgctaggcactgaggaaacagttcaagaaattcaaagactagattgcttcataaaccaagtctttgcagatgacccagtggtttaagttacattaagcatatatccctccagaaatacatacaaataccttataacaaacttacatcttaaaatgaatattaccagcctcaatattttaatccattagagtatttgtatttgatacatatttcagcaaactctggcaactcaattgagcatagatgttggcataagaaaaaattattggtacctctctaataacacaattaataccatcataaaattaaacttttttactgtgtgacaaaagaattgatatttgagggattaaaataaaaatttacaagatcatgcaattataaaaaaaaaaaactgaaccgtaaaatcttttaaaaagagaatacttcactttcccccaaagacattatagactaaaatataaatattccttatcccaaataaattattttgggattattccttttctataacgatgttataagagtcaggtaagacaataggatttactttccagagaattttctgagatatagctttcttaggaaataaaaagatatctgcttttaattcctcagtgaggctgggcacggtggctcacgcctgtaatcccagcactttgggaggccaaggcaggcagatcacgaggtcaggagatcgagaccatcctggctaacgtagtgaaaccctgtctctgctaaaaatacaaaaaattagccacgcatggtggcgggtgactgtagtcccagctactcgggaggctgaggcaggagaatggcgtgaacccgggaggcagagcttgcagtgagccgagatcgagccactgcactccagcctgggcaacagagcgagactccatctcaaaaaaaaaaaaaaaaagtcctcaatgaacaggtgtttaactcacctttcagatttcaaataaatgcttaatgtattagatatctgataagtactgttaataacaaggatttatttcaaaggatatgtatattatactctggttcattcaaataaatattcaaggtcatcttgacaatgtcagagaattgtcctgtctcactatctgagttctttgcagaatcttctggtttaatcgttctttttatttggacatttatttctgtaggcattcattccagtttgcaatttataatttgttcttacaaagagagtttttataaaagcaatgatgtcttgacttaaaaaaaacctcaaattaataaacattcatatttcacattcatgtgaaataattctctttttcccctcttttttttgtaaaagactttttaagcatttaactttcttaaatagtagttgagatcattgcccatttggtgtgggtataggggaaattgggctggttgtttttttcattttgtgctaatgagtcccaaaatatagaattgatacctgggggtagagaagaccagctagaagttaacttcagacctttggtgtcagattattctttttcattactgctaccaagtagcagatacatatcagggaaggaatattctattgcaagtgattggataggtaagtgtttttcccctaggaaaccatggttgccttatgaaatagttctgtggctttcaagatcctgtgcagagaaaggacatgtccagacatactattcaatcaggttattaataaagagacattgagtaaagtattaaaagcaaaaagattgtccctgacatgaaagatggacaagcaaataatacaaataaagacactgggcagcattttcctcatctagaaaattactggattgaaatatcatctttcaatttatttcagctattatggtccataattttaaaaggatgaaacaggatattagcatctatcataagccaggcttctaggaccaatccttcaaacatttcattctgttcatgctttttcttgtctctaactgaaggtttaaaagtttcaatagatatctgtgtaaaaaagatacatacacacacaaagagagggtagatgagcatgaactggagaactggaagtgtacatctcatccagatgtctgtgccattacaagtgcaacaattttcaaaggcaggatgttatagattccctcacccacacacaaatttataaattcatcaagctcctactattccaaatactgtgaaaggtgataggaacatataattcactatatcatagtccttatctttcctttcctatactaagtttgagtttcaaaatatcatactcagtgagtcaaaactgaaaaagaggcaaatttgattgaggaaaggggtgactattggagaagtatttgagctgttatcaatagaagcattgaactgtggtccaaataagattttaatatctaagtagagagaaaaggtaataacattcccacagggagggaacagttttagtaatgatacagatgtgtgatatgcttggcaagtcttgagaacagtgggaagtgtagcatgtgtaataggccgggcgggaaagtgggagtggcaggaatgaaacaggaaaaggagtctggactcaatgcatgctagggattttggacatcattgcgtggacaacttgaaatcatggaaggtttttaagtgggggatttgaaatacttcgcttggggttgggaggcagaactgtcggggataatgccagagtgatggggtcaacgaaatcgtgtattgacctattcagaaagtccaggggaataagctcaaggacctgaattcagtagaggagatgaacgattaaagagactttgccctaagaaaggcagtctcagctaagacaaactttaaaaaaaaagaaaaaaatactaaacttcaatagcaaattaactaagttaaagtatataggctggcctagctctaaccctgattacatggcaatgatttgtaattagtggattaaaggaaaagactgtctcatggcttctatttttgatatactgataatgtttgcttgtaaatgtatacccaataagtttagaaaataattatttgaaatggtttttccctgaaagtggtaaatgtccccactgaatcatgtttaaactcttagctgttgagcaaatccatttagaaatagttaatgactatttaaactgcagtcaaattcattcaaaaatcacttttatttagtgaagtgtgaatgaaagaggaatacttgtttgccctttagtgattctctaatcactaaattagattttctatgtaatcaccataataatattattttaatatacaccgtttccctcatgatgggggtggatattaaaataatattttcatagtagttggagctgggaaggagaaaggactgtaaatgagcacaagggatcctttagagtgacagaaatgttcagaaatttgattgtggtgcaaactgcacttgtctgtaaattaactaaaagtcatcggactgtacatttaaaatgagtgaattttatggtaggtaaatcataccccccaaaagctgttaaagaacattattagtgtgcatgtgtgaaggactttaaatctgctaaatgagacagtaaatcttgcagtcatttatctaataacagcttatagagacgttactacggacaggtgttttctagacaaatgcttctcaaaatgtaatgtgtacaagaattaacagaggatagtaaatgcagattctaattcagtaggtctggtgctaggcccataattttaccattttaacaaacttccggggagtgtcatgtgttggctgagaaaccacatctaaatgtcaaggttctgggcacagggatctggcaagggaacaagaaggtaattttcttactcctacagagctgacatgctaagaagggaggcaggtagtaaggaagtaaacaaataaaagctcaagattgtttctcatatttactacacagccttcagaagagccctatgattcagcattctttcaaaaccttttattcattgcccaccatgtgccggggatgacgataggcactggagatacaattgtaagcatactgtaatttctgatgttatagaatttacaatctagtgccagacccattgcaccttcaaaataaccctatgaggtatataatacaatacaattttactgattgattgattggttgattagacagggtcccattgtgccacccaggctagagtgcagtggcctaatcacagcttactgcagtctcaacctcctgggcccaagccatcctctcacctcagcctcccgagaagctgggaccacaggagtgcactaccatgcttgtctaattttaaaacttttttttgtagagatggggtctctctatgttgcccaggctggtctccaactcctgagcactagcaatccccctgccttggcctcccaaagtgctggggttagaggcatgagccacagtgcctggccaatactctcatttttagaagcagagcatgtgaatcagaaaaggtaagtcctttcttcaaggccacacagtattcacactgggcctcaatcctaagacttcatgtcaacactatgctagactatacactcttcaatttcattgctacaggaagaaatgggaaatttacattgcattcatcctccagaatattatgttcttttgggctttggtgcccttggcaaactgtactgtctatttgttagcttagttctttcctctttctgggtctcacgttattcaagccctcttgtgcttatatggaacgttgtaatttagatctgcatttctttctcttctttgctaccaatttcagcaaccttctgcggatctatttatactctctcctcctgggaatttgaagttcatcttcatttatcgtctgcagatgtacttctcatgctacttacttcctcttttcagctcactaatgatgttgttaaacaaaatagaacccaacactgacccgtgaggacagcccctcagattctgtgctcattttatgtcaatcatccatttcttcaatggaatgtcttagcttaaagtgctcgtactgggacaagaacaaaccactgaagtttacataagaatataaattcctggatacatatgggagaaatatttgaaaatcaacaacttatttgtataactatgaaaaattacaagaaatataaaatggaaaattatatgctagtatatttaaacagttgagataacatttattgaacacaaacatgtcagctacttaattttattattagtatctctaattattaaagtcatctaccaatatagttacatttcacaccaggaactgctggttgggtcagaaactgagggacagtgaggtgaggttacatttccaggactttctccgaagtgcatatatttttctaatattacatattgcttaaataaatacatatttttggttgtcattttaactggcctgttaagaaactgtgctacttttctaatttgagatatgaaacttctcatactctcccaaagagtacctgatttgaagaatgtgaaaaagtgttcgtttctccttgactctacaagaatcagtaattttctgacaaaaatccgtaggtctagcctgttatagagaaaggtatcactaactaccttgaaattaagttttgtgaaacaatttccaggttttataaagctggaggagaaaagagaaggaagacaaagagagctgaagtatgtaaatggcctatagtatttgaatagctatggtttcaaggcaattatattaagtacacaaacctgattttaatggccatgcttagaagatgggcagagtgctaaatgtgtaagtcattatgaacttggcacagtagctctgtttattttaacctttcttttgctgcttttgttgaggatgtttacttaaccaggctctattaaacatgctaaaaacattattgcagactttgtctttgtgagcactttcagttgacaagccacagaagtgacaactcatcaggaatcatagatgacagcagataagctagagtggcatgaagaggacagacagatatcttttcatcttggactaaaaaaataagaaaaagaaaaagaaaaaaaaaactttagtgaaattcagtgtttctaaaatgcaaaggactggttgtattggagactgaattattgtatttacctgaacagcagaacctgtgtagggcactctggaggatgctgccctccagtgcgctgtgaccctgctggacctgcgtgactagcacactctggcgtggagaaaatctcatgcctcaaagtccatactgaaccttgttattctaagcatccgataggtgccaaacaccttaaccctccacaatgttacccaagtctaggaaggaagaaagctcttttatttgtttcacaatgcagagataaggaaatgagaaactacagaatcatttgttaataatggcccatgtgaaatcccagtttacctttagcattatgattatttcttttccttctttcctttccttctacctcttctttgtccttcttctccttctttgatatcatcatcttcttcttcttcttctttgtcacctccatctttattagtctttggagggggtctttttgtcatttgatataattccagtgatatttcctgataaagactgttcatccatataaaaatacattctaaatacttattgaaaatagtttgaatctttctattttgaagattttaaatatcaggttcttacaaaatatgttcctagtagaaaggtggtaattttattctaaacacggaaactgaagaatttttgttatacactgtaattatttatgaaaacaatcttcaaagacagcaaattggcatcaggggagaaaaccatatgcttatctttactatttatataaatgttaacctgatattttaggctatggttatcaccaaaattatctgatatgttcttttgaagtttgttgacaaaaaccactccagatgcaaattcattttatgtagtgggtggtcttagaagaaaataattgtcttatttattgaaaaatgagcatccaaaaatatttttaccagggtttagagagggcaggattaataaatataataattaacatgagagaatgaatgtatgctacataaaaccatatgttatttgatttacgaacaaaatgtattttttaatgaaatgaatttttgagatctaaaaacaacatattatttttacataaagttgttcatgttcacatatatagagtctcctgtagattgtggaatatggactactgcttatgatagtgtttacaatctaatatactttttatgctagtgaacatcacttgcttatgagaaaaaaagaaagtttagatacatattagtcactcagacttataggaaatcacttagcaaatttctaggttgttatcataccagacttaatctggaaatgccattaatttagaaaccagtaaatacagattccagtgcaggcccatagaactaagaaccagggcttcagagtcagacctgggagtaagttatttaacttcttctaaccttattgtccccatctgtaaaacggagataataactgtattgtacaaagttttctagaaagccaaaatgagaaaattaacatcatgaccttatgtcagtgcctaaatgtactcaaccaattttactttcctttactttaggaagtaggaatgttctccacagggacaagagccatctttgatctatatttatggctgtcagagagcttggtagagtgttttacatgaatcactttttaacgaatatctgtagaaataaggaagaaaggaaaaaaagacctgcttccaatgctaaaccaattcctgttctaatatgagacagaacttacataagtaaatatttatgtttgaaatttgcatgtaaaaataaatactatcctcaaggcacataccagctgctaaattacactcaggaaaggagtttgtattgctgctcaaaaggatttgaataaaagtattctgtggttcttcatagtgtccatgaaaataaggaaacaatacaagcaggcaggctcaccaggaggcccttaaaagagtctatgtgtgctgagcttggctcaggctgagactgttgaaattcagaagtagaggaagaaaaaacactgagtaggaatcagtagactcggtattagtctggacatggtgggtaattggaatggggaggggatgccaggggtatctgcctcggaaaccatggtgcagggaaagcagaatagatgggctaaggagggatcataattcccttttcttccccatgtttagatttaggtgatggcagaacatctaagtaaagatgttccataaacagaaagaaatatgtgactgggtagaatatgaaaggtcagggcaggagaggaagttctggaaattgtctgcatagaggtgggtggtacataaaattgagggctcaagcatcttgacttgctcagagaatgtggcttgcaaaccacagaagatgattaaaaacattcactattttaattacatttttttaaagtttctacattccctctgggggttaatacagcatcaaattttacacacttactcatttagatctaggagaaacttgagaaaattctgatccaatttctttagtttataggcaggtagcagcccaagtgggtgaaatgacatggtcaaggttattgagcaaataggtttccattttttcattcattcagtaaatacaaatatgcagatatacatgagagcaaatgtgggatgattcaaagtcctatgctagcatgcatttttgtttacaaattgtcaattcttttgtgactataatttagattcgcacttgtgctaaattaaaatatgcatactttaaatgattgacttaaagcaatgtataataccataattggaaaaccaaaggtcttctacaagcattaacatgtccttttaaaaacaacaggctgatggtgtttaactatattcacctttagaaatatttcctcactttagcagaagtaagtcagaataaccagtaggtaatatagaatattttctaaacttcaatttgaagatatatgatatttctgttttttaaagttgatcctgccatgtcatatgcttaacttaaaatgtctaatgtggacactctaaactagagaaaagagatactctttccaaatcaccttttatgtacttggataaaaccaaaggaaaggaaataaatctagcagaaaccaaccatggcaatgctttcaggtttcagttgtttatttagaaaatcactcaatcattatcttgatactttaactacacagtttattcaactgacagtagccagaataaagcaaattcattaagctatgagttttggctttgatttgtttctggtaatagtctttcaaatgattacacagcttataattaagtaagtcaaccgacagaaaattgattaccttccaagcaagtgctgtctatctatccttaatcatctttcttggaaagttctctcatataatattgttttcctaaaacttcaacatacatactggtttattttctacccctagggatcatgcaaagcaatcataataactcctttggcctggtaatcttttcaatattcgaagaaagctaccaggttccctctgagttcacttgtaccctagttattcctccttctgaattgcactaagtctcttgctctactggattttctccacagaatttgttgttgttcacttaggactttctataatgtggtaccccattgccaagtagagagaaaatcagctcatcagctcaggagtcggacagatctttatttgaattgctgcttcatcactaacaggttgtttaatcctaaacaatttattcaatctccttgaacctcagttttcttatgtgtaaaattggaaatgagaataataacctccgagtcctttgtgatgactaaatgagattatacgtggttcagggcctggtgtggctcttatctaacccacacccctaatagaagtcaggtctttgcagattaaaaaggggagtcctggccaggcgcatggctcatgcctgtaatcccagcactttgggaggccgaggtgggtagatcacgaggtcaggagttcgagaccagcctgaccaacatagtgaaaccctgtctctactgaaaatacaaaaattaggcaggggtagtggcgcgcatctgtaatcgcggctactcaggaggttgatgcaggagaatcggttgaactcgggaggtggaggttgcagtgagccaagatcacgccatcgcactccagcctcggtgacagagtgacactccgtctcaaaaaaaaagctgggggagtcccatcacctcgtagatccagaggtcatgttttagctggaagtcaaggagaattgaacgtgtatttaaacatttgcatgtttcacatatgctcatgcacgtacctccttaataaagtgatcatgagtatgacatcacaaaatacttctattgaatatctgtggcaatgtaaatgacagaagatgaaaaaggaaaagaatacatttgggcaaagagtagtttagaccaacaaatacaaactagtgtaggtcatgttgcactcacattttcttatgttaccatctaatctagtttcaagttgtacttagcttcctattttaatctatttttattttaaaggttttacaaatgccacatctgccttgtgtagctccttactagataacagatttttcaagaaagaagtgtaagagtaagcaaaccaagtcccttaaaatattgtccaaaagtgtgggttgcttctcttctaaaaagatttccttctataagacaatggaagctattgggttagctttatatttctcataggatgaccctaactccgtatcttctaccttcctaaattatcctattccctcaaatatagtagttttggtttattgctttgaaagtggcaatgactgctttcaaaagacacacatgtgcacacacaaactaaatcttacagtatagaagtattgctaaaactgtcccaaagttttaattttccacaagtcttagtaactcagcctgctaagtatctgcttgtaagaaggtgctatattttttctgcatagagcaaataagaaacatcccttcagctgcacttatatttttggtaacacctgcacagtctcctaatagcagagacaagaattaaatattcttttcctaatgtagaatgcccagcccagtctttctttcaaaatccccaagattcattcttcattaagcatgtcccaattacctttcagtgtaactgataactttgtgtttgtgtgtgtgttccccttttctactttatatacttccatcagaatatctacataacttaaaagatctgcattcttagctgtcttcctttggggccataagatttctgagggcagggaagatatcctagtcaccccacaggtcaggaacaatacctgcctcaacagattttctcctctccagtgaatacctttggtgaattaagacaaaatcatgcagtggaaagattgtgaccggaatttaggaggcccaggttccactcctggttctgtctctcagttatgaatcagtgtctttgagaaagttaattagctaatgttaggagattgagctaagtcatcattaatattttctcgggtcaaaaattctgattcttaggattcaagtattcatgatatacttaataatatagtgggcataataaaagatttttaaaagtagactagtataccggccgggtgcggtggctcacgccggtaatcccagcactttgggaggctgaggcgggcggatcacctgaggccaggagttcaagaccagcctgaccaacatggagaaatcccgtctctactaaaaaaaaaaaaaaaatacaaaattagccaggtgtggtggcgcatggctgtaattccagctattcaggaggctgaggcaggagaatcgcttgaacacaggaggcagaggttgtggtgagctgagatcatgccattgcactccagcctgggcaacaagagcgaaactatgtctcaaaaaaaaaaaaaaaaagtatactagtataccactctaaccaaaaagataaaatgagattggatcattggtattggagaacatgaagttaccatgcagacaaacacaaaatgaattctcgttaatgtcttctctcagattttaagtacagattcatactatttggtatgatttagtatgcttaatggcaatgtcattaaatgtgttcaagaagagtctatgtccttccaaaattgtctaaattgctctcagaaagtattctgttctgggagcatctggctcaattgtccatgggttatatgtggatgtatcattcctgaatcactggcaccagtgcttaatgccaaacaaaacccctaaacctcaaactattaagtgttgagcaagatatttagcaacactgggagttctaaaagtacatcatattttggctcagatacctaggggaaaggacaggtttttaggattaaattgatttctgagcatcattatctctcccacagaggccatacacaatttatgaggaaaaagcaaatcacactctcttcaaggatacatttatatgtcaaggtaatagatcagccttcttctgtttatgtcagttggtcagccaatgaagaatgtggctgaacatgcaaatgagctcagcagtctagaagcacgaggtcctatccctcattctcagtgaaacaaaaccactctgtaaatgcaaatgaagattttgcaatttgaagcaaaattgtataggtttccaataataatgtctagaaaaatctttaaaatttggtaagttaagctggtatgaagtcaaaagacatagagactgacagactctgcttatgtggggtttcctaaatatagttttaacagggactatctacaggttcaggcatcagttttattacttcacaatgatgagagtgaaaaaatcacttaccctgaccaagcatgtaagacaatgatttctagatcagatgatagctattaatttttcatgggagataaattgcacctctctacccattttctgaagggcagggcactccagagaccaaacaacaaaccaaaaacccggggagtgaactataaaggagaaattcagcatggcaaaaggagatttacatcaaattaacatatcttgagatgttattcttcttccctgcaggggtatttctgtctagacacctaggaatggtcattagaatccgcacttcaccctgaagggggctgacaatacatactaatttgcagtctctcactttgcattttctacagctgtggttctctctgcacatgctgcctatagagaatcacatcacatctcctatcatatcagaatcttttctattggaggcaaagagcttcgggaaacattttactgtcttgccactagattataacatatatcggattgattattctgacggatcctgctctcatctcattgcttagtggatattttaaatttaaattttatttccaaaatcattgtatttggatgcaatggggagggagaaaatacaaaagtgagaagaagaaacttacactcttaccattatttttgtcccttggaaatgctcctaggttcctagaattccttcaagagttataatttttagttcaaaaattatatgtggtcagtggtcagctaaaattggatgactttggccaagtatttaggtttcttaaatatatattatggacctcctactttttttttccaaattctattttacattgtaggcaatctgttcacacatcagtgtctgaggagagacatcaatcagaaatccaagaacttccaattaacttttatcgggcatctagccaagagtcctgctgggtcctggaaggagaaatcaaacataatttctgttttcaaaaattcagaatctatcagaaaaatagatacgagtaacactgtgtaatcacacaatgggatgtatgatttaaactagaactgtttaatagaaataaattacaagccacagatgagaaaccacatatatgattttaaagtttctagtatgctacacgtggaaagtagaaaataaataggtggaattaacaatgtttattatttaattaattaattaattaactaatttatgtattttgagatgaagtctagctctgtcacccaggctggagtgcagtggcgctatctcggctcactgaaacctctgcctcccggggtcaagcgattcttctgcctcagcctcctgagtagctgggacaacaggcacgtgccaccatgcccagttaacttttcgtatttttagtagagactgggtttcaccatgttaagcaggctagttttgaactcctgacttcatgatctgcccgccttggcttcccagagtgctgggattacaggcatgagccaccacgcccggccaatagtgtatattatttaacccaatacatccaaaatattaccatttcagaaatataaaagtatttgtcagatttttatatatttttgtagtaagtatttgattaagatgcagattttacatctgcagcacatgttagtttgaactagccatattttaagtggacaatagccccatgtggctagctgctaccatattggacaatacagtaagcagcatatgataagttctgagtgagaaaagccaaggaacagtttaattttcttggggctatcaggaaaattgaacagaatagttgacattggaatttggcctataaagataaagaggattttactagataaagtggtaatagattttggccagattttgaacctctatattacatttgtattttgtgttttaagctatggcttagctatggctaagcagggaggaatagaatcagggtttgctttgaaaacgtaaatgttggcaggatggaaaatgcattggaatatggaaagaatagaacttaatagaccagttatgtggctattgcagagtatgggagatggatttaaatatcttctatatgcttgaggctctcaaattttactcttgaacccacatctctctcctaaattccagactcaacaattgtatacttgacttctcactcaggtgccaaataggcaattctaacataaaataacgaaaactcagcttccaattttccactcaggcctctgtatacacagtcttccccatctcagttgatggccactctccttctagtagagttgcccagattgaagactcctttttctgttcctctctcatagccaacgcctcaagaaatcctgttgactctaccttcaaaacatttgaaatctgaccacttctatttctactgcgaccaccctggtctgagccactatgatccctcactgcattattgtaatgggcttctaccttgtctccttgctcatgcccttttcccctagattatattttcagtacagaaatcagatgtgattgcatgtttgaaattggaatcaggttatctcttgaagccatacaagggctccccattccactcaaaggcaaagtgcctgtggggcagattagattctttccaactcattattccctctatggtacagaattatgcactcatgccttctgccatgtgaatttctagtatttcttaaaaaagcaaacagactatacatccctgccacattaactatgagcatgaacaaatgtatttctttggccagtggaatgggtggaaatgatcttgccttagagtgtttgcacaggctaatccctctgccttagaccactcctcctttagttatctgcattgttcacatcctcattttcttccagttaaatgtcaccttcttggtaagacattctcacagcccacttaaaactgcacaggcaggtcatgacacatatacagttgggaataacagaatttgaaagtaatttagagggccaccagttcagtggctttccaatgaggctcctaggcaatgaaatattctgtagggtttctttgtagagtaagagtgtggagtaatgctacagtgggattcctgacacatacacagacacacatacacacacaatccacaaaagcagatccagtgactacctgtgtctgagtaagtttacgcaaaggatttgagcaagggattttgaaggttaacacaattctgaaagttatgaatttgaatgtctgtttcttctttggacttaggcagaagctgaagcctcattgagttatgtggcttacttcgggtcctacagttagttagtggcagaggtggacttgctgtttgtgtgagtacacaatctctgggatttactctcttatttacatgaaagacaaaggacatgagttctgaatgaatgaactgtggtatggtatgttctccataactctcattaatgtcaagttttaataagaaggtaattacatataaggacttacttaaatacattttatcatttcagtgattcttaactaaattgttcaaagtattttgtaggtaaatctatttctctacattccttaaaactaatgagatactcttctatcataatgcaacttttttatgaaactgtccctgaaatagaggctatattgacagaacaaattaattcgattaattcatttcttcctctatcacttttccatttgttttctattattttcttccttgaaatacagaaagctgactatgtggttatatataagtatctagtaaaagagcaaaatttcagaggattgctaagcagaaaagggtaatctcccaactctgctcttacggtgtatgtttttgaggaggatggctagggagtacaggagaggactctggaggtggaatttgataggactggcaacccaggaagtgaccagaaagcaagtgacctttgtcatttgggtaaattattttaggtatggctaggtcaaaaggaattctctttataccccaaatcaggattatctataaaaccactctcattgaaataatgcaaaaagaacgtctttagataaaacattctatagcgagaacccaaaaagaatcccacctacctaagtttgcacaaacatgtgcattagtaagtaaggaaagacatagccagaactatatgcaaagagttaattttgcctatcacgggccaagtttggacacagagagatttttggtaatcagcctataagtcttcttatgagagggttcacaggctgaattgacatggtctgactcattgttgggggagtgatggcagaggacataggagatatcagtgctctacatgaatcctgaggagcacagaagaaaaggaaggaagtgatttcctttagccatgtctagtcaaaataaaagggaaattttctcaatagcaggggaagttctattactctagtgatgcctgttcatttacttgtccctacatcaaacagttgttaaaaacctgcattgttcttgatgctgtaatagatagtcagtggaacaaagaataaaacacagacacccctccttggtgatgtttttggtctagttgcctttatgacataaagtaacctatttaatgaactatgtatttcaatctatagtaggcagagctttttactgactttataaaccccttattaataaagcacccacacactcacacacacacatgcacacacacacacacacacacacacacagaaaacttctgatatattaagggaaaatttactgggagagcaggtcctcaaatcaacagtttcacttgagattcaggggctcaaacatgatggaacaggtaattaccagtgcttgaaatgggtacttaagcaaaattgcatagaaggaagtattttctctgttacataatataaatgagacctatttatttaccacttcatcaaactttgtagccagatgtaccttaccttggaataactatgttttcaactgttgcatgacttccttgcattagcacacacgttttgagtttaggccatgttgtaatatttattgatttcttagtttgtgcaaagaacccgtcttcattctttatacgtattaactcatagaaatctaataacattatgtgtgtgtctttgcatattcgtcctgtatgatgaatcaagaataaattatattaaacttactatcaaataattttctttgggttagacttgccttctctcaatttgttatagtgtgtatgtacttacaaagcttagaagcacctaaatatctgatgataaaattctggttttaagagtgaattttgcaatagataactgtttgaatctttaaaatatgaaaattagtgttttgattaagggcacaaaattaacacagtatggcaaaagcattctacctgaatccaagtaaagctgacacagaactaaaaatgacctgagaactaaaaatgacttggaggaaccatatgggacatacggtattgttggaaaaggcttgagtttttaaaaagtaattttaaagccattgtcatagataaactattggtattacttcttgttaacaaacacatttcatctctacagctagttacacattctgagcatctgctaaagctcaaattctgctctagcttcctgtagtagagttaaggattacttgcttttatatggttcatttacatctgtgttatgtgataaaggtggtgatttcttgacgcagcaatatagatgagtttccccattaaaagctctatgggcggaaagagggacctttataaatcactgtgtggtcttctacattgtgctgttttgtgagatattttcctccccagtttggatcggaataacaagcacataagaaattgccaagagcattcagaaagaaagcaaaatcaaccaaaacaaacacagtaaagtctaatattattttaagaaaaaagttctgaaaaatgcttgacccaaatgaaatattttcaagggtattgccaagaacattcaaatgggaataggtgtgtgtgtgtgtgtgtgtgtgtgcatgtgtgcatgtgaatatatataatatatattttagagcaggaaataatagatattaaagttataataatactagtaatagtagaataaatcatatttattgagtacttactctgtgcttgaaactctgctaattactttcccttgatttaccccacaatcaccccatgcagttaatattacatcacagttagtattatattgcagatgaggcaatgtatgactgccttctacatatttactagaacgtattgtaaatgcaccatgatactttttttggaagtcacttctcatttaggtaaaaattatttgccaagacataatctccctccccacttttaatggccatacctttaatcacggccagagaaagtggcttcatatatatttcttaaattaaaaaaatactatactaccagaatttgcattaactctttcctaccatctgtttcctttgatgattaccaacaggagacatcaattgagcagtgactgcatataaagtacagattcaggaagggttaaaaatgaagagagaaactgctcttccaccacttacacttatacactaatacatacataacagacacacacacacacacacacacacgtgtacgtgcacattttatttcaaccttatgatactaggttcaatatcttccagagaataccattggccctaagagagttcagctttaatagatattgaggttaatttatgacaaggggagagattttatcaatagaatattctggttcattgtcaacagtgttgtaaatgctttagtactatagaatcagatctatatccatatggtgacatttattcacttcacattttctcaaagtgactaaaatggatgactcccttaaacatggaacttgttattttataaatcatttggacaatgatttgtgagaaggtctaactggggcatagaatgggaaaacagatacgaaaatcacattatcacagggatgccattgtggaggtcatcttacacctatagtaatctcttgttgaaaaaggaaggaagatgtttcactgacctgagtatcagggaaactgtgtttctcctggattcttaaatgtttatgttcattgtgcttacctttttatttgactgccagaactcttagtttaatttttgattcaccatcagcaattttaaaggactattaatgtgtttttcaccatgttgatctttgtttttctctttgttttctgtttacttaattcctaaatttttattttatactttatatttgtttatatgtatgtatactatttacatgtgtgttcgtgtgtacatgtgtatgtgtgtgtcttagccacaagttccgtatagaatgaatagaataagacaggatattaacacttaaaaagataaaatcaaccagccttctgacacgatgtctaccacaatatatactattttattatatattattattattctactaccgtccatacagagagatgtgtaccaaattttttccctctaaataataaaatgaaattagagaaaatgtgagcaatgacacatcctcatatcctttataattaggatcttacggagagaccatggaccatcaagccaaaaagccaaaaagctgtggatcccagtttcatattattgcaccatgcacattcatattgtaaacacaccatgatacatttttggaagtcacgtctcatttaggtaaaaattatttaccaatacataatctccctccccacttttatttctttatttttatttttttatttttattttttttgaagtttgtaatagatatgcatggctaaaatttattgttacattaatcaatatattttataaattgggagaaaatattaaaagttcctccccacttttgatggccatatatttaatcacagccagagaaaatggcttcatatacatatttcttaaattttaaaaaatacttatatttccagaatttgcattaacttgtgtcaacttgcacaaactgcccaaactccaagagctttctcatatccaaagtggagataataatttttatttgccaggtgtttctaaagattaaatgagattaaatatatttgacacatagtacaggctcaataaatgcttgttttttgcttagtcttcctcatggaaatctccattcacaagattttcactaaacacacactagacattctgaaaatgattaataaataaattttgagaaataatttatataagcctattttcctttattgaaatacattgcacggggaaaattcactataactttacatccaaaaaggttaaatgcttaatgaactctttaaatgatggtgcccaatgcttgtaaagatgcacatgtgtgtgtgtttctgtatgttgaggagtgatcattctcacacaatgctaacataaacatacattaatttggcacagattatctgaagtattatttggacctctgtattattatttttattccagaaattcgatttctaagaattctgactaaaaacaattaaagaatattcatttacaaagatgctcattgcaataccatttttaagtttatattagtctgttttcatgctgctgatagagacatacctgagactggacaatttacaaaagaaagaggttcaatggacttacagttccacatggctggggaggcctcacaattatggtggaaggcaaggaggagcaagtcacatcttacatggatggcagcaggcaaagagagagcacttatacagggaaactcccccttataaaaccatctgatctcgtgagccttattcactatcacaagaacagcatgggaaagccctgcccccatgattcaattacttcccactggatccctcccacaacacatgggaattcaagaagagatttgggtggggacacagccaaaccatatcaaagttttattttctttttaatttacaaataataattatgtatattttgaggacaatgtgatgtttggctatttatcataaaaaattgggttagaaatctagatgctcaacagtagatgattgggtaaagtggatttaaatgactattaaatgaggtggcgaagtatatttcttgacatgaacagatgcacatagtatatgctgagatttaaaaaaaaaaagatcttgaaacgccatttatagagtcaccatagttttaaaaaataaattcacacatctgtgaagaaaaatacctgggagagtttatttaaaagatgttaagaataggtatggttgtctctgttatgtggtggtgatttgtactcatttagcataccaagattttctcatttttcagtgatgaactgatgctactgatataatatgaatgaaaagaccgctgcctaaagtcctacctattttcatgttccttctggtttttgcttcacgggtggtgcattcccaggcaaatggttcagaaaagaactaagcatagtgcatggcgtgttacataatcccagctttgttttttaatagatgtacttgagtgaccttaaaagcctaaaaatgcaatagttaagagggagttgtgtagggagggtgacttgtgatgttatcagcagtatttagattctatctttattcaatttcaagacatgctgctattggacaagactgtctattctatttatttgttaaaatacaaatcagttctcaaacaagtcacttagaacaagttttgaaccagtttgccttcacttttgattacctggtagtgttagaggcaacttgatgcaaatctgtaactttatttttttagtcattagagtagtgttatctatacatgtcttcctacatgtctagaagtacacactaagtagcaagtagtacattttctacttgcaaatagtatcacatattttgttcagcaatctaaacaacccgctaatgcgctgagatgtaatgcaaaccctaagtattcataaatgccgacttgaaatcagcatgggaatgtcaggtttctcagacaaatttcacctgcctaactttgtttctggctcttcaactcacagtagtatttatttccctgtcctttaaatacatacacatatacatatacctactccagtgttaaaggggtctgtaaaataccttagtatgctcttattgagaaggcaaagaacaaacaatgggagatctgtctaagaggtggaaatgtctagggtgtacttcctcaaaacattgcctgggcttgtaaaatgaagtggtttggaaatgggttccaccctcttctactgacctttggcttctatatgtcttcctctctggccactttctcaaaatattccttcagaagccttttactcaacctaaaaatagctcccagatgctaccttactttgcagtctctttcccgcttactgagattgtatgattaggaaagatagcaggaagagtgtaaggacaagacctttttggttcaaaataagttcattccttagcagagcctttcgtgatctccatgtgaatagctcaaaaatgtagacaactgtttcctgtaagtttacttataaataatgtttgaaaattttagcaacttctttggtttaaaatctaaaattagatgagagtatttgtctaattttagatggagttgtcttacatattaaactattaagtgacttaaactctgtacatcaagtcatctgctaaacttttcattgaattctctgcttacatttccagcaaatgtatcctgttttcctacattttatgtttaataactatcactgaatgtcctggcaatgtggtgaataagtggtttaatcctggccttccattctaggaatgaaagtcaagtaaatacaacagcctttgcatcatgtatcttgttgaaccaacttatgttttgaattgggcacaatgtttcaaagggagactttattaacaaaaaaatagatatttatagtaattcctgccctctactcatgagtcatgtgggtaatgcttgtgattttgttttcgttgttaaatattccttacctgtggtaaatctcatgataaaaatatttgcaatagaagaggcagtgaggctggattaaatcacaatcaaggcttttatctccaagaaagaatctggtagaagaacctccctcctcattagtctcttttgtcagtattttcaagcatggcaacagcctcagaaagacccaaaatacacaacttggggattggaatgaagccacaaaaagcatgtttttataaggacaagaagtcagaaagttgatcttcattggtttcctgcctaccatgtgaaatgtacctcggagatctggtatatgtatcagcacatcagcagatgagagagcaacatgattgtattaataacaaagtttattgtgtatttctttcaaatgaacaaaaattttgaaaaaacttattacaggctcaaaaatgtcctttgtgttgttatgtttaagtcaaccaaacatgatttggtcaacgttaaaacagaaagctgggtaactgttgaagtcacaaatagttttctgcgaacttggacatcttgagcaaagctgagatgtttgcataatcttttctgtagcaacaacattccacatgcatatttctctttaaaaagaaactccaagctcagtggtattctgggttcaaggcctgagtaaaaagcatctcaagtcaaaagtcctgttctaaaaattgagatgtagagaaggtcataagcgttttgacttatcttttaaatcattcatggatgattaaaagtcacattgactcaaagtacaaatttacttaagtatctgaactcaaactagctcaatttcttcttcaaaatcctctaaaatgttttaagtttccacaaacaagataaatccttatacataatactgagcaaaggggaaggtgaaacgtacaacaaaacctgctttcataaattgttcttaaggtctggaaataaaaatgttaaatgtgaccttttactttagtggcatttttctaaaatacaagtctcaaagtgtatatgatgtaaaatgtattattttaaaatagaaatataaaacctagagaaccaaatgtataaaatgaaatgtaaatctcgaattatacctatcttgagcatcttactttcctaggtacttgatcatgctaaagaatgaaatgggatctgctaaggaatgaacttattttgaaccaaaaagttcctgtccttacactcttcctgctatctttcctaatacttcattaataaagcagtatttttatgataaaatgacttttctttctgctttgagccaatagaagatgtgtcaaaaattgtaacttgtaacacagtagagttgtgtcatatgctcttaattttatgaatttaactatgtggctgatatcataactctactagtatgaagaataaaaattctacacaatatttatgacatatttttctttatgatagactatatttattaggtgattacacattgatacatgtcactacatagaggtatatatgcaaatctaaaactcctgtgtaagatgctcccaataatctaatgtagagatggcagagcaaaataattagcacatatgaatgtcttcctgtcatttggaaataataataaccagtttaataatgattataacagtaatagccaacaaaagtatcctaaggaatgagatagtcaaccaactaaccaagctgtcatattgaatgaaaattaaacatcagtggaataaattataataaagattatcagttaacttagctttccacatgaggcttctttgtggtcgctgaggtgaaaattgaacctaaacactccaaattagtgccattagcagaaatgtacaataatagataaagctttgccaatcccaacttttcttttctgaagggaagttacaagcacacgtgtcagctctaccactagcctgaaaccaggcagctgaattttttatatctcatagtctttgtcaactcaaattattaatatttggataaggctctttaccagaaacgagtagttagtttcactttttgaagtttaaaccactcactatgcctcccaagaagtttctgatttgggaaattattcacactcaccccacacatacccactacacacacacacacacacacacacacacacacacacacacaccaagaggggaaaaaaatacctatgaaagcattttcttggacattggcactgcagatagaagtgagttagtaagcaaactgttccagttcctcctcctataaaagctattctttaaaaaaatattatgatcatattgagtgtgaaaaaaataaaataaaaggccatctgatttctgttcagtttcaagtttctgaaactgatggccaagttgggattacaacaattattgtccatgtgtagctgaaattccagtatgtactgataaacaagatttgactgatgttgcagacattaattacagtgatctgctaactggccttctggacttaattgggcattttatgatcacattctaacatgcaagacttatacaagagtaaacaatgagtttatttatctttcagattccaatagttgctatttctctattgcaatgtgttggaaaacctgctaatagaaaatctgccttgtaaattcagcttgtgatattaataaatctgtttctcaaaagttcttaggattgtccatgtcaaaagacagtctgaattatttgacataattatgggttagacatgcttctagtcaaaagagtagaagtatactaaagtataaaatattttctaaactaaaacaaagaaaaaataatttaaaatattttcagcaagatttagtaactatgtctagtagataattattggtgagtgtgaatgacattacctctaaggaatgtgaatatatatatttttagattctaaatgcatcagaatgttatactatgtttgatgcaacaatataacattctgttataaatagaaaggtgaactctaaatatcagcttcttcctctccactaaataaatattaaacacattgaacatgagcccaggaggtctaacattaattgaaccattcctttgtgctaagtatcctgtcaactgcatgcatgtattatctcatttaatcatttcaataaccctatcaaataaattctattattcctcctttacatatgacatacgacaaaactagggccccaaaagtttaagtaactgacagaaaatcacatagcaagtgtcacagcccaaattcaaacctagaagagtcaaacttcaaagtcaatgcttgtgacgccatcttaagacaacctgagcatcgtcccgcaactttctatttcttgtgatgctcagtgcattagaagggctgacaggtataactctgtatccttttgtcctctccctcaactcctactctcttactcaatatcccattcagtaacttttggcttcattttatatttaaggagtaaacttgtccaagagctccgcaactccatggagcttttaaaacactttaaccaggtgaaaaattttcagtcaataaaacaaatgaaaagtagattatggccaggcacagtggctcacgcttgtaatcctagtactttgggagacccaggcgggcagattacttgaggtcaggagtttgagaacagcctggccaacatggtgaaaccctgtgtctactaagtcagccggaaatcccttgaacctgggaggcggaggttgcagtgagccaagatcgtgccactgcactccagcctgggcaagtgagtgagactccttatcaaacaacaacaacaacaacaacaacaacaacaacaacaacaaaacaagtagattagaattcaactcatattatgtgggaacgaggaatgcataataccctatatgccctactagcaatgtttacaacagttttcgtggtcagacctcaaagatgaccattttcactttatattcgccaatataagctttagacttcttcggtacatggtccaacatgtttgcataaaataagttattttttgtatatagtcttagacttttaaaaatatgcttcattgcctttctagaatgtcattgaagtagagggaaagtggtaggatccaaagacgcatcaagtgaacagcacagggtgttgaatgaaaatttaaattgactcaaaaactcattttcaatgttctgcccttttctttagaaagaaatgaaaagagaacaaagggttgtttgttgactaagtgccaaaaacttctgtcacaaatttcatgaactccaaatgattgttggcagacttgacctgcctatgaaaacacgctgaaagcatcatcaccatttcactacttgtttttagacacccatgtctctgggttatgcttccattccagggacaaggacacgtctgagcatttcacagtacgaatctggtgaaatactccaggggtcctaaaagtagaattgctcaacatttcccagatgtggggatgtataaagtatttacttctaattctgcatttataagcacattctgttttgtagcatgtatatattcccaatccttttgggggagaggggactgttaaggagtagggatcagctacaggtgggatcagagatgagaagtttaagcagaagctgtatgtatagaccatgtctttgggagaattaaaaaagaaaaggcaactggctgcctattttgatgtagtaaataaaactaaaaatgaaattagataaatctttcataaaatagattgaacctgtgcatttataactcaaacatctgtgcacgtatagatgagtgctgctttgctattgcatgaatgaacaactccagatcttggtgtaactctgccactgcttttgactctgatctgtgtaaatccctgctgcaaaatgaaaagttttctacagaaatatttctgcaacaaacacacacaaatatgcagagaacatgatgtgctagtcaaattgctgcctgcttgacacacatggggataagaaggaaaaagagcatttaattcaattacaggcaatttttatgatcaaataagccaattccagttatctctcatttagatatgattttcagttaaatcctaacagacataatgcttcacaagaagatactgtctggatagagtccaacgcagaaaatttgtgttaatgctctttaattaaactaagcaatttatcttcgaccttttgttagatttggggagtaatcaaaaattatgaagttcctttgctaactccatatattgcctctggttgcctgactctccaagggtacttgaacctcatagccacattgcagtgtgacagatacacaaagctaaacgaaaaatatgaaacatctttatggaaagataattttatctaaatatgtgtaactaaaaacctgattttatatttgaaaactgattatcatatttgtcactatcttatttatttttataaattttgagctgggctagatcatttcaggcttgacctacagacccttgggatttcatggttttctctacttaggagcatttcacttttgaaatttgggaaactctggtaattaattacactaggaccaacataagttaagttttagtaaaaggtacttatgctattaaaaacctgaagctgtaggccacttatctgtattcacaatagatacctaaagcaactcagtatttctttatacctcttaattcttactattaatcagcttaagattcggtcctatcacattttaatttgtccaagtcaggatactttttacaaccaaagtggtaagaaatgatagcatcatagtttaattggcagtattttcattttgtcacctaaaataataatgacacaaccactggtgtcctagaatgtcctagaatcaataaatacattaaaaatcatttaacaacttcactgtattatggatttaatattaccaagcctgtcatttaaaacccatcacttttaacctatattcagataggatacatgctgtggccaaagtacaccattaacaaattctggatgctaattacattttgcttgaatagttctattttaataaatgaatgaatgaatgaataactatgtaaataaatgcatattgatggtatggggcgatctctctacacactgaaatatacacaatgttagatagcattgttttcaaaacatgccaataaatgtattattatcattatttcttattgaagaatacagcaaagaagtccaggaagtgtcagtttagtaaacaaaccactagttaagaacatttatgtggtcaaagctttattcattgctattataatgagcacatgagtgctttgccttggactatataaaccttctggaagacagaaggtcaggctatgtctagtttcattttctcggaagttagaaacagtaaagttcattttcttggaagttagaacaatcaagttcaattaaaccctattgtttaattgaaaaataagtgcatgcttttagaaggtaatgatgaaaatgacactggcaatgaaaatatgaagagggagagaaaacaaggaccaaagctgaaggctaaaactgaaattggttctgggaggacttctcactgccatctcttaagcagtacagattgtgtctgggtagcacgaacataattcaagcctcttgtgaaggagtcaatatgaactagacaatttggttcagccatgcaaaaaaaaaaaaataggatcacaatgtaaaaaccacagattcaaaaagggagtttttagagcaaacaagcagagaggacatttaaaatccaggggttgaatgcataagacctttacaagtgaggttgctggcacacatacttcatgtcacaggtgatcatcaggattccattgctggggctccaaggataaaagaacaaaatgtgactagatttggaaggtcttttggtagtaagggctcatcaatcacaaaccagcacccataaaaacaatttcttgaggctattcaattatacatgtatacaaccctcactacaaagtaaaaacttttaaaagagattttactttttacaatctgtaaactcacagcaagcagaaaacaaccgactaaccaaccaatcaacccttcccaatccaaaaacaaacaaacaaaaatatcaaaactgttataaagagggaggaaagcataaattgagtgccaaaagttaacctgtttcccctctcagtcccttagacttataaaagaaagttgacatttctgtccctatagtgaggcagccttctaaggtagtcctaattgtctgggatcctaaaattcacatactgtgtaatcccctcccccggtgcatggacaagattgagtgacttactctaatcaataaactggtaaagttgatgggatgtcacttatatgacatggtttcaaaaggtatttctttcatctttctggtagactcttcactgccttttcagcatgcatgctttgatgaagtaagctgaatgttggagaggcccatatggcaacaaactgtggtcctcagctcaactgcccacaagaagctgaatccgagtgagcttggaagcaatcatttccccactcaaacattcagaggaggcctccacccctaactaacaccttgattatggcctctgagagactctagagcaaaggacccacgtaagttgtgcccaaattcctgaaccacagaaattgtcagataataaatgtgtgttgttataagctactaaattctggacaatttattatgtagtatagaaaactaatgcagcccccaaatgtcctcctgagagttagaatatattccagttcatctaggatcaacaagcattctattaacaacatctttccaacagtaacacaacagtctgtgagtaaacgtagagcagtgactttgtcattgtgccattatcttttatttttaatagaaacctatggctgcagagtaaattcccttaatcttttttgaataaaccaatatttaaagataatgtgattatatatataatcaattcccatgtacagctgctgacaaatttagggtactcatatataaccttttaaaaagtaaaagttccctagaataaattaaagaattgccttaaaagctacataaggatttctctaggtaactttcgtagacatgtagaatacattacaaggatcaagaaactccagatctcaaattaaataaaacatatattgaatgcactataaaatccagactgtttaaagatgaagataaagttagaataattataatttttgaaatatagggagacatttttgaaagattctgggacttaacatttgcttcagtttagatctggcaataattacatacgtgagagccaatttagtgtggtgagtaagaacataaattctgaaaccagccaacctcagttatttttcttgctttgccacctgcagctttgagacattggataatctcttcatgcttgtttcctcatctccaaaatgaagatgataagagcatccacttcacatgaggattagaggagataatacacatatagtatttgaaatggtttctggcatatggtcaagggttaaaaactacaaaagtgatcctatgaatatgacttgcctctatgcatcatggtttttccaactacaaaataagagcttgaataagacaaattttgaatgtaattttcagtcttcaaatcttgactatttttgtttacactcgctgaaaatacttgaaatcagtagaaaaaaagtgtattcattcatttattcattcattcaatacacatttatcttgtccctactatattctaggtggtgtactagatgctgataatactatgatcaaagcctatccctgacttctaggagcggatctagaaaaatagcataaggtaattgtcaagagctcagcctctagaatcacgctctctgaattttagggttttatgacgttggacaatttccttaattctcagtgccccaacttcctctcctttgaaatgggaatgatagttacaatcccgtaaatttattgtaaggatcaactgagtgaatacaagtgaagctcatacatggaacttggagtaccataagtattcgataaattctactattgtcaggagaagagtcagacaggaaatcaagcacagtgtggtaagtgtgttgatggtggggtggcggtggaggactgtgcagtgcacagggaactagagcaggaaaacaaagaggatgcccaacacatggggggatcaagaaggttttccagaggagccgatatttggtctcctataaaataattaagagaagtggctgaaaaaggtagttataatatagttaaatatttcagtgtgtcagagtaagagcaatagctgttagtcattcctctttgtgggagaagtgggatttgagttggaatggaaagattcagacaggctcagtggggttaactatgtataaatatacagaagtaagaattcagaatgctctaagaagcatcaaatatattcagaattaatgtcagaactttatggactaaattactaattgttaagaaaatatccattaaaaaacaaatgcattgttaaagaaaagtccacaaactggcaaactgctgcatatattagtaagaaatgttagggatgctttttggctcttccaggtctggaaatgttgttaccttgtcataataagaactaatcacagtgaatttttcattaacaaatataaaaccaattgaattggactaatttaaaaagcatatatctttaaattgcatattatattttcatgcactttgattgatgccgtatttcacaataaaacatttttaaatgaaaaatacttcaatgttaaatattaaagtacaactgaattcatgaaaagtcaccaaagatctactctgctcaatacacactgaatgacaagtctaagcttatactctgtctttaaacatacatcttcgttttcaagtaaatgcaaaatagtactaaatagcatccctcaagattatagccatatgctaggaagaataatccagataaccatattattctcttgagagacttgattctaaatagaatcctaacaggtagcatttcaaatacaattttgggcaagagaccactgtggttcttctgccatcacaccacttacctaactcttcccacagagtaactatcttcaaataggaagctgccaagtgaacattaatttaacatattgctaggaggtgcagttctaggaacaagttccaggaaggacttctatctgggagggctttctaatattctcctctggttagccgttccactgtccttccatgaagagccattcctggcattgatgcatttgagcagaatgcccatcaggggcattgtaatgtggattgtgagaggttggactaagaggttttttgtatggcggaagaagatgaaataaaagacttagaaatttccacttaatgttaggatgcaattcaattacttaaatatccatttactgagtacaaaatataaattaggaatacaaggttttccttggaagtcctgtttatcctattgtcttggtgaaattattaacagagccccctttctatctcaaaaatgcccatagtaggcactagagaatatgattttttaataagggcaggcctcaaggagtctgtgatccagctccacagagatggacaacctggattctatggctggcaagaataatttctggttttccaactaaagtggggttttaccctactaaaagctagtgttatctattgctcctcaaattccaaccctaaacttcacaggcctggcctacttcatacactctgtgtaggttaaagtgagaatataattaaggaaagggaattattcgtaaagccaaggaaaatccaaggatttcagcatctgcatgaacatcggttgttaaaaattataattgaggctgggcacagtggctcactcttgcaatcccagcactttgggagaaagaggccggtggatcacctgaggtcaggagtttgagattagcctggccaatatggtgaaaccccgtctctactaaaaatacaaaacctagctcggtgtggtggcagtcgcctataatcccagttacttaggaggctgagataagagaattgcttgaacccaggaggccgaggttgcagtgagcagcaactatgccattgcactccagcctgggcaacaagctccatctcaaaaaaaaaaattataatcgagaaatatacaaattcaatcccttactctcctgctccaccagtactaccttaagttaggacttccttccctcttgcttgggctataagtacaatgatgaaatgctaatcttcattcatgtcatattcaacatcttgcttggctgaagatttagaacacaggtttgtcaagtgtgcagataagcaaagttgtgattaaaattttaaaataactaaaagagtggtttagaatgttccaaacacaaggaaatgataaggtgatagataccccaattacctttatcgatcattacatattaaatccctctatcaaaagatcacatgacctcataaatagttgtacatagtggtacaactattaagtacctataatgatttaacattttatttattcatatatatatatatataaactgttggaaaagaggctcaagattcttacagttctcaatgggcttgaacaatgagcccaccaaaacgtacaatttaatatagataaattgaaagatctacctttagcttaaaataaaacaaaacaaaagagtatggataagaaagaacaggtataaaagtcgttcacctgaagaaacctggggacttaattgggattttatgatccagtggtatgataaagctactaagaataaagtctaggttgaaataaaagaagtagaatgtccttgggacaaaacagacctggttttctgcattgttaggaacacgtgatctgtgttcagtcctgaagatactgagcttagctctacggtttaaggtaaaattgaccacacaatggcaattaagaacagataaaaaagaaaagaatgcatagctgggcaaaaaggaaatgttaaggaggtaaaatagtcatcctaaagtgctacaacaacaataatgatataatagcaagccattgataaatcagtactttctatgtgctcaagtgtgctagtactttaaacaggtctgctttgactcttgcctaaagcctagatgttagacagcattaaatcccttttatcagatgagaaatctgatgctcggaaagagcaagttacctaaagctacttttataccacatgtttgaaggcatttgtgtagaggagagaaagacctattctttccagagggaaatgaatggaatctacaacttgatacagaagataatttcctagaattataactgcaatagagtggagttgtctgcctcacctaataatcagttctcctttgttgtgcatgatcaagccaaggtgaactgttacgaacagaatctacagaaataaagtattctgtgctcattgggaggtggggctaagtaaactttaggtttccattcaacatttggggttatgattctgacactgagaaatggggtactttcgttgccttgcattatacactatttaggtcaagtaaaaatcaatcaaataataaatacattaaattaaattaaaaagtcagatcaaaccagttgttaggctgaacagacaggtctcttcaatcaaaatagtcattcaaattatcctttgtagtcatatcctttaatctacttctgtgattggttacatttcatttggatttcttattttttaaggcaattttatatcatctacatataatattaatagccagattaataacagagcttttaaccacaaggttatagagtatagttacttaaaaatctgaatgggcatctattatttctgaaaatatattcataccacaactgaaagaaaattttatacaaagtatggcaatagaaaataagatccctcttgaacatgcatctctctggaatataaattcctcaaatattacaggaggcctgttgtaagtggagggaatcctcctgattgagatcaaatcacatagagttcacaagagaaagttacctgtccaattggtatatttgagctatgtgtacacaaccagttttcctcccctgttcttgttaattgtttgagaatcaaatccaatggtaaaaaagagaatagtaactatagttgcatgcttgaagcaagaatagtgaaattgggagaacctagacaaagtacttattagttggtgaggaaaaaccataaaactacagggttttctttatatagacacaaagacagatataggctatagcaatacaaatttaactcattcatttagtactttttctttgtttgcaaatatttatagtgtctaccatgtgtcataggtgctagtggcaggcatgaatgacttccaaggaccagtctctagtatctagggttcacatttaagggaatgcaaagtacatttttagtacctgaagagtttatatcttgaccaaatccaatcttttattttgtattctcattgtcctgtgtatctcttctctgctgtgttaacataaaatgatttgtgtgaccacttgattgatattcagttcctcactggagtatacatccattagggtagaaatgatgtttgtttgtgctcacctttgtctctagtgctttaccacaatgcttggggggtacacatgataccactcaataaatattcagtgaatgaataaattaataaatgcaaccttggagaacaaattgttatgaaccacagcctttataagccatatgcaccagctctatgacaggctttgttatatacaaagaaagcatttgcagaaaagtccatgccaaaaccattctcacactgttggagaaaaatatcattaattatgtcatctttgaaaagaaagaatagcaataaacccagactacacatccgccttaaattggccaaaatctcaaatgtttttccatccctactttatgcaattttatcactgcaatacatgctttttttgtaaagttaagctagatttctggcttttaaaattgtacttcataagctcctaacacacaacaggtttgtcatgagttaccaagcaataagaattgacatcagacaatatggataacaccatcataccacatcttaaaaataccttttcacaaggcatacaaaaagataacgtgatgcagattttgcaggcttgcttgagtgttgcctttaaccactctatgtaggtttaaaatgagtagacaatattccacaattgatctgtgtacaatctgtaaaatgttccttataactgttatagaatagaggcatcaaaaccatatccatattcacaaaacaaaatgctttacagatctgatgtaatatttttaaagtttgagaatattttgttttacaataaatattcaataaaatgatatagttctgatttcttgttatagtacaatatgtagcccttttaatgattgacaaaggaaattaatatgtttttgaaagaaaaattctatatatcctaagctttcttactcaattttgaagactttagtttcaagggcttgaaacaaagacatttatagaggttgtaattattatgttaagtatgtgctgttggcaaacttactaattttttatttgcattactgcaggaggataatagaatacatcagattatagctaatgcatcctcagtgacctggcaaattcatttttctatgttcacaaaggtctggtttttacaagcataaactttctttgtagattctagatattagccctttgtcagatggatagattgcaaaacttttctcccattcagtaggttgcctgttcactctgatgataatttcttttgctgtgcagaagctctttagtttaattagatcccatttgtcaattttggcttttgttgccatttcttttggtgttttagaaatttacaagaaaaaaacaaacaaccccatcaaaaagtgggcaaaggatatgaacagacacttctcaaaagaagacatttatccagccaacaaacatatgaaaaaaagctcatcatcactggtcattagagaaatgcaaatcaaaaccaccatgagataccatctcgtaccagttagaatggcaatcataaaaagtcaggaaacaacagatgctggagaggatgtggagaagtaggaacacttttacactgttggtgggagtgtaaattagttcaaccattgtggaagacagtgtggcaattcctcaaggatctagaatcagaaatactatttgacccagcaattctattactgggtagatacccaaagattataaatcattctactataaagacacatgcccacgtatgtttattgtggcactgtttgcaatagcaaagacctggaaccaacccaaatgcccatcaatgatagactggataaagaaaatgtggcacatatacaccatggaatactatgcaaccataagaaagaatgagctcatgtcctttgcagggacatggatgaagctggaaaccatcattctcagctttctgtgcaaactaacacagaagcagaaaaccaaacagtgcatgttctcactcgtaagttggagttgaacaatgagaacacatggacacagggaggggaacatcacacactggggcctgtcaggctgtggggggactaggggagggatagcattagaagaaatacctaatgtagatgacagatagatgggtgcagaaaaccaccatagcacatgtatacctatgtaacaaacctgcacgttctgcacatgtaccccagaacttaaagctaaaaaaacaaaaatcataaactttcctgcatatcactgtcctgtcacccataaacattagaaagtgtcacatatttcagtatgattttaaagcattcttcagattggcgacgtttgaatgtatttttttgcaggccttttacttttcaagtgactcactgtaaggagcaagcactgcttagcttagctattctcagatttttaatgagaaaatattcatgttacaatagaattatctgatttatcatcttaaggtctgtagaaatccattgcataccacaaccatacttgtctatcaaattcagagcagcaaacataggatttgtttgtgtgtttgcttatttatttatttcctcaatttattaactaatagctatacttttcagatttcctgatgttattttttggtccataatcccatccagaataccacactacatttacttattatgtctctttaggctcctcttgcttttttgatgacctaaacattttagaggaatactttataggtattttgtagaaataatgtccctaaattgagagttttctaatatttttctcatgattagattaaagttatgggttttgaaaaagagaacacagaataaaagtgccattctgtagtattgtcataacattggcaagcagacatactatcaacatgacttatctctgttgacattgactttgattacttggcttgaggtcatgtttgtcaagtttctccagtgcaaagttactctttttctgtcttccattacagtgctctttagaagaaccactatgagccatccacacttaatgagtgaggagttatgctcacctccttggcgatagagaagctacataaactattttaaattcttctgcataggaggttttttcactgtatttgaagaagggaatcttaaagcaatcatctgactatcaacaaaccttataggctaagaaaggtacttaacgtttgttgggtaccgttcttaagaaaaatatttaaaaataagaaatggctataatttgttaaacatattctatataccaagctttgttattaggcatgctgtgattctcatctcataaaaccactataggaaccttaggaggaaaccattattattctcatttcatagacacagaaatttgaagttaaacaggtaaagcagcctgctcaataaacacctataatccatcacttgctgaaaggaaaactactcacacatacacacactcacacacacatacatataagaacattatgtcttataaaataacaccttcccatacaacaaaagcaggaagcatggcagagtgtgatttatctttttgttaaagaagaaaagtgttggctaattggaggtttgtaattttgccccatttatttcccatcataaagaatgtaaatgactcccccatctccactaccaccagtactggatatccctggtttgagctcttcaattctccaggggttgtggtcatttaagtgaataagacttcatgacataaaatcatgagaatgcaagaagagtatgggtttttaagagaatgtaaatttcccattgagcctactttatttctaggcataaatatgtgtttgcttaaatatccacatggttgatgtaacaaaaccattattctttctcagcaaacatggaatttctgttttcacagaaccaggtttctattcaaacattttatcataaactggcagaactaccaaagcatgcacagtcttaatattaatcaggaatttctttttcctatacaagtcacaaaaagctttataaagcatgatccgcttgctatatgatgaaaagcatttcacagtttgctattacagaattcacatgcctgcaaacatgtaatgacccaattgaaaacacaaggtcagagtcaggttgtctaaaaaaaaagctcatatgagacatcttggtgagcaaataaatatcacttaatgtaccttaatgcctctcagacagactcttagtacttaaattattcttcactgaatttgttaataattttattttcaaaatggaaccatagagctttactttttcagtaggattcactcaattctgaaggatcaaacagacttaaaagaataaaatcatgcctttaggtaaatatgtatgtaacactaatggaacagtgcagtgtatatcctgcccgatagtattgtactgtacaagtgtgtctgtttaagtggacacaagtcacaatgtaaggctcattacccttagacttagtaagtaatttaactcaagtcctgaacattctctgctgtaaaacctgcaaatgcatagggatttgcaaagggaacgggaatggaatgtgagacaaatgaaacttaattgaccaataacaagttctgaaattgaggcaataattaatagcctaccaaccaaaaaaagtccaggaccagatggatttacagccaaattctaccagaggtacaaggaggagctgggaccattccttctgaaactattctaaacaacagaaaaagagggaatccaaagtaactcatttcatgacgccagcatcatcctgataccaaagcctgacagagacacaacaaaaaaagagaattttagatgaatatccctgaagaacattgatgcaaaaatcctcaataaaatactggcaaaccgaatccagcaacatcaaaaagcttatccaccatgatcaagtgggcttcatcctgggatgcaagtctggttcaacatatgcaaatcaataaatgtaatccagcatataaacagaaccaaagacaaaaaccacatgattacctcaatagatgcagaaaaggcctttgacaaaattcaacagcccttcattctaaaaacgctcaataaattaggtattgatgggacatatctcaaaataacaagagctatttatgacaaacccacagccaatatcatactgaatggacaaaaactggaagcattccctttgaaaactggcacaagacagggatgacctctctcaccactcctatccaacatagtgttggaagttctggccagggcaattaggcaggagaaagaaataaagggtattcaattgggaaaagagaagtcaaattgtccgtgtttgcagatgacatgattggatatctagaaaaccccattgtctcagcccaaaatctccttaagctgataagcaacttcagcaaagtctgaggatacaaaatcaatgtacaaaaatcacaagcattcttatacaccaatggtagacaaacagagagccaaatcatgagtgaactcccattcacaattgcttcaaagagaataaaatacctaggaattcaacttacaagggatgtgaaggacctctttaaggagagctacaacccactgctcaatgaaataaaagaggacacaaacaaatggaagaacattccatgctcatggataggaagaatcaatattgtgaaaatggccatactgcccaaggtaatttctagattcaatgctatccccatcaagctaccaatgactttcttgacagaattagacaaaagtactttaaagttcatatggaactaaaaaagggcctgcatggccaagacaatcctaagccaaaagaacaaagctggaggcatcacgctacctgacttcaaactatactacaaggctacagtaaccaaaacagcatggtactggtaccaaaacagagatataggccaatggaacagaacagagcccacagaaataataccacatttctacaactatctgatctttgataaacctgacaaaaacaagaaataggggaaagcattccctatttaataaatggtgctgggaaaactggctagccatatgtagaaagctgaaacaggaccccttccttacaccttatacaaaaattaattcaagatggattaaagacttaaccattagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaacaaacagcttctgcacagcaaaagaaactaccatcagagtgaacaggcaacctacagaatgggagaaaatttttgcaatttactcatctgacaaagggttaatatccagaatctacaaagaactcaaacaaattgagaagaaaaaagcaaacaatcccatcaaaaagtgggtgaaggatatgaacagacacttctcaaaagaaggcatttatgcaggcaacagacacatgaaaaaatgctcaccatcactggccatcagagaaatgcaaatcgaaaccacaatgagataccatctcacaccagttagaattcgatcattaaaaagtcagtaaacaacaggtgctggagaggatgtggagaaataagaacaattttactctgtttgtggtactgtaaactagttcaaccattgtggaagacagtgtggcaattcctcaaggatctagaactagaaataccatttgacccagctatcccattactgggtatatactcaaaggattataaatcatgctgctataaagacacatccacatgtatgtttattgtggcactattcacaatagcaaagacttagaaccaacccaaatgcccatcaatgatagactggattaagaaaatgtggaacatatacaccatggaatactatgcagccataaaaaaggatgagttcatgtcctttgtaaggacatggatgaagctggaaaccatcattctcagcaaactattgcaaggacaaaaaaccaaacaccgcatattctcactcataggtgggaaatgaacaatgagaacacttgggcacaggaaggggaacatcacacaccagggcctgtcatggggtgggggggagcagggagggatagcattaggagatatacctaatgtaaatgatgagttaatgggtgcagcacaccaacatggcacatgtgtatacatatgtaacaaacctgcacgttgtgcacacgtaccctagaacttaaagtataataataaataaataaataaataaatttgaaagcaccttaggatcgtcgtttcctcctcacatttagaaaaatgagaatggaatcaatctcatgttatgtaatattaagaattccttgtaaagtcatctgaaattaaacagctccatatgacacaaatgcagaaatatttgcttttttaaaatttagtacgtattgcctgagcaaagcactcttgtgatgaccccagttctaaaatcctagtattatctttgatgaagacttctggtttatttttatttacttatgttcattatgattttcccctcagaattcaaccttttccctagttctctagctgcttctccatccttttatctgcttgcttatttctgtattactttaaggaagtgtcagggctgtgtgggccactctccatagcaccccagcttccaattatccacccttgcataatgcaaccacagaatccaaacccgttgtttcactactactactgtttatgcctatgtcctttaaaagtttgacagtaagtttctatcattttatttgtcaccttacctgtaaaattccattccctaaaactgaattgcctgacctatcacacctactcattcatttatccctgcagtcatatgtccattcacctctccatccattcgtttattaactacaatatggaggatggagcgggagagagttagggaatttgttgggtcacagtttgcacaaagttaaggaagagaaataaatcatgatattgtaacagaactgctacatttagacgtggctggaacataaagaacaatggagaaattgtgaaagatgagactggagtagtaagccagggccagcttataaagatagatttaagagtttgaacttcattctgaggataccatgggtccgtgtgttttcactacggcaatgtcatgattggttctaaatttttgaaaagctctggctgtcaatataatttgcactgggatagatattaagatcttgtgaagtaatttcatacttatcatctcacataatcataacttcattaatctctctctcaagtatttattcctgctttctttgccacattaagtcttggagaaattaatcttgattttatattctataaaactagctcattcactttccttctgttttataacttacttctgttcatctcaaacaaaatttcttatatgtatttcttcctttgaaaaaaaagaataaaattagccaaggattttggactaccccgacccaatttctttctctgtaattcaccgttttgggtgctttcaacataagtctttacatgaaagtaaagacaagggaaagtaagaaataaaaattggtataaaatgaataaatgaccatgacatgagtaaagtaaattgagagctggtcttacaggaagaaagctgcttcggtagtaaaaaatgaagttaccaatggaaaaaccctgttccaaaatatttctcctgttttttttttttctacaagattctgctactatttctaaagatctttttatatttgttttctctgcaacagttattttgaaaaataatgaaaattttaatatggtcaaaatttcatggagtcaagatcccatctgttttacatcactcctgcttcttttatttggcctcagtctaaatatacctattcaaaaaaaaaaaaaatctgccgggcgtggtggctcatgcctgtaatcccagcactttgggaggctgaagtgggcagatcacctgaggtcaggagctcgagaccagcctggctaacatgggaaaaccccactctactaaaaatacaaaaagtagctgggtgtggtggtgcacgcctgtagtcccagctacttggggaggctgaggcaggagaatagattcaacctgggaggcagaggttgcagtaaactgagatcgcacggctgcactccagtctgggcaacagagcgagactccatctcaaaataaataaataaataaagattgctttgattataaaagtgtcaatgcttatattgtacaatacacataatcttcataaaagagaaaatgtttaaaactcttcaatttttccattaaaaattattcattgtgaatgttttgggtatgttccttgtcaatagttttatgtgcatgcctacaaatgcacagtgatcttccacccaccccacacacaaactcagtgctattacatacatacagcttttataaattgaggacaataacagtatgtgtgtatagagttgtgagaatgaaataaaataatatcctaaagtatctgtcccagagtttggttcatactaagtgcccaaaatattagctattatttcagttattcaggtatataacctacttgttcacacaacatctggtgggcatcttctctttttaaaacgtgattttaacagttgcagtcatggggtcactgaagacatgatctttcgtcagagggtcccggattggagtgtcttaacggttctgccacttactgcttgtgggagcttgtatgtgatttccttattcaaagattgtgggtaatgtttatcttccagattttttttttgttttggggattagagatcatgtgtgcaaggtattgaaacaaataccaaataaataatacctattgtttcctgtgttcctgctatggtggctgcaatgagcatgttcatatatgttgctttttccttctgttaaattatttccttgggaatgattcccagaaattggattactgagttaaaagatttgaaaatagctatgttctttgtatttactgttatgctcttttccaaaaagtttcaaccaatatgtaatgtaataagcaaagcacctcatatatttaaagaatgttcctatacctgtttcattcaagtccagattctatgctcatcacttaagaaggggaaaatctgggatagattttactgcaggaatttcaaaccactgggaactgaacagatggtgctaactcattttacgtttgagagatcaccagtcagccatgctcagtaacagctttcagaaacatctggattcaaacttacagcctaaacatgacaggttaagtagcatagagttataaaataacttcatgactagattctcaaaaatccaaattcccagagatttttatgatttttaatgatcagaaaaatttcaaacaatgtaagcattaagaatcacataaactatatagcacttcaatttgatattgtggaattcagagtgtggatggtctatgaagcttttaaaaatactattctgtagatataaaaatactaacaacaattttactcaaaggagcacaaaaatatatgcagtcttccagttatatttattaaatcttactaaacttatgtgaaactgaaatagttaactttttgagaatagacagaggcaataaaaaaatttgcctaaaaacaaaccttatgacatttttatccatgtcataagtcttactggaatgcaatcttctggaaggcagacctcaggtctaatacattgtttttcaatgcctgttatagtgataggcactgcatgtatgcctaagtaaatggtgactgttccagtcactgctattgatttaatataaaggggagtcttcaaaaagctcatggaaagtgcataatatgaaaaaactatgcatgggtttaaaaatgtttgcccaaaatacatttgtactaacttgtaacctatctgaacaggatctagtttgaggcactaagaagaataaggtatctatttaaaagagcccttattaaaacaacataaattctgctaaaattgaagcaagaacaaacatcaaattcatggtgaagtttggttggaagaatggtgaaatcattaatgctttacaaaaattttatggggacaatgctccaaagtaatcagcagtttacaaatggataactcattttaagggacaagaaaatgttgaagatgaagcctgcagcagcagactatccacacacatagaattttttctttgtttatgccctaattgaaggggatcgatgactaacagcatgaacaatagccaacatcacaatcatttcaatttatttggcttacacatctgactgaaaaattaaaattgagcaaattttccactcaacttcatgggtacaaaaccatataacctagatcaactatagacaagagcagagttttcaatggaaattttaatttaaacaagtgggattgagatcctaaagctttctttgaagaattgtaacaggagatagaacatggcttcaccaatatgatcctgaagataaagcacaatcaaagcaatggctactgagaggtggaagtggtccagtcaaagaaagagtggaccagtcaaaagcaaaggccatggcaatagtttttttggatcttcaaggcattttatttgttgactttctggaggaccaaagaaccataacatctgcttattatgagagtgttttgagaaagtttgccaatgcttagcatggaaacatccagagaaacttcagcagagtccttcttcacaaccacaatgctcgtgctaattcatctcatcaaacaagggcaatttttcaagactttccatgaaaaagcattaggcatccaccttacagtcctgatttggctctttctgacttttttgtttcttactctttaaaaatctgtaaaaggggccaggtgaggtggctcatgcctgtaatcccagcactttgggaggctgaggcaggtggatcacgaggtcaagagatcgaaaccatcctggccaacatggtgaaagcccatctctactaaaaatacaaaaaattagccaggcgcggtggcgggctcctgtagtcccagctacttgggaggctgaggcaggagtatcacttgaacctgggaggcagaggttgcagtgagccaagattacaccactacactccagcctggcaacaaagcaagactctgtctcaaaaaaaaaaaaaaaaaaaaaaaaggaagaagaaaagaaaatctgtaaaaggtactatattagtccaatctcatgctgctatgaagaaatacccgaaactgggtaatttataaagaaaagaggtttaactgacccgcagttcccagtgtctggggggaggcctcaggaaacttacaatcttggcagaaggcatctcttcacagggctgcaggaaagagaatgagtcccgagcgaagggggaagccccttataaaaccatcagattccgtgagaactcactcactatcgtgagaactcacccactctcatgagaacagcatgggaaaactgcccccataatcgaattcacctcctatgaggtctctcccacaacacgtggggattataggaactacaattcaagatgatatttgggtgggggcacagccaaaccatatcaggtacttatttcccttcagttaataatgaaaaaaagactgcattgataatgattaaattcccggaccttcagttctttagggatggactaagatggctggtatcacggcttatatgagtgagttgaacctgatgtagcttatgttaagaaataaagtttacattttcatttttatctttcaattattttcttccatgaattttttgaagttccgtcatattaccctccaaatttagtagtttgtaacaactatttgattatgttcattgggctgtcagactctatgagtcaggatttcagaaaaggaactgtagggatgggttgtttctactccatgatgttctgaaccttttccgaatctagagatagtgcaatgggtggggaccagaaagctttgaaggctcatttgctcccatgtctagagcctgagttgaggtgactcaaatatggagactcactaaccacagcacctacacatgccttctccatgtggcttgacttcttcacaacaccatggccttggggtatatggacttctaacacagtagctcagggcatgagtattgtagtgcacaagatgggaattcaattcccttttatggcccagccagattcaaggggaggggaactcttcatgagagggtggcatataagacaggaagtgctattataatcatttaccatccagtcctgttctctacctattacttgtactttttctaccttgttaaattaaaaaagaaataactgtatgtctttacatagctttattactcaaatatggtgaggtgggtgtgttttgttctaacttttaaaaactatatataattttttaaactcgatcttccttaaagattccagaacacctccactgaatgaatgggttggaatgatgtgtccttctgatgaaaatcaccacttcgccattgatttctcaaatgcccagtaatcagaggaggaacaaacatacattaatctcatttttcacaagaggatattttgtatctgaccagaaaaggagctttccaaatatttggtgaattatttgaaacattaaaaaaaaactttaaaataggcttatagagtttatttgaattctttagttgtttatgatatctttttggccataatcttcaaaattagatccaatggaagacatttcaaaatagtaggatactatatagagataatttatgttcagggtaattcatttccctaatgaccttttccttgcaaattgcacaagtttgatttgtgaactcaaagtatgtaagctttagtctcatatgaaacataacagtcataaaataaaaatttctttttcctctttgacaggaagacttcttagtttctctctatattcaattctcagttaagagctttccttgttgaaggctgagtatgagttttccactgctattgtcagcttttatcatttatttgaaccaaggtctccttagtacattagtttatcttgactgtcagtaagagatactgacagtttcaccttcacaagtgtttattaattttcttttctttttttctaagcatagactggagatcagtgactacttttttcatattcttatcatactgatgaacttttaaaaaaattcaaaacatatatggcataaggtcttttaagtgatgactcttccccagaatattacaaatagtacccaatttattaatgttgaagatgttaaatgattctcctctattgactatattttattttttatttgttttttagctgaaagaaatataagaaatacaacctaatactgtaatgaagtgttcctgaacaaaaatacagataagctgttttaaaatattatctttatttgtatgctcatatcaggataactccaactaaggcaatttgtctaagtagctcatttatttaaaaagaaaagtaaaaatagcaatgaattatttgcctctgacatatttgtgaaagttttttaagaattgtgctgggatgggaaagatgcctaggaagcattttccctaagaacatcaggcttcttacagcaatttatacacatgtatggtaaattattctcattgccaaagatggttatttagtatggatagattctccaaaaacttacaagacatcatcattcatctgaatctcttccctgctccccaccattcagaatttgttgtaatttgtgaaagaaaagtgaaagaggcaagaagagtgaagagcttcagatttaaccactcagagtatgggttcaaattctgcaatctgcctcaaagtaaatatgtaaactcttaaaaatcatttgactttagtggccctcagtttccttatctgtaaagtgggtttgataatacctgctatgtattaaaatatttgtttgggtgatgacactgtttaccaaggtagatttattaataccttattttaaaaaatcattatttttttctttttgtttttggagatagtctcactctgtcacccagactggagtgcagtgccacgatcccagctcactgcagcctcgacctcccgggctcaaatgatcctcctacctcagcctctagagtcactgggactacaggcatgtgccagccaccatgccaggctaattcttgtatattattttgttagagacagggtttcaccatgttgcccaggctggtcttgaacttttgggctcaatccaccagtcttggcctccgaaagtgatggattacagacatgagctactgtgtctggcagaaaagtcattttcacacttgctatgtggcagaacatccagtatctattgctctctttgcagataaattattttgtgccgaaagcaacagcaatttctttggcagaaaatgtgattatgttatatcagtagataatcatgtatctcatgtaatgcaagctgtacaactaaacatgagaggtcacttcccagcttcctttaatatgtatttgctgtattgtcagctatctcctgagagatgataaatatcacacacaatagatggaagatgacaaacatggagacaatgaagtgagaaacccttaaaatcaagaaaattgtactctataacttaatagtttcctgcacattggggaaaggtctctgttattcagcattagcacaagtatcctttagacaacttcactgaccaaacagtggcccccaaacagcttgagcaatacagcgtgtgttgattgatgaacacatcccaacagtatctactgggcacctgcaatgcccgcacaccacacattgcttgtgctcagctttcaatagacagcgcaggtcaagcaagtgaatatgcgctgagttgtttgttgttgtgctgttttaataggttttggtttacctcgccatgcaaaggtgggtgaaaagaatgactgaaatctattttgtccccaccctgctttgtcctctttgggtctctatggagaagaatggacagggagaatttagggtagcttagagcctccctgtctcatgcaactgatactcagcaagggaagcagtgaccctcaaaacccaaattttgagtggccaggcctccaagatcagacaaaacgagaggaagaactatcacaattgtctacaagtagcagtgttcttggcttgggcccaaaataccaggaatattttcattaatagggacaatgataaataaaataggaagtgagataagaggtcattgcctaaggaaacaaggtttttcttctcatttttacaactctccaaatgacccacaaaaggaagtgcaggcaaataatattttaagttccagaatgcactttcacttttccaagcaggattgcctacagataaatccaagagggaggtcattacattgaatggaagatatttagaataggcggcttcgccccatgtaaagcaattgtaagcctttctttgtgttttagaagtttttagataaatagtcagactcaattaagctctataacttcaagagatggtgcttctaaggagttacacagtagggactgcagacgtgggattctgcggtctgttaacaggcctgtgggagggctgagagaatcagctattgtgcttcaatcagcaacagagcctacagtgccaccgtcaatttaaccatggagctttagagtgtggatggggacaaatggctgtgtgaaacagaacttgagaaaggggcaacacatttagtatgaaagaattaagggtttagacacaaagacaactacagaaaaattttttagaaataggcttaaggtttgaggattgacaagaggagacatggcaaacgttgctgcagctaatctcatatttggttaagagcataggtcatagagccagactgcctgggattgagtgctggcccataaatttaactactgcgtaatcctgggcaagttacttccactctctgtacctgcctcagtttcctcatttgccacgtgaggcaattataacactatctacctcacattggcttttgaggtattcaatgaattaacacatgtaaagtttttccaatggtctcaacagttttgaaaaagtgctcaatatttaactaacactgtacccagaacttcccctagtaataagtagtatttacgtaacacctactaggtgacaggacttatgcaaagtaatttatgtgtattatgcttgcacttaataactctatggcatagatactattatcacctcaatttcacccataatgaaattgcagcacagagcagtgaagaagcttgcccaaggttacacagcaagtcagtggtgctatcagcattcaaatccaagcagtttgactctaggcatgacacacttcatcactgggctgtactaccgttaaacttgccataggaaatagtggacacaaacaatgtccttgcttttaagtctgtttcagtgggtttaggcttctcaacaacaggggttttagtgaatttcttacatcttcctagtaccttgcagaccaccttggctgaagtgcatatttgattaggtaactggctaactggtttcctgccctttgttaattgcaggtgctaagctctatgactcctgcctgtatcctaaaagcgcatgacaaaactcatgccatccctcatggagcagtcctcctgacactgctatagtcccccgtccctcactgtgtcacccctcccccatgtcccaataaagggacagtcactggtctctctgttcattcaccttccctgtcgtccatcctctttgcagcactcccactccatggccagcatggggaggatcacaggagactttattaaaaacaataatggaggagacaagagaaataaaaaggagagacaggccgggaggtccctttgaatctttttgtcttgcctggtctgagggctgccttgccacctctgctttcctgcttttaatctcagaagtctctaacgtgcagaatgagcaaagtgggggttgaaaaaagcaaaccatttggaagccagaaaaaatattagaactttcatttctaaaacaataagaaagttaataataaattcatataaggcctaacattggagccttcacaccatcagtatattaagcggccgtgcgtcattcatctgctaaaaaaaaaagaaagaaaaagaaaaagctccagagagctaaagaaattgatggggctgcctcacttgattgtcctctttcagcacattatgatatagcacagcttcagtgtatttgggaaaacggactcatggattattttatatagtttaaactaaattaatatttacaacatggacaagtgtcttaaaaaacacaaaaatactggcacatgtgtacaagaaaatagcagttcttgagatttctattcttggtaagtgccatgtattagaagtaaaaaaacaaggttagctaagtagatctaacaaatcatcagagaattttgaaaatatcaaaattcctccttgaaattcagattttctttcactattcttgacaatgaattctgcttgaagtgaatagtatcctttacaatatgaggcaatcatcaaatactacattcttaaggtaaaagtagataagtgtacactatcatacaattgtataattaaaggattagataaattatagaatttgccgctaattaaccaagagtactctattatcttatcaaatttgtgtcatgtgaaatatgggtgggcctcagtattttaagagtctaaaacaatctgcatttgtttttgaaatttacaattggtacccttaaactgctttctgtaaggcagatttggatgttcttacaacagcttggcaacaaattcaaactatcgaatgtaatgtttctttgtgcccaccagtagctaggtttgggcagctttacctaactaatatttgattatttgaaagttttcttgcagctattttgaaactatgttcctttggacatatgggatgccctgcggaatgctcttggagggccaagggaagagggtttagaaggaggcctcactccacttcttctgtaacctctccatttgtttctagatattaaacttctgcggaataattcatttgaaaatcaggttcgattgccaagaattatttaaaattcatcagttcattgattcaaaaatattgtctttattattgacattttaagttattaaatattcaacttattcaataaacccattcatttattctacaagcattagaacaactataaccttatacctttgttcttattatttaaaaactgagtagaattagaaaataataagaagactgataatactggtaataaggttacaattctcaccccttatatctgtgcaattaaaataaggtggatgtcaagacctgctgggtggggcaaaccttgagctacaataaaaacctactgaactttaatctagtcagctctatatcaagagtgaagacaagaacattgttaaaatgttttatgaaatcctggggctatctttcatctttaagggtttagagaagaactataatttgggattttaaaatatttattggttctctgggaatggaaagtctccaataatcttgaagggtcaagcattgtaatttaacttatttaaccttcagaaacaaagtggagactaccaataaagcatactccttcctaatgaatagagctacacacgtcactaaattttacaatatgccatccttcaaaattatcataagccatttcgttgaaatttatagtaagtttacctatctgatgccagtgagtttggtcgcttataggtacatattactagtgatttaagatattcagatttttttcacttgcattttattcatatttcagctgctgatttacttcagacacacctcaatgcctgtgctaatttgcatgttttttcaagagttcaacacaaacttaggaaacacattcctagatagacctctaataagtgacctgcacagtcatgtagtatagtataaacaagtaacaacagttatcttactctatatttttcagtacttactgacaaaagaaaagatcttcataggcctaaatgcattctggatgaaattattagctactttctctgttcaaaatcaccttttcatttgcttgaaggaaaaaattcagattatttgagcagacaactaagaccaaatgaatctaaagctctctcacttctaattatttcgaattagataacagtattcaggtatagatcctacatggaaatagcctccaaatgtaaagagaagataatccatggagggcgtcattctttaaaaacctctttgataagagagggggcacatcttttgtacacattgtaagaagatttaaacatggagatgccctccctccctcagaccatggggccaaaaccaaagggggtttggaatttcccaactccaccgccaaagataatcttgtattgggacaaaagtcgaggatgactcagaatgtaattagggttgtgcatctaagcaaatgacacaatatagcttgcggtattaaaaaaaaaaaaagaagaaaagaaaagaacacaaggcccaggaaaaggctgctaatgtatccacacagagacaaggctgtggcagaatgaaaacaaaacctccttaattagcaaattatagcacaggggctgataaaactctgtgttttgtagctgagctacccacttatcgctcctcccctctcatcatctgcacaagtgagagcacttctaatgtttatacttaaaacaaatgacaggggggaaaggtttctaataagaggctgagctgaagccccatttctaagaaaatagaatggctctagtgttttgtcagcattcttgctaatgccacaaccaacaggatgaaacaggcacatagcacagaagatcctgtagcccagacttgtttatccacaggctgctggtctgtattgttattcaggtgctttttttttcttttctgatatgtatctgctttaggaatatttccctgttcttgtgatgatgggcaggagaaagaaaagacatgaaattcccttgtttgtgtgcctctaaaatgtcacctcacagcatgtccagacacccagccaagaaatggcttagtcaggctctctgccaactggcatgaacctgaagattactgggcctcctggagggcgatctttttcccacacaacaaaccttacaatctaccttgcaatggtcccaatactaatactaattcctcttgcaatatagggcaggggtcagctaactttttctcaaaagggctggatattaagtattttaggctctgttgcaactcctcaattctgcttttgtagtatgaaagcagccatagacaacacataaatgaattagtgtggctctgttccaataaaactttatttacaaatgcacggacaacatataaaggaaggaaagtggttgttcttcaataaagctttatttacaaacagaggtggcaggaaggatttggcccaagggccatcgcttgttgacccttgatagagaggatggaaactcagaatattaataaaatttctgccattatgtagttaaaaaggtaatatgtaaaatatagttgcatcaaatttcacccatcaatttgattatagtccaaatctgctcatggacttcatttatttccctatttattaaaaaataataaatagagccaactatgctgtaagcattgtgctagaaaagtcaatctgctaccagaaatgattaaaaaaaaaagaagaagaaataaaaactagtgaacaagacaggtgcatcatgtacctcatagagcatagtgtctatgaaaatagagagtcgctcattctgcaaatatttattaaggttctaccatgtgtcatccactcttctaggtagaaggtatactgcatcaacgagatagacaaggatgctgctctaatggagtttgcattcttagtaggcggagatagaataaataatctgacagacaataagtaacacagcattatgcagtagcaagtaccatgaagaaataaaacagtataataaggtagaaagtctcttagtaaagtggggaaggtggtaggtaatggtgctcagagactttctgagaagactgctgagtgaagacctgaatgaagagaagtagccaaccatgcaaagatcagggggaagaattttctgagctgagtaaacagcttgtaaagtccctgaggcaggaatgagcctgtctgttggagaaataacaagaaggccaatgtcacttgagtgtctggaatgtcgtttgaaggtagtaaatgatggggccagtgagaggtgtggggcagatcatataagacctcctggtaagaattcagattttattcctatgtaatgagaagttgtaggaggattttaaggggggaaatgacattcttattcatttaaattacattaagccaatacctttatatgagaggagtgctattaaaagaaagctcaatgtgaaatggtacagtcaggggtaaggaagaactgtaattgcccatagaaactcatagaaaaggacctacttgtcatagccctaaaacctgagctctctcaatggagacagtttaccaaaaggctgttataacactaactgcctaacttctgggtctgaaagggttttttttggatcttttgattctaaaatgtaacaagcaaccaataataccgaactatttgttgaaaagttaatacagattctgaagggctcttacttggcttgaaaatcagaggtctattcttcaaatgaagttgatggggacatttctacaactcgatttaaaagatcattatttctattaatctttctcagcaactgttacttttcccaatctctaggcataaattgtgcatgtatcttattttcacgtttagtgacaaattattaaaatcatacttactaaatatctactttattttttttgagatggagtcccgctctgtcattcaggctggagtgcagtggtgcgatatcagctcactgcaacctccgcctcctgggttcaagccattctccttcctcagcctccctagtagctgggattacaggcacacaccaccaggcccagctaagtttttgtatttttagtagagacagggtttcgccatgttggccaggctggtctcgaactcttcacctcaggtgatctgcccgccttggcgtcccaaagtgctgggattacaggtgtgagccaccacgcccggccaatatgtacccatttcacacatttaggaagttcccacaaatgtgaaaataaaacataagagcattctctctgactgttgcacagccaccaccggccaccaaaacaataatataccagtgagaattaagttctcatgtgcacatattatacagatgtatattaatataattaagttctcatgtgcacatattatacagatgcatattattataattaagttctcatgtgcatatagtatacagatatatacatattatacagatgtatgcagtaaatggctccctactgtactgaacaagaaatactaagttcttgtgcttatagaagtacaaaacattattgtacaaaggaatatctagctgaccctcaagtagcctagtgctaacatttaagcagactttagcatcttaaagtagttacaaggtcccttaattttcactattttatagttaccactatacacttgagcacttgatttcttaaaaactgattattacaataacaaaaaattaatccagacccttaatgaacatgttcagaggtataaaaatggataagcgacatttactacacttgaggaactcacagtctaggtgggaaaacaagcctagaaacaaacaattaaaacaaccaccacaacaactttgaactacagcattaacatgatacagtcaatgtactgtgatgacatttgagaactcagcctgggagggtaagtggagtgtgggtagatttcctggagaaactggcaacagagctgacccttaaagaataattaagaagatgaattggagtgactagagaagtttttgagattctagattactggttaaatataatttgaataattaataaccacctactctggacccaatattgttttaactagtattaggacaaaaataaccataggttatagtccttgcctataggacaacttacaatctattgaagaggtaaggtgtatacctcgaataaaatgctgacagtagacagtaaagtgcagaatgcaatagataatgcattcattttttcatttaacacatatttattgcatatctgttataaatatgttatatactcttctgggaactgaggttatgacattggacaaacacacatggtcactggcctcatggaggtcacattctaatggatattaatagggattaatatatatgtaatatatgggtttaaaaaaatcgtcatcatcaatgtgttttgggtaatagcatttcaaatcttaactctgaagaaaagaatacaatatgcaaataggggacatccttaaccaaaaaatgttgtcaatagaaaaacagctaaatagtccagtaaaatctttgtatttcttaaaatattctggatggcaattcataactatattttccattaatagtcatcaattttagctagtgtaaaatatgtatagcaaatagactattgttttctgttacaaggcattattgactcaatttatttaaacttttaacaaaaaaagacatcatttggcaaaagcaaaacagatcttctaaggattccccaaatcttagaacattatacatatttaaatctaaatattttaaatgtacatctttgtgaactttttgagatgtgggagacagaaaacaatagttcacaaagtacaggatgtgggctaaatgtttcactgtcatagagaggtagggagagatcataagaaagtgacaaagacacagaggccagctgtatttatcattacttatctaagagctggtcactctcaggtatttactatgacttgctaataattccaaaaagagctgtattacagaagagatcaaaccagaaacacacccaggtgtttcacaaaataaaactatgatgttaggcatattattcacaccacccttcctggtctgagatgtcacaataatgctatcaacctacctcattttaatcgacaagtgattatggaaagttgatttctttgaattaaatccatcacatcaagaaagcagtgccataacagttccagtatttatggtgacccacaaatcatttgcccccttgcatgccttgcttctcatcctgttcagttgcaagaccagaaaagttgaggaaggaggtttcccttcatggaaggtgatggattaacataattatcatatagcttcatttagagttgataacacatctattctgcctcaaaacctttcctgatagcgatgccatgagctgcataataatcactatgctttgattaattattttgccaaataaatggataaattaatttcacctacatacactgatagcctcagtttctgcagggtgttgcttcttcctatggcaactacttggaatcaaaatagaagtaatacaaattgcagtactgagcataccaaatggttacagtaaaaagatttccatttcaattatcagaataaaaatatcacatgaagtttagaacttggagtgaagaaaactcctaattaagggaaacttatgaaagcctttagcaagttctttgctgaatgcattttttggtttcttgatcctccaaccaatcacattgacaatgacaaaagatatgcaaatttaaactgacaatagtcaagccacattgctctgactcataccaatagggacgttttcagcatatattcagcttgatttttacacttgaaagggtgaatgtaaccaaagaacattttaatagttattcttggctataatctgaaagctatcccataatcattgaccaagaacaatgcaaacaagaatcaaatttattttgcaaaataaattaacatatgaaacacgtgcatgatttaagcccagcagaattatgtgtttaccctgtcactgctgaataattgcatagcaacaagaaatatgcattactatgtttgaatcactattgtgattatacgctttaagcaaacaaaacattacgtttttggtagaatagatcattcaggataacttgggactaaattttccttcccgttccctcaaagaatccagactaatatgtaatgattgaattctcactaaaaactatacggatggtgtactgaagaataataacaagctgttcaaccaaaatcatttgtttacaatggaaataaattttaccaaagaaaaatacaaacatcctattataaactactactgaaagtaatgcataaaatttcagctacaattgtaaaaaacctgagagttctgtttgctttttattcttctgcctacctactgattgcctattacagtcctatagtctgtaatagaaagattacaatatcagctttggaaactgtagaactactaagttccagttaatgtgtcaaataaaataacagtgatcttagttcagtccctagtggacaaaagtagaataactattacttggcatgattcagcaggcaatgacctaagtgagtgtgaccacacaggaacaaaatagagcatttgtcctttccctatcttttatctttttaaagggattgcccggttaacagactaacttaaagaagcctgattgcatacctatctacatgtaccaagtgaatccattaacaagggagagaagcttttcacaaattgagacattgcctcccttctagtagcatagtcagttgaatatacttattctcggctgcctattattaaacagagtgcaaagacagaatgaattgcagaagtgtgttcataatttaataggcttatcttcaacaaaaacttaaatggtttgtagataaataactggataaactattcgatttgatttctataaattgagattacattcatactcaacattaacattcatcaaataacatggatacttaaactcgccaggtactgtctctaactacaatgccctgagaagggaggtatttcaggaatatagtagactacatgctgcgttcagcccatatctgcaggtgcatgtcttcctcaacagccagcatgccctcatcgtgagcgagcaacccctttccgacagttaacattacaatgtatctttttaattttttttctcaaggacagaagaaaaaaatatttaacagaaatcagtctactattctaccacttgctgaaactaacagttccctttacataaatatacaatttctccaaccaaatatcatattttatatttactctcacttcatgttaatttttataaaggttaaaaaaacaaatactttgtgatgatttgccaccccagcggcacaaaattttctggtgcaaaatcgatttgatcttattaattaatattgtcattattatttatttttcaccaacttgcttaagaggtacatactttctttcttaaggtagtgttttgacagagagaaccttaatgctgaactttagaaaagagaaaccaaaaatgtcataaaatttgccagggctagacacacaaacggggtgcccccacacattcataggtttgggcaagcccccaaaccttggcttacccaggaagccaaacccagacagccgtcttgcaattgcaaacactgcccccctggagcaaaaggtaaatacacaaatgctcccctaaggaactttaagttagctgcagtgcaagaaaggaaaaaggtccgtgctattagaaactgaaagcaatcacttactttttgcagccactgagtataattttccatcacatgttccagatgttgaagtttctgggaagagaaatccggttccacgtgtggagcatctctctgcagagcgtttgtgttgtactggtctgtcgtactctcacgacagttgccatcgtgttctggaagaatgaaagtgtaggcacattgcccatgttgaatccggttatatcttctcccactgttttctggacttcggcgctgattgctgcaccctatgtgagtcagaatggcagcgaggaaagcaaaggaaaggaaaactgtcattgtactgccagcacactccttccgtgcctctcgcaaaacttgctcctttcttctgacctctaaaactagttctttatttcaggtaaaactgcttgtttgtttgactctttccccctcaaagaaagcgtttgaagaagaatcatagaaaactagccatttgttagctttgttctaaaattttaaaattttttatttcactgcaatgatgtttttcttcgttaaaacttgagatatttattgcatagtagctgagatttattgtttcctctctgtgtgaccgttcagcatggagcctgcctgagtcagctgcgtgtacatattctagaccctttcctctaccctatctgctgcagatctgctattttctcccagacctcagtgagttttattaaggttgcacatccaagccaagctggaagcaggcagcctttcacaagatgacttgacaggaatgcatgagtgtgcccc

SEQ ID NO: 1452 - DNA, 248545 bp, Homo sapiens; identical to SEQ ID NO: 1451

SEQ ID NO: 1453 - DNA, 238590 bp, Homo sapiens
ctgcgtgatgggacatcaggcagctttatttatttactcttaaaactgttacaacagaatcatggactgacacaggtaatggctgagccataagcaaatcgagaagtacagaaatgtcccaccccaaacagctgcggagtacacatcacacagggcctctggtcccggccttctcaggtgctctggagtggaggatcctttgagggaactctgaccactcctgttgtctacctagagagcacgccacttgggccacctacccccaacctttggccaaaggagtgaaaggacctggaacctgtcgtcaacctcagcatcctcatgaccccaggacagacgcagtggaggcagcaggtactctgggcctgtgctgttgcccctgaggtgtctcctgactacgcaaccctgtttccttcccactttcatcccagcaggccctttcttcctgctgacaaaacactggctccctcatgttcttggcacagcagaagtgttctgcacatggtctctacggaggaaagctggtccccctggcccaggcagcacttcctccgtgagcccctgcagtttcctggtgtgtgcttggggagctagggacatggtgtcaaacctccacaaggcactgctacctcagaaagggggaggacctgtcaggcccaggacagcctccctgcacatggagatcaaatctaaacttaggtcaagacccctaccttctccagggatgccaggaccagagaagggcagaggtcaggagggggcatgaggaggccaagtctggggcagcctcctcagaggcaaatctacactgcagccaatccccctccagagaagcccttggaatctcccaggccatttcactacaaacttatgtttgaatcctttattagaaaccatgcaaactttaatacaaaaaatacaagtgcaataagaatctttgtgtcaatacagttcccgggatttctcctcactgcagccatcccaaggcctagctgggatgccctctgtgggccttgcctctcctccctcccctctccagtcagggcataagggaagcagatagccttagtctcatgccttttatttttaaatttccagacctgatttcctactatctgcatgaggctcccttggacatgagggcttacatgtcctagggtgtgggtgccggcctgaaggaattccatctcctggccctttcttgttctccagccctggctttttatcctagggctgaccaccagatcccagggaatgggacagagatgccaaaaccagcctcttggttagaaaagaaaagcagcatacacacaacaaaatggcaaaaccaaccagtccacgctccaagggccccttgtgtgcctgaccggctcaccagccacagcctctgcacccctcttccctgccgcaccgcctccagggccctaagctgcccacatcctccagcgggggtggcataaggatatctccgccctgttccctctaacacttactgaggactttcatgtagacatggcttcaacctgcagaactattttgccagtttttaggttattagaaaaaaataaaaggacaaaacaagaaaaatgtgacagcagctaggcgggtatgttaagcatggggacaggcagcactgacccccaacttggggcagggcagcaagaagggcccgacaccacctgcatggggaggggggggcgcccatttgtgggaccagagggagaggcagtggcttaagctccacggtcagcgtcctgtcaccactcggaatccacctccactcttccctccaggtagatccagggagaagggagggcatgtcagtttcttttgggtttggaccaaagaaccaaaaaaagatgaggatagaatctggttctcctctcctagatcccaacttagcctcaaccaccccaaccccctcccaacctcctccacggagcagtggcgcagtgatggggcaagaccaaagcagggagatgggcccaggctggggagtgagaggaggtgtggggcagggctgctgctgccccgggcacgcaaagcaggagggaaggcgagcctagcgggctgcccagcacggcgcccaagcgctcactggtctagtggacagcccgggaaagggggccaaggacccgggagcccgagttggggccgccagggaagtgtggggggcgggagacaatgtcggccccgtggtcggtgcgggccctggcatttgcccggaacgtcagcctgtaggtctcaatctgcagtgacatgggaggagggaagggagaggggaacaggggagacaagaggggaacacgggggagacggaagacgagaccagaatgtcatcattagatgcctggaaaataaaaggttacttcattaaaatttaggccacactctagtcaaaaacaaaggagtttcaatttgcggccagtggcagggcccctggctggcccttaggccgagcccagccacttacttgtctcctggatctggctgtccaaggtctgggcctccctttggtcaccaccccctgacagggtggggtggccattgaggccactggctgaagtgggggcgccagcttcaggcgctgcctcagagatggccggctcctccccagcagggggacccggacacagaggagcctcgctgccaccgccctcagtctacaatgaaacagtgggggagacagtgcagggtcagtcgagggggggagtgggatggggtgatggtggtgggtttcacacacagcccccacccttgctgccctggcacccactggctcaaggcacagtcgcttggagaatcccaggcaggtgccccggccccacccaccccacctcacctgggagaccgactcccgagggtcaggagcagctggaccagtgacacactctcagagcccctctgtggcatgtgaggctctgatgaagcctctctgagggcagaggtgccaggcctcaggctggtaccaaagacgtagccatgacaacagtaagcaataagcctgaagggtagccccctgaagggtacagcccaccctcccaaaccctccctgaacccaggccaccccctgcacacagagtggggtcctcagtagctcccgggcagccctgcctgcacatctgtctggtcaggaacacaggtgctgaggccttgtctgtgcggggcaccattctgggaccaggggtccatgggaggcagaaaggtgtccaaggaggtataacccagggacactgtggaggcctggagggcgtcataggaggaggacatttgggggacatggaacactcagtgtgaggaaggcagagaagagagaacagctgcgagaggccactggggagctggaaagcgtgtgtcgccaaatacccaaaaagtgacaagggagaagtggtttctaatcggcatagtgagaaataggcctcgattaaaaacaataattccagaactaataaagggatataatgtgaacaaggaaaagaacacaaggcttagggtcagaaaagcccagatgtgaatcctggtccacgctcgctcgctgtgtccttggaaaagagactaaagccaagttaacgccccactgagacgggcgtgagaacggcatcctcacgaggtatggggggcacgaactgagagcctgtggcagcaaggacccccccagatgttcctggaagctgatcaaggcttcagtcagagcatcaggagaggatgggacaggggacgggctgggcagtggctggcactggggagcagagatggaagggaaggcccagggcagcggctcctggcccctctcccctgcgcacctgaacccgagcagcagcagccatccttgtgctcggggtctgcaagatgcccctcatgggccccccacccacggatgacatggaacataggacagacagcatcttggcacacaaaaggtctcacagtactgtggaaggaggaagggaggaaagaggagagagggaagggagaagaggcccagccagtcgtgaggatgggaacctctgccacttgagctctgtcccagagccctgcagagggaggccccaggcaggccctgcagagggaggccccaggcaggccctgcagagggaggccccaggcagcctgctgtcgctggcagctaagaatgtgctgtcctgctcctaacccaggagcggagcctgacatggggcgggaacccacattccccttggcgcgagacagctggggagaactgtgtggtgcagaacccccgctcgcctgggggtggtctgtgtcccagtccgtggccttctcaaatggctggatgggctcaattaggaaggccatggctctcaggagcaaggttctgcctccagctgacaggtgaggggtggctgggctggggcctcttcacttctgcctcagtcaggactgatgatacacggtgggaaaacggcaatggtgtgggtgaagacatgactcctgaagagactgaggggcggtgacaggtgcctacctgtgaggaccctgaccctaactgcatagttcccacccctccccagctgtgtctccccagtgacccactcgctaccttcacagcacctcctgcaggtaggtggcccacattatcgagggatcccaccttggcctgggccttctccttgaagttcaacttctgactttcaatcttgacatctcctccacctggaaccacaaaggaactggtcacctagggtggcagaggaatatccctgcaggcaaaaccaggactagcgatatgcccaatctagaaatgagacagacgtgacctgttctgggtggcaaatgaagaacagtgaacacgtttgtctaaagaggacttctcatatcacagtgaggctgagacaatctctccgtccagccagtgggaatacctccaagaaaaggaaagccatcccttccaccaccccatgccacagccactgagctgcaggccaggcttgggcaggcctggggctccgagcacagcctccagggcgaagcctctgcttctctactctgtgtgggaatgccctcccgctaactgggccatgcagtgcttctcaggcacagcctcactgaattctcatgaatgccctgtcatcacggccacggtccctgcttcccagccggtaaaactgatgctgcaaaagagaagggactcacccagagttaccaccaatctgctgattgacagtgacaggttgtgaaaattgtctgagaccctaaaccgtaccacactctagcaaaaagaaggaataataaaaaggacagagtggccccgaggctgtgcgctgaggaaggaaagacatggaccaaggcaggcctgggatctagtgacctcaggctaggacggggagggaaagtggtctgaactcacgcccagggttcagagctcactggccagagtgtgcccatgagaccaaggggaagggtgcgggacgagctgccctcaatgagtacccagcccctcccgcgcccagcagcgtggtttcccttgggccccttctcctgttcttccatctcctctcagctcacatggcagacctccacgcacagcttctggccgaggtctcccggtgtcccatattgggaaacccagccctggcaaaaactagaccctaagtgactcagtgtcattagagaaggaagtatctgataggagatttcccagataaaaggggaaaaaaatggttagttaaggacagaactgttttgatctttctaaatagaacacattctaaactggatcatgctcttcgctgagagggaaagggagttttttttttttctttttggagacagaatttcgctctgttgctcaggctggagtgcagtgccatactctcgcctcactgtagtctctgcctcctgggttcaagcaattctccaaaggcatgcaccaccacacctagctagtttttgtatttttagtagagacagggtttcaccatgttggccaggctgttctcaaactcctgacctcaagtgatccgcccgctttggcctcccaaagtgctgggattacaggcatgagacaccgcgcccgccctgagggaagagagttttgccttcaccttatctggcctgtggtggctagccttctgggataccaggtctgccagccagtgtgcctgctgctacagcagtcctactcacaaatctgctgtagacccaggaactaggacacgaggctgctaggggactacccaaggcaagagcccagcctccgcacagcgacttccacaggggcgctgggccaaccatgttgctggaaggaaactgcattagtgcaagttgctgaacgcctcccattctcctgccagggctagcggctgatgcttcactggttgggagcaccctttgctcctgcatctgataggtgggacctgaacactgccctctatacagctccttcagcagtagcttctgtaatcctcgtttagagccaatccaggttctcagctcagagtgcaccacttccccaggcctagctcaatagttccacacacacagtaggtactcaagagaatgcctgtgcagatggctgctgtaagaaactgctcctcctccacttagaggttagcacccgaactcctgctccctgacagaatgaggactgtggtgtcctgggtagtcttcatgggatgctaaaggcacagagatgaaacccttgccagccagctggctgcccagctgacccatggcaggacgacataccctggagacccagtgggcaagggaggcaccactcaccaggcttgtgcttgatgttagccttagacccacacttggaggagaccttagagatgtccactttcttgttctgaatctgaacctgaagagaaggacacaaaagactcattcagagagaaggtatactgtcagagccaaccccatgctaccttttaaatcttctccatgttcagggtttctcgctccctctgtaagctgctatctcagtctggtcaaagacaaggtcatctccctaagtacttaaaagagccctcgacccaccctggccctgctcttcacttccttttttttttttaaagatggagtctcgctctgttgcccaggctggagtacagtggtacgatctcagctcgctataacctccgcctcctggggtcaagcaattctcctgcctcagcctcccgagtagctgggattacaggcgtgtaccaccacatctggctaattttttgtatttttagtagagacaaggtttcaccatgttggccaggctggtctcgaactcctgacctcaggagatccacccacctcagatttccagagcccagagtgttgggattacaggcgtgagccaccacgcctggccttcactttttttttttttttttttaagacagagtttcactcttgttgcccaggctggcacgatcttggctcaccccagcctccatctcccgggttcaagtgattcttctgcctcagcctctggagtagctaggattacaggcatgcgccaccacgcccagctaattttgtatttttagtagagacagggtttctccatattggtcaggctggtctcgaactcctgacctcaggtgatccgcctgcctcaggatcccaaagtgctggaattacaggtgtgagccaccacgcccggccaccagccttcacttctaaccccacctccagccagaccaaaccaccatttccacaccccacaggtctttctgtgcagaccctgtccatgcatgctccagacagctcttctgtcatttcaccaggtccaaacaccagcaccaaggctcccatgaaatatcccctttattccatctcaaatccttacctatcaactccttgcccagagaacctggaataacatatttacttctagtccttttcaatgcattttccccttgggagaggtgagggggtggtgtgtgtgtgtgtgtgtgtgtgtgtgtgcgcgttgtgtgtgtgtgtgtgtgtgtgtgtaatcatagtattcctgcttaatccatgttataacaattttcccagccaggtgcagtgggtcatgcctgtaatcccagcactttgggaggctgaggcaggcagatcacctgtggctaggagtttgagaccagcctggccagcacagtgaaactctatctctactaaaaatgcaaaaatttgcatttaaaggtggtgcaccttggctgggcacggtggctcacgcctgtaatcccagcactttgggaggctaaggcgggcggatcacgaggtcaggagatcgagaccatcctggctaacatggtgaaaccccgtctctactaaaaatacaaaaaaaattagccgggcgtggtggcaggtgcctgtagtcccagtactcgggaggctgaggcaggagaatggcatgaactcgggaggcagagcttgcagtgagccgagatcgtgccactgcactccagcctgggcaacagaaagagactccgcctcaaaaaaaaaaggtggtgcatctttaagtctatagccatgcatgccctctgggttgctggatggggattccagcattcctgtgagcggccccgctgtcctctggtaggtactgtgggagagcctgactttccaacacatcaactccatgcagtgttgcaccattctggtgggtttcaccacaagctgttaaatggtgagctaccttcttgagccctgttttcccttctttggtgtcaggaaatatagtcttcaccatgtttccagaggacagatataatgccaccagtatttttgtatttgcacccacagcccaaggcctggcacagaataactacccacaatccccagcttgccagagccattctcaatctttcctctaaaacttggctcatgcctaacccagcaaacccattatgttttcttccccatccttcaatgcccagctcaaaaggtgccttccatacggcctcacatagctctcgcttcaatccgtctctttctcatatcatctcttgaagggacaccaccaggaactataccataatggcttcacgtgtttgataattacatacagagtagttactactgtgaaaacacacagcctctactttgtctcatctttccaaaaagtctgcaattttccctagatagaaatttttttcttttctcctcaatctatagttcattatacagatatttataggcatctccaaaatggaagtttaggatacagcacagatacctcctcctaagtatgtgctgatgacaccactgtaagtgctttatctgggtttaaaacaaggtatcttgttatttgttaggggaagaaatggccaattcaagaagagggagacatgaagacctcatccaaacatctccctatccttatcccccataagagagggcatagggaagggtacttttaccagccaaagatctggtagctgcttaaaccaacccaacatgggtcttcaagcaatggtgacaagctcatcttagctgtaaccacaacagcacctgcaagaagttaacagtcactctccaagcccagggccctcaccaagatgtagagccacagatttctttcttgttttcttttgagacagggtctcactctgccacccaggatgaagtgcagaggcatgaccttagctcactgtagcctcaacctcccaggctcaagcccctcaagtggctgagactacaggcgcacaccaccatgcccagctaatttttgcatttttttgtagagaaggggtttcgccaagtggcccaggctggtctcgaatttctgggctgaagcaacccacttgccttggcctcccaaagtgcttggattacaagtgtgagccactgcatcggccagggccacagatttctagacagtgttccatatttgaagcctctatctcttgaccttttgtctagtatgcaattaaagaatagttgaggggcagtcagtttcacattatggatgtattccagctggtaaatgaagaagtaatgctagaattagtcttaccacggcatatgcctactgaacccacaggtccaggaattgccaacatcacaaaaaaagagacaaccgaagaatgagacatgaatgtaatttctcacagaataaacctcattacctacttacatgtcatgctagcatgtggggaaaaaaccaaaaccaaataaatttaaagaaaattgagggacaacagaatatgttaattaaaaccatgaggatgtaattagaagaatccagattctaggacaaaccactgagcttacccatcaaggaaattaccagtaaaaaaaagaatgagccaggcacagtggctcacacctgtaatcccagcactttgggagggctgacgcgggtggatcatttgaggtcaggagttcgagaacagcctggccaacacagtgagaccctgtctctactaaaaaatacaaaagttaggctgggcgcagtggctcatgcctgtaatcccagcactttgggaggctgaggtgggtggatcacctgaggtcaggagttcaagaccagcctgaccaatatggtaaaaccccatctctacaaaaaatacaaaaattagctgggtgtggtggtgggcactgtagtcccagttactcgggaggctgagacagaattcttgaacccaggaggcagaggctgcaatgagccgagatcgtgccattgcactccaccctgggtgacaaaacgagactccgtcttttttttttttttttttgagaccaaatctcactttgtcgccaggctggagtccaatggcatgatttcaactcactgcaacctccgactgcctggttcaagcgattctcctgcctcagctttccaagtagctgggattataggcacgcaccaccacgcccagctgatttttgtatttttagtagagccggggtttcactgtgttggccaggatggtctagaactcctgaccttgtgacccacctgcctcagcctcccaaagtgctgggattacaggtgtgagccaccacgcccagccaagactctgtctttaaaacaacaacaacaacaacaacaacaagaacaagaacccaaaagttagcagggcatggtggtgcacgcctgtaatcctggctactcaggaggctgaggcaggagaattgattgagcccagaaggcggaggttgcagtgagccaaaatcacgccactgcactccagcctgggccacagagtgagactttgtctcaaaaacaaaacaaaacaaaacaaaaaaagctgctggctcacacctgtaatcctagcactttgggaggccgaggtgggtggatcacaaggtcaggagatcgagaccatcctggctaacacggtgaaaccccatctctgctaaaaatacaaaaaattagccgggcgtggcggcgggtgcctgtagtcccagctactcaggaggctgagacaggagaatcacttgaattcgggaggcggaggtttcagtgagccgagatcgcgccactgcactccagtctgggtgacagagcgagactctgtctccaaaaaaaaaaaaaaaaaaacctaggtagcccacaccatgaaacagatgtagtttctgacataagagtcctatgttaggaatatatcctagagaaataacttgaaatgttaaagctatttatacaaaaatatgattttaaatgtgttatagtttcatgcctgagggacagagcgagactgtgtctcaaaaaaaaaaaaaaaaaaaaaaaaaaaaagaatggagtggggacttgtagagtaaaaacagcttaagattaaaagagttatagcttgtattatcttattagtgttactattttaaatatatggatcaattttttccttttttttttgttgagacggagtctcgctctgtcacccaggctggagtgcagtggcgtgatcttgcctcactgcaacctctgcctcccgggttcaagtgattctcctgcgtcagcctcctgagtagctggtactacaggcacgtgccaccacgcccagctgattttttgtatttttagtagagatggggtttcaccgtgttagccaggatggtctcgatctcctgacctcatgatccgcctgcctcagcctcccaaattgctgggattacaggtgtgagccaccgcgcccagctatatgctgaagtattaacaaataaataatatatctaggactggcttcaaaatacttgggataggcatatacagataaaccaagactgctcatgtagatagtaaatgaggcagggtaaaaggtacatcaggttcattttactgtttttttctacttgtctgtgtttgaaaattcccacaataaaaagttgttttttttttttttggtttttgttttttgagacggagtttcgctcttgttgcccaggctggagtgcaatggcacaatctcggctcaccataacctccgcctcccaggatcaagcgattctcttgcttcagcctccagagtagctgggattataggcatgcaccactaggcctggctaattttgtacttttaatagagacggggtttctccatgttggtcaggctggtcttgaactcccgacctcaggtgatctgcctgccttggcttcccacagtgctgggattacaggcatgagccgctgtgcccagcccagtaaaaagttttaaaaagcttaactgagcctcactcactttaataaagtccaccacctctaggctacagctctccctccttaggtggctatgtggaggagtctacaatctgcttccaaacgattcccccacaccaccctgcctccactctatgctccagcctcagggaaccatgtgcggcgcctccttcatgggctggcccaagtgtcccctcctcggggactgcagaagccacgctggctctctgtggtcctaggagcaatcacggcatcacacaccttgctctgcttgtgcttacacaggctgcctgccgctctatgagagcctgcaggcacactccaggtaccaaaacatgctgtcagcaggtctcagtgcccactacacatgcacagccccttgcaagggtgaaatggaaccaaaacggacacaaaatcttaactgggaccagccacagaagaagccactacattggcactggctcatcactcccctccctcccctccgctggtgtcctcctggctctcatcaaggggtatgtctgtctgtctgtcgggggcatttttggagcactaactaggatcctgtttggagcctctcatccctgtggtaactgcgttatttctgtgtgtgtgtgtgtgggtgtgggtgtgtgtgtgtgtgtggggagtggtggggggtgtaatgctgttctgtctgcacagcaggtcctcctcccttttttttcagtgtctctctctgtcacccaggctgaagtgtggtggtgccatcacggctcattgcagtctcaactacccaggctcaaggaatcctcccctctcagcctcctgagaagctggaaccacaggcacatgccacctaatgctgccaggcacatgtctaatttaaaattgctttgaaacccaggctggtttcgaagcaatcctcctgcctgggcctcccagggccactgtacctggccttattttaaaagatattttttttgggactgggcgcagtagctcttgctataatcccagcactttgggaggccaaggtgggtggatcacctgaggtcaggagttcgagaccagcctgcccaatatagcaaaaccccgtctctactaaaagtacaaaaattagcccaggtgcggtggctcatgcctgtaatcccagcactttgggaggccgaggcgggcggatcatgaggtcaggagatggagaccattctggctaacatggtgaaaccccgtctctactaaaaaatataaaaaattagctgggcattgtggcgggcgcctgtagtcccagctactcgggaggctgaagcaggagaatagcatcaatccgggaggcggagcttgcagtgagccgagatcgcaccactgcactccagccttggtgacagatcgagactccgtctcaaaaataaaataataacataacataacataaaatacaaaaattagctaggcatggtggcaggtgcctgtaatcccagctactcgggaagctgacgaaggagaatcgcttgaacctgggaggcagaggttgcagtgagccgagattacgccactgcactccaggctgggcgacagagcaagacttttttttgtagagacgggggtcttactatggtgcccagctggggggctcatcattttaaactgcacatttccttgtggtggctttagggagggactgacagagattatggaaggaaacaaagcacctgggtccagctgtggtcagctgttgtttatcctcatcttcccaccaggaaagatggctcacagtagtctccctaattctctgtttaaggaagcctcctaaagtgaaaaggctttaaaaatacattcaccctcaaaacaacaaaacaaaacaaaaaaccctacacatgtgaggtcatgtgtaggcagtgtggaaagatcacagcaggtgatacattaatgatgactattttcagagctcttatatgcaccacacaacacacacaaatatatctctatgtctcacctacacaagtgacccagttccctcagaacccctgttcaccttctgttttcatccaggacaaagccaggctcagcagctgcctgggcccctcgtgggctggatctttgtcacctcacttcagctgatcctattccaggctgactaattagtctggtcaagcaattccacccgagtgtaaaggatgccatttctacccaggccaggaagaggcagtggtgagaagatgaccaggaaggaggggcaggaaggagttgtgtggggcaagaatgaaagctcatggccgcattcctcatgatacaactgctgggggtatctgtaggccatgggcaggatgtcatgatcaccaaggaggaggcaggagtgttaacagagtctaaaaatgataagggtaagtggagcaggacctagtccggttcaggacagtaaggagaaagaaccgaatgaactcaaaagaaacggaggcaagacaggctgtctcacttggcctggaagggagcggtgagggcaggggctgtacatggcggcttctggtgcctctggcacaactccacagagtaccacttttctaggcactgtcacagtgacaagcggaaagcacacagggtgttcttcacacactcgacgatagtaagacttcgccctgtctctccctagaccagaacctccctgtgagctgggatcacctgtgtccctaatacacatcatagagctggcacacaatggcagcaagacaaaaagaaggatgtttgggtggaagaggaaagaggacaaaaagataaggagggaaagtctgggcgcagtggctcacacctgtaatcccagcactttgggaggccaaggcgggcagatcacaaggtcaggagttcaaggccagcctggccagcatgatgaaaccccgtctctactaaaaatacaaaaattagctgggcgtggtggcgcatgcctgtagccccagctacttgggaggctgaggcaggagaattgactgaccctggtaggtggaggttgcagtgagctgagatcacaccactgcacgccagcctgggcaacagagtgaactctgtatcaaaacaaaaacaaaacaaacaaacaaacaaacaaacaaacaaaaaaacaggaaaagggactaaaaaaggaggggaagaaaaaggaggaagggattagaaaatggacaaaaaaaaggagagcagaaagggaaatgggagggccgggcgcagtgtttcatgcctgtaatcccagcactttggcaggccaaagtgggtggatcatgaggtcaggagttcaagaccagcctggccaacatagtgaaatcccgtctctactaaaaatacaaaaattagccgggcatggtggcgagtacctgcagtcccggctactcgggaggctgaggcaggagaatagcttgaacctgggaggtggtggttgcagtgagctgagatcacaccactgcactctagcttgggcaacaaagtgagacttcatctcaaaaaaacgtggggaagggataggaagaaaatgttgattaattcttattttataataacaaggattcaaagatgagctctggaaagatccatccagacatctgtctcagagaagttacttccacggtaattcaagggcatgcagaccgacatacacatcccaggaacggactccagacaggcaacaggtctgctgctgaccactgtgctcagacccaggctctgacatagctggagaaaaatccaaagcctcccacccatatgggtaaaaagatactgagtggatatcaccatgctggtgtttaggggctcaccagaaacaccctgtctaacatgggagcatcaaggtcccctcactttgctagtctgcttcttacagaacgctacagctcaggtcactgggattctatctacatgggcacctggctctctccctagtataccccacagtgggctatatctcagatgccagctaaccagagcttatacttacattaccacctccagggacatgcttaatattgtccttggaaccacacttggactgaatatggctgtagctcacttttttggagactatctggacctggagtgttagaaaatagaaaaaacaacacaaagggagaggactggttagaaccgacacagggaaggcagtgagtccacacgtgatcacaatgaccaacaaaaagtgttgttaaacctccacccccaccttctacagaacagatgtggaaaagcacaggaaaagaaatgtgaaagagcaagaaggggagtgaaaaacgtgaacagacaacacaacgacaggagcagagctgcgcaggcactgcatgttggtcatcaccgctcctttgggggcggggttgtggttcacaaggcccaggcagcagcctaacctgatgcccaaccaggcacagccctacctccttgctctgctccctcctcaagagctgggcacagtgtccttggctcttctctgcaagtcttatcatgtggacctgttctcacccaaagagggtgcttcccttaaatctgggccctggaatggctgcagccagacccactctcagaagcaaaggctgctctgagaagcactgggcagctggcaacaagggcacggatgatactaacaggaaggaggggccagtgctcagatgtgcatacaaatggatacagaatctccaacaccaggggagcggctacagcctccacacttagcccatttgtctcagggctcgagaaggcatagtatttttgactcaagggtaaaataccttcttgaatcctccatatgcctaatcctctgccctgtgagatgcccatgcggaaagaacaggctctaagcagggcagcaaggacgcccaatcctgggggcacaaccacactgtatagtacgggaatggcttcccctggaactgagaaacaccaaggccctggctctaagagtctggaacaaagaatcctaggaccttctcaagaaggaatagttgccaacttcctttctttgcaaatgatgcaggtcccaggctgaagagttctccacagagtacagaaatcctgagaaactccaacccatatacctcattgtacctactcatttctagcctttttcacaactttgatggtaaccaagtggttagcaaactacttaatgagccttggtctgaacctaggacctctagtagtcacccagaagccacggtgcagctttcttcactgtaggaatgccctaggctgagacttcccatgctggtccctaagggctggagtgcgggcttctctggcagaggcacacctacctgctacagctaaggaaggtaggtgttgcaagcactcaggaggggcctggtttccaggtttacagaggcaaggggaaagaacctgtggtttcagcttacctctgccctccagttgatgctgcatacctatactaagtgggtttccattgggaatgagcatcctaactttcagttaagaggtgacccggggaaccaggacaaatgaagttatctccatacccagcagcgttatgagagggatcttctacttcaaggtaaagcacaggggctccagggttccaggtggtggaaattacccctgccatgtcttcttgataacgaatgtgggtgcactgtatttgcatccataccaggtaggtttcacatcaaggtcagtgtgaaggaaatgaatgaaagtctttggatccattttatccagccaaaaattatacacatatgtattctccaaagggctaatgggctcccaactctattaactttcaaggttaatacaaaaaattttctgatggccgagtcatcaagcacagagaagggaatataggggagaagaagtagaaactagttagggaaagggaaaaagtgcaagagagggcatgtggctcaggctggaagaagtattttaccatcttcaccttgcagaggtgggtctaaataaaactcactttccccgcaggttgtttctgtgcacttgcaattgggccggctgttttagtgactgcattagattcaggctttcgggttgtagcagctgcctctgtttttttctctactttggcctggatggagataaagggagggcaaatttcaaaccaagaggataagagctcaaaagccaagaagggaagaaggctgtaggggactcaaatccaggtcaggccaccaggcaaaagcaggtggcctttgatcctaggcaaaaccatacatttcccagggtagaccaagtcaaagatccttgagtagaggaccacaaaagaaggagctgcaggccatagtcttaagacatgaggaacagatcaagacactagctaatgaagaaaaggcacaaaggaaggctaagacaaccaaattagtgattctgagagtgtgctggggcatgattttccaattacaataccccccaccccatgccaaatgtcctgatatgccccaagcagctgccacggtcacaggaagtcaatactgatagaaagtgtcagactctttaggtatgttgaagcagaaaacaattcactagatcaagtcactcaactccccacccaagaactcctgtaacttttgcaccatgaaaccataagagcaaagacggggagataggccatcagcagcacagcccagaggcctgctgggcacaccagagccactgtcgctaccacaagcaactctcaggctcttctctagactgatctcagcttgccatcagtgtcttccaacagcaccaggattccacctcatttttgtccctcctgaatttcttaacagctccagattaagcaatttaagtatgctgccctggatggtggtggtggtgtagagctagtgaatgacctaggagatgagatggtcactactccagggacccgaacattctcagacggactttcatcaccaccttttcacgcagagttcccatggttaccaacagttaaataattctgggactgatgcaaccagaaaatcttaaccaccggaaaatcctaaaagtgaagcactgtgatctttctccatcactatatgcagtgcagtcctgctgtttaggaaggccagaggctcacagcacgactcatcctggccataagaggacaccctagtcctctttcagatatattccactcaagtcatgggttgtggaagtaagaggtgttctaccttctgcctatcctgacattctctgtgcaggctaagaaccatgaaaaactaggctcatgtcaagtgtctctctcacttgcagagtctctgaggcctcctctgtttcttctacaaaagaatccttttacatccaagcaaaaatgtaaactcagaccccaacatctagaacaggagcctttcttactgagacaggaagagaaagcccagagctcagcctaccccgcctccctgctgctggggcacaaaacccactacagagccccggctgaaataccctgatgctgagtccagtgtcctgactgcctgcttctttggtgggcctgggaacagtgggtggaaatggaggggaagatgcaggggccagcatgccaggaccccaagctccctggacccacccggcctcctccaggctgatgcttgatgttttccgtggagccaaccttggagcggacattcttcagatcaggagcagaagtattggtggccaggcggctgagccggggggtggtggagctgggtttggccgaggtgggcttcttgtctatgaaaggagttgtggagggccgggagggcatgggtgtggccttgactcggctgggaaccacccctgcagcgggggctgtcccactgagagtggtggttttcttcatggaactggtggaggtgctctttgggcgactcaagtcagctgcaaagaagggagtgagagataacacgggttcagggagagagagaaaaagggagacttaagccacagaggaggtgggggttcaagttagggctctacaaaatggcggatgggctattacctggtacagactttgcagtcatcttcttgacttctgcaggttttccctcagtcttaatggctgtacaaaatatacttattaatataacatttaacaaactgacctgttggatagttcatccaatagtgagattcctcattatttaacaattactgaatatctactttgagccagggactgtgttagtccctgggaatggagtggtaaattagatggtcaggcactgagtcttattcttctctactgccctgataagccttctatgtggccttaaaagtaggctgtcaatacatgcctatggacttgaatagccctcttcttatcatcatgtaagcccatgagcaccacgccctcttcttatcatcatgtaagcccatgagcaccacgtgctaggtgctgtgggttactaaggcaagagtaaattctacctggaaattcatgagcagtacatttttctgccttcactcaagatttttctgaatacatacaactgctaagctcacacagagatcaaggcttgttaagtaccaggcccacagggctaccactgttccaggtagtccactaaggaccggtgcgtaagcaggcctgcacagctgtttgtgatactagctagagctatggctggggcaaagccaagatcccattttcccctccctagttcccatgggagagaaaggcaatactcaccagtgggcttcttgggcaggagcgtggaggggctcctactgcttgggccagttgaggcaacagcagcagctgttgtggtttttgcaacagtctgagtgctcttggacccagatctggaggctggggcagaagctggcttggatggtgaggcccgcttctcaggagcctttgcatctgcaatgggctggaaataggaaagtgggaatgaggcctgcaggtcagcaatagccccaaggagtcacgctacaagatgcttctttttttgtttgttttgttttgtttttggagacgaagtctcactctgttgcccaggctggagtgcagtggcatgatctcggctcactgcagcctccgcctcccaggttcaagcaattctcctgactcagcctccagagtagctgggactacaggcacgtgccaccacgcccagctaattttttgtatttttagtagagacagggtttcaccgtgttagccaggatgatctcgatctcctgacctcatgatccgcctgcctcagcctcccaaagtgctgggattacaggcatgagccactgcacctggacacaagatgtgtctatacaaccatgtattggagaacaggaggtactgtgggttcagcagctactgacaggaaaatacatatggttctaagagcaaagtcctccacataaagcaacaaactggccatgcagggtgctatgtgatctgagggcacacaacagagagtaaaactacttcaatccaacttgagccagtgagaatgaacagccctgatgggtacatcaccacaacctacgtttgcctccaaatctactgctatatatatcatacacacacacacacgcatatattttaatgtaacctctgtagaaatgccaaaaatactaatgtatttaatgtaataaaatctaatgtattatacttgaccaaagattaaacatacacaaacaaaaactaaaaattatgttcaaatcgagccattcttttggctaacacgcacctagagaatgctgaacaggactgagctgcagatggagaggccactggccaaatctgggacagaagcgtgagctgtagccctactccagcaaatcactgagcctctgagctttatttcctcatcgggataaagagattagaatggagggtgatgaaggaccagctttgataatatgtgatgtcaggaaataaaggatgaaaggtctcagcacagagacgatgagaagaggcaggcctgatcaacagaagggataaaaagcactgatatcacagctacagtctgaaagcaaaagggaaaaagtctctcaagtatagatgcttggcatctgggtcactctagttccttttacatggaggctgagaatgacgtctctagtgaataagggaaagaatcagtttagcctggtttctacggggataggggatgaagacactattttgataaacaaattaccacattacaaaagagagtatgccaaatcacagacacagtgggctcagctctcttcctccaagagaagtggctataaagagggcagtatgtaggtagcgacaagcaggatatcgttaaatggaaaaatcagctaaggaggtactagaaattaagggctggcatccaaagtctaactctgcaaatgtagggtaatgacaatttccacaaataaaggccttaagtatggtgtgaagaacgctaaggctggaatcagggaaagtggttctgctaccagctctgctggaaacatgtaggattttggccagaggattcccttttctattgctctaaaatttgaggactaaaccagatgctctctgggatgtgcatcaaatttttaagactatgactattattcagaataatctagcatagtcttattattttgccatgagggtaataatgataaaataagttagaaaaaagttatgtgggatagaaatctcaaaaggatgttgcatcttttagatgtcaggctcttggcttcaaaaacctgcagaagttaactggagctattctgctgtttcccaatttacattttcttctctgccagaatcgtaatctacttattttttctgaataggtttttctctctctgtctctacaaatctttctaccaaaataagctgcagatgaagaggccactggccaaatctgggtcagaagcctgagctgcagtcctggtttggccccttaattctaagtgtgctatttggcaaatcgctgggcctctctgagctttatttcctcatctggataaaagagattagaacaggactggcgcggtggctcatgcctgtaatcccagcactttgggaggccgaggcaggcggatcacctgaggtcaggagttcgagaccagcctggccaatgtggtgaatccccagctctactaaaaatacaaaaaattagccaggcgtggtggcgggtgcctgtaatcccagctactcgggaggctgaggcacaagagatgcttgaacctgggaggtggaggttgcaatgagcccagattgtgccactgcactccagcctgggtgacagagcgaggctccatctcaaaaaaataaaaattaaaaaaaagttcatgtatatacagcaactagtacactacacttcatttatatgattattatagagtgaaatttcactagacacctctccttcctactctcctctgtcaccccccagaagccgctgctgaataagcaacagggaggacctgctgccagggctccaggcacctcccctctgccctcttattcaaacctattgttttctaaagatcaagaaaagcaaccaactggataaatgaggatcagagagaaagctttacaagattttatcattactagtttatgagaggatttttcagtttcttggccagggcttcagcctagacttcaactcctaggttccacagttttcttcaccatattaaattaaaaactgacattttaacatgggaaactatttcgtaccatgaatttaaagagtactatcaggctgacctaaaggcccttctcaaataacacaagatgttaaggaatgcagccacagcctccactatcctctcctcctggagcaattctgtaacactaatgctgctccaaatgtgaccagtttctgggcaatacagaaaccgtgggtgacctggaaaactggatgacttcagaagtagctcagtgagaggtggcctaatgcccaaagcaaagtaagttatcacatcatgctggaacatgctgagataagctggaagaactagttatatcacaatagtaatggataaaacttctgcaggatgataacagggaaagacaaagaattacatttgatgtgggaattataccaaaaaagaatatctaactggtatgtggagtagaggaaactggttaataagtgcttaaataggtaaagagtaggtagctgagagaaaggaggaagaacctaagtagatagagtattacctccaaacagggaagggaaaggtaagagcataaaagggcttcaaaatgttaatgtctgcatcaatgggccccaaattgatttccttttcttttttctttttttggctgctcctcgtggagcagggctaacccataggcagcgcgtccagagtagccatgccaattttcaaatcaccctctcccccatttcccttgccttttcccaattccaccagcctgattctgttgtctgttagcaacaaggatctgtctatctgacactcagaggggaacaattttcctcggcacagtagttaggtgaccacttacctttggcttcacgtcttttgaaggtaagatggaaggcctggcagaggcgacggcagggcgtttgggtggggcagctggcactaagcctgaagcaaggctcatgggttttttattcaacccaccaatggtggtgggagctggctgcttagggagagaagtgggctgtgttttggctttcgatgttgaagtctttgcaggttgagtggtggccaaaggctttaggttgattgttgtttattttttatttttattttttaaagggcaacatcaaacagacaagaataaaaacaaattaaaaaaagtataaattgcacaattcaaagtaaaattataagcaatgaggatagatgcaacttaaaattagcatttctttcttctgagctcaataaataatggaatgaaaccaggatagagaaagaaaatggggaatagtttctttttctttttctttctttttttttttttttgagatggagtctctctctgtcgcccaggctggagtgcagtggcgatctcggctcactgcaagctctgcctcccaggttcaagcgattctcctgcctcagcctcccaagtagctgggactaccagcgtgtgccaccacacccagctaattttttgtatttttaataaagacggggtttcaccgttttagccaggatggcctcgatctcctgaccttgtgatctgcccgcctcggcctcccaaggtgctgggattacaggcgtgagccaccgcgcctggcctgggaatagtttcttaatgatagtggcacaaattctggcagtttggcacctgaagatttaattcagtaaaacaattaactcttaataattaactaacttttggtggctattctaaaagaaaagcatcaggaggtgattcagccattattacctgtattttttttaataactttttaattttttgaagaccctggacaacatgctgaaactacctgtatcttgatgggacaatagcagccacagcctacagtgtggcttttgaactttgcaataagtactagttatgcatctgaagctatatgatccaccttcaaaatctgcattctcttttcatgaatggatatttcagaatctttttttttctttcatctaacgctgagataatagtaaataattcagaatttatttcagaatatttttgcaattgtcctttttgttgttgttaagggaagttgaaacaatctctacagaacttttttttttttttttgagatggagcccagtgcagtggcatgatctcggctcaccgcaacctccaactccttggttcaagcaatcctcctgcctcagcctcctgagtagctgggattacaggcatgcatcaccacgcccagttaattttagtatttttagtagagatgggatttcaccatgttggtcaggatggtctccatctcctgatgtgatccgcccgccttggcctcccaaagtgctgagattacaggcatgagccaccatgcccggcctctacagaacattttttacagatatataagataatagggtcaaaggctgagattttaaagttggtttaggccactgtggtaaatgagaatacaagatattttctaagcatgtccaaacatgaggaaggacaataacagctcagaaaaaagaaatttcattcgtgattcaagcaataacagcagaagatactccgtttaaaaattatggcagtagaagataaccaccattctggcacctacctttgttttcttctctgggcttggtgggagctccttgttcggtggggtggtgatgtcatttcctgtcccactcaccacaggccttccttcttctggcctggctattcctaaggggagagggtgagtgggaattatgctaagcaaacattttacatgcccattttgaaaatacaaggtttagcaaagacagaccactaactagcacttcattctgaaaaaagtccacagggttgtgctgctgaaatgtggacaagcctcccaagttctcattgtgatggaggacagttttagattcctcagattcagagagcctgaccctgtggagaagcagtctaagggacacatgcacaaatgatcagtggaaaaaaatggtcctttaagtttggtttcccttccctagagaccaaagggactctgtcttccaaccactagctctccaagcaataggacaaaaacctcttctaccagtctatctttggaataaaggttgctgtgagatgggataagagccagaagatcattcaatgactccctttccttcctttccctataaagaaccactttatggaggatgtgagattaacctgatccagttctaacagtgacccagattttcaacaaggccaaggagacccatggaaccagactcagggccagaaataaagtctcctgcctaaggcaacatagcctcctctctgtggagaggttactctggatttcaataggactatacctgagagcattaaaatactgtgaaatgtataaccttgctgtgggggaaggcatttctaactggcacaaagtcaagaggccacaagagataagtttgactaaagaaaaataaaaaacttcaatgtggcaaaaaacaaaataagacaaaacactataataaaagtcaaaaggcaaatgacaaacagaaaaaatacttgaccctcataccaaagacaaagagcttattctataaattactcccacaaatcagtaactgctacaaaggccaataatccactgggaaaatgcaaaacaatatgaacagactttatagaaaagagatacaaagttttttgaaactatgaaaagatgtacaatgttaagtataagaaaaataaaaaaaccccactgaaatgccattttattttttgagacaaagtcttgatctgtcacccaggctggagtgcaatgctgcgatctcggctcactgcaacctctgtctccccattcaaacaattctcctgcctcagcctcccaagtagctagattacaagcatgcaccaccacacccagctaatttctgtatttttagtagagacagggtttcaccatgttggccaggctggtctcaaactcctgacttcaagtgatccacccacctcagcctcccaaagtgctgggattacaggcatgaaccaccatgcctggcctgaaatgccattaatattaacatattgtcaaaagtcctaaaattttaaaataactactgagaataatatagggaaatatacttggtaggtatgtgaactgtatgacccataggcagggctgcctggcagtgtcattttctgaaaattacaaggacagataaattctaatctagaaaaccaatttctagtaatttatcctagaagtgtatttacacaccagccaaatagtaaatgtgcaaggtttccaccagatcattgtttctaaaagcaaaagaacaacccagaagtccgttaatagaaaactggttattatggtagaaatatcaatgtaatctctgaatgtgaaaaaataaagcatggagaaattcttttatgattactatgcaatggtctctattaagtgaaaaaaaaaacaacaaagcataagtataatgtgaaactatttgtcttgaaaagggatgagggaaaagatattgcaaatacacttatatatgcattttaaaagaatttttgaaaggattgtaattaaacagaacaacgtttttgagggaaaggatgggacacaaaactggggaggttaggaggcttaaaactttgagaaataattacagattcataggaagttgcaaagaaatacatagggaaggtccctgtgtacccttttacccagtctccccaagtgttgatatcctacgtaaatacagtatactatcaaaaccaagaaacagagacaacccacagagcctactcagatttttcactttacatgcactcatttgtgtgtgtgtgtgtttgtgtgtgtagtgctatgcaactttatcaagtgtagctttgtgtaaccaccaccaccaccttagcctcccaaagtgctgggattacagattacctggcctggagtggctggttacaatcaatagggcttcttcatgttacccctctatagccatatctaccccatcccctttccaatccctaaatatatggcaactactatgttctccatctctatagtaacttccagtacactatatttaaaagagtggtgcaagtagatatccttgccttgttcccaatcttagatagaaagtattcacttattcaccattaaatatgatgttagctgtaggctttctgtagacgctctttgtcaagttaaataagttcctctctattcctactttgctgagagttttaacatgaatggctatttgattctgttaaacgatttttctgtgtttacaatttattttcttcagactataacagattactttttttttttgagatggagtctcactttgtcgcccaggctggagtgcagtggtgtgatctcagctcactgcaagctccgcctcctgccattctcctgcctcagcctcccaagtagctgggactacagtacccgccaccacacctggctaattttttttttttttttttttttgcatttttagtagagatggggtttcaccatgttagccaggatggtctccatctcctgacctcgtgatccacctgcctcggcctcccaaaatgttgggattacaggtgtgagccaccacacctggctgacaattacttttgattattgcactaaccttgtatacctgaaataattccaatttcagttttttttttttttttttttttaagagatgaagtctgttgcctaggctgcagtacagtggcatgatcacagctcactgccacctggaactcctgggctcaagagaccctaatgcctcagccttccaagtagctgggactactggtacgtgccaccatacctgaataatttacaaaaaaaatttttttgaagagatggaggtcttgccatgtggcccaaactgaccggtctcaagcagtcctcccacatcagcttcccaaagtgctgggattataggcacaaaccaccatgccccatcataatttcaatcttttaaattgattcaagttggttttatgacccaagatccatcttggtgagtgtttaatggacacctgagaagaatgtacattctgtcactgagtggaatttctatcaatgtttatgagattttgttgtttgatggcactgttacatctttactaacattctgtctagtagttctatcaactgttcatagtgggttacagaagtccccagctgtaattgtgactttgtgtacttctccttttagctctgtcagtttttgtttcatatatcttgatgctctgttttttggtgtgtatacatttagaattgctaagttttctaaatgtaaggatcaatcttagtgggattgatcctttattcttttctccgacatctactttgtctgatgttagtatagtcactccaggacacgtaatctttaatcccagcactttgggaggctgaggcagaggatcacttgaggccagcagtttgagactagcctgggcaacaaagtgagacttcctctctacaaaaatcgaaagaaaattagtggggcatggtggtgtatgcctataagactcagatacttgggaggctgaggtgggaagattgcttgagcccagcgagtcaagcctgctgtgagctatgatcaggccactgcactccagcctgggcaacaagaaaaaacaactatatatatatatatatatatatatatatatatatatatatatatatatatgcataatcattatatatagctactgctactttaaaaaattgttaacatgatatatttctttccatcttttaactttcaacctacctatgtccttatgtttgttatgcatttcttgtagatagcatatacttgggcaatttttttttctttttaagacaggtgtgatcatggctgactgtactcactgtagcttctacctcctcggttcaagtgatcctcctacctcagctcctgaatagctaggaccacaggcatgtgccaccatgcctggctaatttttaaattatttgtagagatggggtctccctgggttgctcaggctggtctcgaactcctaggctcaagtgatccttctgcctcagcctcctaaagggattacaagcaggagccgctgtacctggcctacttgagtcattttttaaaaataatatactcttccaatctttgtcttttaattgtagtactcagaccatttgcttctaaaataattcctgatggccaggtacagtggctcacgcctgtaatccattcagcactttgggaggccgaggtgggcttatcacctgaagtcaggagttggagatcagcctggccaacagggtgaaaccccatctctactaaaaatacataaattagccgggcgttgtggtgggcgcctgtaatcccagctacttgggaggctgaggcaggagaatcgcttgaacctgggaagtgaaggttgcagtgatctgagattgtaccactgcactccagcctgggtgacaagagtgaaactccatctcagtaaataaaaaaataaatgaaataaagtaaaataattactgctatgttaaggcttaagtctgatattttattttttatttgttctctctttttctcatttctgtttcactttcctgccttcctgttggttacctgaacatttttaatctttttaatttccttttttcattttttcaaattacatctcacccaaggttacctgaacatttcttagaattctatttttattaaaaaaaagcttttgagtatattgctctgtatagttttcttagtggttgctctaggtattacaatatacatacaacaaactggtatcaatgttctactactgttttttcctctagagatggggtctcactgtgttgctcaggctggtctcaaactctgggctcaagtgatcctgccgtcttcagcctcctgagtagctgggactacagatgcacaccgccacacccagctatgttttactactttgagtgacctactggaaccttacttccatttaggatcctttattttctccctactttaatttttttttttaaagacagagtctcactctgtcgtccaggttggagtgtagtggcacaatctcggctcactgcaacctctgcctcccaggttcaagtgattctcatgcctcagccaaccgagcagctgggattacacgtgtgcgctaccatgcttggctaatttttctttttatctttagtagagatggggtttcgtcatgttgcccaggctggtctcaaactcctggcctcaggtgatccacccaccttggtctccaaaagtggtgggattacaggtgtgagccactgcgcccagccctaaaatatgtcttaagtgtttcctcttcatagattaagcactacatcagatggcattacaatttgtgcttcaaatatgatttatgactttaaaaaattcatgaggagataagtctattatattcctttttttttggagaccaagttttgctcttgttgctcaggctggagtgcagtggcatggctcaccacgacctccacctcccgagttcaagcgattctcctgcctcagccttcctgagtagctgggattacaggtatgcgtcaccacgcccggctaattttgtatttttagtagagacgggggtttctccatgttggtcaggctggtctcgaactcccgacctcagatgatccacccgccttggcctcccaaagtgctgggattacaggcatgagccaccatacctggctatttccatatttttacccattccattgttgttcttttatttctgaaattccaagcctccttctgttaccaaatcttatttttttggagagcctcctttagccattctctaagggtatgtctactagcaacaaattcttagttttcctttatctaaaaatgtcttttttatttatttccccttcattcctgatggattgttttaccaaataatttgcagttgacagttcttttcttttggcacttgaaaaatgttgtgccacttctttttgcattccccagtttctgataagaaacaggctgtcatttaaatgctgtttcctcagcaccataaggaaggttaaaaaaaaaaattgctgtttccctaatgcatcatatctctttgctttttttacagatttttgtctttagtttataaaagtttaattatgaaaagtcatggcatgatttctccacatttatcctatttggtatttgttcagttgcttgaatctgtaagttttgtcttttgtcaaatttgggatgtttgttgtcattatttctttgaacagttgttcagccttgcatccttgctcctctcctgagattctgatgatacaaatgttagatcttttgttattgtcccatgggtctgaagatatgttttttccttgtagaccattttttcgtctgttgttcagattgaataaatcctattgatctgtcctcaacgtcactgattctgtcctctgttatctgcagtctgctgctgagcccattgaagtttttaattttaattattatatttttcatattgacaattaacatttggttctttttatgtaacttctatttctttactgaggtttttagttttcatttgtttcaagagaattcataattgcttgttaaagcacttttatgatggctgctttaaaattctgattttgtactttagcatgcaatcaccctgtttatatttagtctacaggttatgactgtagttctgatgacaatttggttcctagagcccttgcaatgcatttatggcctgttgtgttctgattctgctaaggttctaactaatcccttttggtactgcctgaaagggctgtagggacttacctgtgtcacccagtgtcagcacataggggctgagtgatgctggaaacatagaatagagagcttcctctggactgctctctggctgcctgggacccaggcagacctcctgtttgatctctgctggggttgctgggagcaggaaacacctacctcgggggctttctcttgctaaggggaaggaagtagaggttctgaaacctacgaaagtctcctgcccctgggtagaggattacaagacaccagggctatagaagccactggtgctgttacctggtaggggacaggcctccctgcagttgctggtgatgtgggcggaccaggcctatagcttctgctgagtatggagtggacaacaggaaggcccttatgggctgcattgacactgtacctgcaggcagactgagcccactgctggggatgggtagtgaaacagggctcaccattaggtctttgctgggtttttttctttcttgtttttttggcaatagagaacagattttctctatttgttttcttttttcctttccttttcttttcagtctatgcctgttggtaattccaggttacaggcctctccagtgcccagccagggatatgtaggagacaaaaagaaaacccaggggatggacgcagtggctcatgcctgtaataccagcactttgggaggtcaagcaaggaggatcacttgaggtcaagaggtcaaggctagcctgggcaacatagcaagatcccatctctaccatcaatcaatcaatcaatcaatcaatcaatcaattcatcagtcccagggaattcactgtattgccattcctcaagtcctgagatccctaccaggtttgccttctttctacctcatattcttttatggaattatcttcaattatttccagactatttagttgtatttacaggggaggagcagaaaacaatgagatgataccatcttgtcttggtaggaggtttttgtaatggagagcactttgtactttttgatgtttgaaccatatgtacttttagtcaaaaactgagtatttttctagttttaaaatgtaatggggaaaaaccatagccaacaactgtgcaaatttgttaacgcctttgttcttttttttttttttttgagacggaatctcgctctgtcacccaggctggagtgcagtggcgccatctcggctcactgcaagctccgcctcctgggttcatgccattctcctgcctcagcctcccgagtagccgggactacaggcgcctgccaccacgcccaactaattctttgcatttttagtagagttggggtttcgctgtgttagccaggatggtctcgatctcctgacctcatgatccgcccgcctcggcctcccaaagtgttgggattacgggcgtgagccaccgcgcccggctaatgcctttgttctacagcaagctcaaagaagatcttacttgtgtaactagctgccactggccccagaccactataaatatttttcaataagttcagcatttttcagtaaacaacatatttcataaagtcgcattgtctatgatacaggcatgcagtaactcgacctatacaaataaatgtaactgtgcataagcagaaactgctttctctctcccagaaggtagttctcaccaagccctttcccttgtctcatggatatataaggcaacttcttttttgttgtttgttttgagacctgatcttgatctatctcccaggctggagcacagtggcatgatcttggctcactgcagccttgtccttttgggctcgagcaatcctcccacctcagcctcccaaacagttgggactataggtacatgccactatgcccacctaatttttgtatttttccatagagatgggttttttgccatgttgctcaggctggtctcaaactcctggcctcaagtaatctgcctgccaaggcctcccaaagtgctgagattacaggcatgagccaccaagcccagctatcaggcaatttctagagaccaccacccacatatccccagagtttcacaaaagcaatgtctgatgtggaacttactaactccttcaatgaactgtgctcttctgttgggtctttccattacctatactaccactggctgggaaaaccagcctcacatcacagcatgaccttcaattcctttttctcacacaccttccaaattccagtttcactttatcttcacctgttatatttcccctctcatatcctcagcgtttcatctgccactacctgaatcaaatttctaacaggattgtttgctttcaactctttgtcttccagttcatcacacttactgagaacaagtaaatcttcctaaagctgacctggagctactttatctgctatcataggcagtcaccacagtttcagaacatggtagtgagaggtgacagcgtgctggcagtcctcagagccctcgcttgctctcggcgcctcctctgcctgggttcccactttggcggcacttgaggggccctttggcccgccgctgcactgtgggaccccctttctgggctggccaaggccagagccagctccctcagcttgcagggaggtgtggaaggagaggcgcgagcaggaaccggggctgcgcgcagcacttgcgggtcagctggagttccgggtgggcgtgggcttggtgggccccgcacttggagcagccagccagccctgctggccccgggcaatgggggacttagcacccgggccagtggctgcagagggtgtactgagtcccccagcagtgccggcccataagtgctgcgctcgatttctcactgagccttagctgctttcccgcggggcagggctcgggacctgcagcccgccatgcctcagcctcccacccctccatgggctcctgtgccgcccgagcctccctgacaagcaccaccccctgctccacggcgcccagtcccatcaaccacccaaaggctgaggaatgcgaacgcaccacggcgcaggactggcaggcagctccacctgcagccccagtgcgagatccactaggtgaacccagctgggctcctgagtctggtggggacgtggagagtctttatatctacctcagggattgtaaatacaccaatcagcaccctgtgtttagctcaaggtttgtgaatccaccaatcgacactctgtatctagctgctctggtggggccttggaaaacctttatgtctagctcagggattgtaaatacaccaatcggcactctgtatctagctcaaggtttgtaaacacaccaatcagcaccctgtgtttagctcaaggtttgtgaatgcaccaatcgacactctgtatctagctgctctggtggggccttggagaacctctgcatctagctcaaggtttgtaaacacaccaatcagcaccctgtgtttagctcaaggtttgtgagtgcaccaatcgacactctgtatctagctgctctggtggggccttggagaatctgtgtgtcgaaactctgtatctaactaatctgatggggacacggagaacctttgtatctagctcagggattgtaaacgcaccaatcagtgccctgacaaaacaggccactcggctctaccaatcagcaggatgtgggtgggcccagataagagaataaaagcaggctgcccgagccagcactggtaacccgctcgggtccccttccacactgtggaagctttgttctttcgttctttgcaataaatcttgctactgctcactctttgggtccactctgcttttatgagctgtaacactcaccgcgaagatctgcagcttcactcctgagcccagtgagaccacaaacccaccgggaggaacgaacaactccagacgcgctgccttaagagctgtaacactcactgccaaggtctgcagcttcactcctgagccagcaagaccacgaacccaccagaaggaagaaactccgaacacatctgaacatcagaagggacagactccagacgcaccaccttaagagctgtaacactcaccgcgagggtccgtggcttcattcttgaagtcagtgagaccaagaacccaccaattccagacacagtagtaagctttaaacttttcagtgggacatttgaagcttagcaagattggattccaaacaactttctagaattttctcccattatttcttgtcacatatgtaaagacggctttggaatatttccttaacctatactctctcctttagagaagcctcaaggtgaatgaagcgggtgggtctaaatggctcagattggttaagaaggctatgggacctggtatagagttgactggaccaagctgagccaataagatataattactcactcattgtcagtatagacaaagacatggaaatgacagtcatgcaacatcggaaccctgacatatatggtggtaacaaagctggccacagagctcaaaccatggcaactcaatgctattctgtcctgggcagagttacaagggaagcaaaaagagatgacagaggaaatacagatttttaaagggaagagaatggagtacatgtgcagggagaagcagaggtcccaagagagatatacacaatggcagcagcctggccacatttcctgtgactggatgccctgagattcctccattgttcttttacctaacatgagctgtctaggcttcatatctttgtttaatatgagttcccttgcctggaaggctttccctccgcattatttggcatcccagggttccaaggcccacctcaaatgtgacttcctccaaaatgtttccacaattcacaaccctcccactgcctcccagtcctccaactggatcaaaagttgcttgaggataaggataatttccagtgcctagatagtgaatgcaaatggtaggcatgttaaatgaaacaatcttcctataaaagttttatctacagagtggttagcagagtcagcatttaaacatttatcgggtgaatggatcggtggatttgtcagtcatctgaaatttttttctattagcacaaacttctgttagtctgaattagaaagaacttgttctgaaacaaagtcttcactcatgatcacctagaagttatgtggtactgaacaaagcacctggggatcaagaaaaagatgacaaagtcctgtccaggaagagcttacagttctgtcccagctagaaggaagcaacagcatgggacacctgaatgcttgtaattctggagtcataagaaatcaaagaggaactattaagcttctttgcctccataaaaaaacgtgttttttatctccataaaaaacaaaaaatgttttttatctccataaaaaaaaaaaacccaaaacatctgtatgtcttctacttaccactcccctagaaaataccatttcttactttcaaagaaaaaaagtacaatttcataaaaatatactgagagtaataaatattagagaaaacaggtcccaggaaacaagactatttttttttaaacaagcaaaacacatgttttaaatccccatttacaagtttgtgaattatggccctttgtgctcaaactggactcggagaaacacaagcttttttagaccaccacaataagagctgtggggggatgggagatggggaagaaaagaaagggccaggaagaaagacacaaaaggctgtcacaaagaccgcaaaatttagctgtttattaggttgcaagtctctccttctctccctgctttctctttcttctttttctccccacaaatcctctcaaaacacatacaaaaagagaaaactagaagcaagattgggtcaaacatgaagaacacagaaagaatattaaatagctagctttaaagggctctttttcagtttgaacaaaagtaaaacgttctccaaagcaaaaacagaaaacagagcttccacccagattgtgcaacttaatgagaggaggttagtgctgataaacccattgtgaatctatataaagtgacagattttcaagcaaggaaatcaatcagttgggattgaaggatttagagctcaggaatcatctggttcaaaccaacagggagctgagggctgggtggatgggggatgggttggacagggtgacatgaggtcaagaaagggggtctagtttttatacccaccattctctgaccccattccaccccaaacttgcacactcaattcacattatctgtcatgctagcaagacattcagcttgaccctgcaagattcactttgttctcttccttgcctcactcccagcaagcttccaacacaagggaattaagctttccccaggcagtcacagaacccagctgtaaaaagctgcttagtgctctgccggtaatctgtcactttggttccttccttgctgtctgcttgttcccaatggaggcaaaatttagaaacataccatcacgtgggggcttttcaaacaggaacgatggagtgctctgggttgcagtgacctcaatttctttcttccctgccagagccgtctgtcctggctgtttctctcctcgctggcaaacctgcgagcatgaatcaattctagtttcactaaaatcttcctgccctttttccttgctgcttccttcaggaatctgctccagcttactatggagatataatccagcagtgccgagttccttcttcccagagttgctgctgctgttgctgaagtgagccaattcttctctcttcttggccactggttcctcacagatgaaaggaggtatctctttagtagacaagatgggcagtttcccagggctcaatttgtagctagctgtctgttcctcacccacagtcatggagcgcttcatagcaggagctcccagtttcccaggtgtaggactaggcattgggctactagggggaggcagcaggccagaagaaggctcttctcgggcagggagttcagggtacttatctgcaaggttgacagctgggggaactgagaggtgagaacattcagacagggccctgcgcactgcctttttctgctggggggcttggttgagcacagcctcctcggtagaactcaatttctccaactccttatcatggtctctgatgtgacagcttgcattcaaatgttcctgggtgaacaccatagtgattggcggaatggtggtgggtgaatgctcaataatgggggctgggtgggctagagacaccaggagtggggactcacacttcagctgctcagagttatcatttaccaccccaatcactgggcagccaggggtgatgctattctccatctctcccggagttgcttcccttgagcccagagagccttgagccactggatgaaagctggggttccaaacactggtttcctgctccttaacatatctggtagggatgtcagcagccccagggaaatccagatctgactggctcttggtctctagtccattcttccctgccaccttcccctgaactggaatggttttgtttttgtctggcccctctatgagtcccagatggaactcggaggtcttctggtgtaccgagttcccctccaagggatggcaggtctctgaaatcacatacctgctctcaaggtgacctgaggcttcttgacagtccttgtcctgcatttcaatgctcagctctttgtctagcttcccctcaaaaaagcagagcttgttctgctccaggaagctggcattcttcacaagcccatcttttggttgcccgtccatgctgacattcagcccaatttcattcagtttgccctctgtcctctgccattcgaatccggcttgactgatttcttttggggagtccattcggcactctgcaggcttgcccttactgagctgaccgtacgcggcagtgagagaggctgtctgcttgtctgagagcgacatcgtctctcctccactgctctccctgctttcgctcctggagctctaataccacctacgatcacacagagcttgcagtgacatcacaccaattccccagtattcatgacaaaattcatctctccctcaatgcccctctctcctcaagcagttgagtattaaatgcacttacaaatgtgaaagaaagaaagaaaggaagaatgaatgaaagcgaaagaaaggaaggaacctgctgctttctgcacaacaaaatgctactttaatctgagaatgtaatttcccgtgaactagcactctgtttagatctgcaatttaaaacacagtatggtgccaatccaagcactaaggatagtaattattttggctttcactgatatagatacgtgcatacccacacactcatttatctgataccatgcccacccttccacattcaaccactcagaaaactgttttaaaaataaccgagactcatttgccaatccccagctataaccctgaagaacaatgaatccaggaaattgttcaaaattggactaaaaaaaaaaaaaaaaaaccacaccttaacgtagtattaagattgcaggcattcattctcagaggaagagtgggtttgctgtcatagcaacttatcaaactaacttgaaaactgacttgagtggggtccccaaaacccgtaagagctccatctgtagctctgcataatggaagagtttaataaagggttcatttaaagacttcagtgatcagggctttggggatagatattctaattataagacatttgtgtgacaacataccccttatgcatttacgcctgtccctgcccccacttggttccttggatgagctgggttgctccctccactaccaagccctgctctttccagcctaataatctgttaggtgtcatgtgaacacactgggggcagtgcatctttctctgacctccagacttagggactctaacaattgtagcttggagttttccccactcaccagagcttactgcccccatttaactcagcatggtcctttgctgccctgggctttgagctcaaatattgtatattcaaactgaaggaaccataaaacaaaactgtgagaaaaaaattacactataaggacaggctatactcttactttgaacaaagctgatttttcttgtctagctgtaagttactgtcttgcaataacatagcatactggaaatattctatcagaaatccaagagaagtctttttccaagatgaagaaaagatttagattgctttttttttttttttaaaaaaaggccatttgccataaactgcaatgatttgatgacagtttttaaacaatgcctttagaaaaaagggcaagttaagattgttctttggtctataaaatgtaaagaaattaccaaggtccgcataggaaagcttgctaaactgtagcctctgtccccaagaactcaccttctctattcataccactcaagttcccaacaagagtacagggatcaaccttatataccttttccattaccttcagtacctgacacagggctacactcatgatgatgagtggcaatgttgcaatgctgaaaaaaaaaaactgaacatgaactgagcctcatatacatttcttccccttgatcttgagctgtttagtaacaatacatgacaaagcacaatacagattaactggcaaggaacctggtttccatactctatggcaaagatcttgctaaggaaaaggaagtgaggtataacaaaatgaagaatgccaggagaatcatgattctaattagtaacaagaaaaaatatgattggccgggtgtggtggctcacgcctgtaatcccagcactttgggagcccaaggcaggtggatcacgaggtcaggagatcgagaccatcctggctaacatggtgaaaccctgtctctactaaaaaatacaaaaaattagctgggcatggtggtgggtgcctgtagtcccagctactcaggaggctgaggcaggagaatggcgtgaacccacgaggcggagcttgcagtgagctgagatcacgccactgcactccagcctgggcgacagggcaagactccgtctcaaaaaataaaaaaaaaagaaaaaatatgaggcgagattgggtacagaaaggccttggtaatacaacatagttgaattcttgctttctttttttatacatataattgaataatataattaagtatgtacaatatgtgaggaaaattatgaaagtctggagatggctgggtgccatggctcacacctgtaatcccagcactttgggaggctgaggtgggcagattgcttgagcccaggagtttgagaccagcctgggcaacatggcaaaaccctgtctctacaaagagtacaaaaatttaggtgggcatggtgatcacaattgtggtcccagctactcagaaggctgaggtgggagaattgcctgagcccagtaagtcaaggctgcagtgggccgtgatcacatcactgcactccagcctgggtgagaggaaaccctgtccaaaaaaaaaaaaaagggggtgaggaagatattgttgtaatacagtctgaatataccagaggaaaactctggaaaataccttagaaatcaggtaagcctcaacaaccccattctgtgtaaactagtcaccccccacaaacgacacacacatatacacccttaatttactgacatggtggggaaaaaattaatttgactttgagtcagaaggccagattttaaaatctgtgtcacttaatagttaagagtcttagaaactcatttaactgctcttagcttcagtttcttcctctataaaaggaggggaatctttaaggtgctcttggattcagttttaccactttcacttctgaagttgaaacagccattcaagtaatcacaggcccactgctatgtccagctcaaagtatgacttcaacctgggactccactaggcagtatcttcagtaacctttctgtctcatgcgggagtgctgcctattggcagaggcatgactgggcatggcggacgttgcagcatgtctgaagaaagtggtagttggcccttatattctgaagaagtggaaaataccaaggcaaagaacaagcatagaaacttgttccttatagccaaattatttttagttctggccagcctacccagacccacttcactagttcatccctacccaacagctaaggcaataactaaaattacaggtctctgctaccttcagatatcacatattctgcctcagtaattctatccataaacagcagactgcaaaatgtgaaccagccaaaagaccaagagcagaaaccagaagaatgaagctagtcaggcacaaagaagtgcatattccagactacagttcatactgtgtagatcagaaatgtggtcaaactgaaaaaatataattatgaggtcaacatctagcaactgggccaagcactggcttcatagttacaaggctcaggagacagagagttgaaagaagcaatctggggtgggggggcggtcagaacaagaagttcaagcccatagaaggggcgagtacccaagacatcatgtcagccaggtgctcaggcatacagataagtttggtggtcacccaggggtctgagtacaacaaaacacatagccgtgaggattgagggaatatatataaaaagcatttgacaaagtagttaaaacacacaaatacataatgtatctactgatgctagctttaaaaaaacaaccaagaaggccgggcgcggtggctcacgcctgtaatcccagctctttgggaggccgaggcgggaggatcacctgaggttgggagttcgagaccagcctgaacaacatggagaaaccccgtgtctactaaaaatacaaaattagccgggcgtggtggcacatgcctgtaatcccagctactcgggaggctgaggcaggagaatcgcttgaacccgggaggcagaggttgcagtgagtggagatcatgccattgcactccagcctgggcaacaagagcgaaactccatctccaaacaaacaaacaaaaaaacaaccaagaaactgtacatatatatatatgaagtaggttttcctactccctatagggaatctgatgtgtagtaataataacaacaacaacaacaaaagtgagaaagcctaagtccctggactggagaactgctgcactctggtaaagacagacaaaaacaaaacaaaacaaccactactactcacaagaaacaacatataaatcgtaattgcaatcactaacagataagagaaaaagaaaagctaaatttcaaaatctggggcactgcctaaggaaagtaaataacctattccctgaatcccttttaggacaagggtccattatatccatcaacagtactgcaaagacactaaagtatgtgtgacagtacagagtcagaatgctgaggcttccctaacagacccctcattttatagaggaacaaaatggtgtccagagaaaaaaagtggtttgcccatgatcacatggtgaaaacttaatggaaaagccacaaagaagatgctaggtttctgactgccagtcttcccaaaccgctgagcaaaaattaatcttagtcactagatgactctccttttcgatgtatctttatttttttgagagggggtctcgctttgttgcccaggctggagtgcagtggcatgatctcggctaactacaacctctgcctcccaggctcaagcgattctcctgcctcagcttccggagtagctgggattacaggcccacaccaccacacctgactaatttttgtatttttagtagagacagggtttcacgatgttggccaggctggtcttgaacttctgacctcaggtgatctgcccaactcggcctccccaagtgctgggattacagctgtgggcattgcgctcggcccaatgtatcttttttgtgatcattgaagtacttcaaactttaatttggaattataatttaattcttttgtgatcactccaaaactcccaaattaatacacagtatgcatacacatgtgtgtgtatgtatgtgtgtttaggggagcaaacgcgtgtttgaagtaagggagaaaaagaggcaatgcacttggtttcggtgtttactttatatcttaagaacggtcttgtttgaggccgggagtagtggctcatgcctgtaatctcagtactttgggaggtcgaggcgggcggatcacaaggtcaggagttcgagaccagcctggccaacatggtgaaaccctgtctccactaaaaaaagatacaaaaaattagctgggtgtggtggcaggtacctgtaatcccagctactcgggagtctgaggcaggagaatcgcttgaacctgggaggtggaggctgcagtgagccgagatcccaccactgcactccaggccaggcaacagagtgagactccatatcgggggggggaaaaaaaaaaaagaaagaatggtcctgctttaattatgcaaagagtaagatgtgggtgacttattccttagcaaacttctgtttctaatttccagtcttaagagaacttagatttatgttaatatctttctatggtgccttagcactgtaagtttcctttcatgtggcttctgagtaggaagacagattcagcctcactaagaaaaagcagagaaccagacgcttttacagagggggaagggacagagtagcttctagtttcattacactaggctgggcatggtggctcacccctgtaatcccagcactttgggaggcagaggcaggtggatcatgaggtcaagagatcgagaccatcctggccaacgtgatgaaaccctgtctctagtgaaaatacaaaaattagctgggcgtggtggcacgcacctgtagtcccagctacccgggaggctgaggcaggagaattgcttgaatccgggaggcagaggttgcagtgagctgagatcgcgccactgcactccagcctgccaacagggcgagactccgcctcaaaaaaaaaaaaaaaagattacactattgcttttgcaaggcatacaaagatattaaatggaagaataattaatggctttgttgcaccccaaatgaggtgaatgccacctggatgacaaatgatggggaaaccctagtatagaataattagtaaaactcaagaaagactgggcatagtagcccacgcctgtaacaccagcactttagaagggttaggtgggaggaccacttgaggccaagagttcaagagcctgggcaacatagcaggacccacatctatacaaaaaaaataagaaaaaaatgttttttagccaggtgtggtggtgcatgcccatagtactagctacttgggaggctgaagaaggaggatcacttaaacctaagagtctgaggctgcagtgagtgaactatgatcacgccactgcactccagcctgagcgacagagaccttgtttaaaaacaaaacaaaacaacccacagaacaccctgagaatggccagttcagtactccagtccaaataagaattacagacataatctcaatcagggatgcagatttatccacaggaaatagccacagcaagaaactccaatctcccagccactgtaaaattatatcaagttggtggatgaggtaaatacatgaagtttgaaaagggtgagcctgcctaggtaaaaagaaacacacttaagaaccagaaggactaagtcctagattcagctgccactgggattccttgtctctaggttcttcctccccaggagctgggattacaggtgtcccagctaatcaccacacccagctaatttttgtatttttagtatacacagggtttcactatgttggccaggctaatctggaactcctaacctcaggtgatcctcctgcctcagcctcccaaagtgctgggattacaagtgtgaaccaccgcacccggccccttgcctctaggtcctattcctactcactcacctctgcaaagtctctttgaacccctcctgagttctttatattatcataatactctatctctttttagaatttagaaaccacactgtaatcttttatttatatgactttcccaggagcttctagaaggtaggaatgtgaactgtgcatttgtgccatgtgggtgcactgcacagtgcttgactcacagtaaataagctttcaaaaaagatctgctcagtgaaaggatgggtagtttccttttacactgcatctgcatcatttgacctgatccgttccatcattaaagctgtcttcaacccaacccaagcggtggtgatctggaatgtcctttgagctaaatattgtgaagttctattccattctgtctgagtttgaagaaagcgcatggattcctgtgtgtctgggcagaaggtggtttccaggactcttggcaaagcctgcaggtctctaatcccagtacatgtactggcagatatttctgttttagccttgtgcttggagttagtatttaacctgttcagggccttggtttttatacatgacagacaactagtttctctgcattctttcttatcagttaccaaggcaacactactttccagattgaccaactgttcccagttattgcctccaggaaacaattatcattacaatgaaagtcaataattctactattaacaatgattgatgacactcactccttgttaataaaagataaagttgtcaagttataatctagtttcttccctggaagtaaacgttccaagtgtttagacatacatacataaaggtaaaactatttcagaaaccatattctacattttagaaacatttctcatgttttaactcaagaaaataaatcatgattctccctgattaaaaaaaggatgagaagcaaacagacagaatgaataagctgaggcgaataatctgatatatgtgaaccaaagacatgaaaatgcttatggataagaaatcctctaaaggccgggcatggtagctaaggcctgtaatcccagcactttgggaggctgaggcaggcgcatcacctgctggagtttgagactagcctggccaacatggtgaaaccctgtctctactaaaaatacaaaaactagctgggtgcggtggtgtgcacctgtagtcccagctacttgggaggctgaggcaggagaatcgcttgaacctgggaggtggagattacagtgagccgagatggcgccactgcactccagcctgggctacagagggagactgtctcaaaacaacaacaacaacaacaacaacaactctaaaaactacaacttggaaatatcaagtctttgttcttttaagtctagtatggaccctcccatagccctccccaaaagaaaagagaatcatccaactaaactaggtagaaagataacccatttcttcaagcaaaaatctaagatcttctgcttttagaggcacacaatacccctaggatcctttaggagcttactttcttttccccaatttcatctcaaaatgtttaacagatgtccctgtttccccaaacttgactttattccatgcacctgcacttcactatgcatgcctttacacagctgtcccctagaattctttaccttaatttgctcagcaaactcttagccatactttcagagtctcctgtgtgaagatttctctaggtcttgtaggaaaacttagtccctttctgctctgtatttccataggatctagctcacacttctatcctttttcagaggagtaaacttctcttactagaggaaaactgtctgttttccaccctggaatctctgaagagtatagaatgtgttttattagtctatttttagagtaggagtaatgtcacttggtatctactgaatgaatgaataaactaaatactaaaaagtacaaatcatgctgtgtgtccgctatttgcagagcaataggcaatgtttatacacttcaggaggccgaggtggacggatcacttgagctcaggagttcaagactaggttgtgcaacatggccaaacccagcctctacaaaaaatacaaaaattagccgggcacggaggcacgcacctgtagttccagctacttgcaactgaggtgggagtatcacctgagcccaggaggcggaggctgtagtcagctgagactgtaccactgcaccccagcctgggcaactgagcaagaccctatttaaaaaaaaaaaaaagaatggaagcccccttactgtcacctccatatcttaaagaaataactatatctgcaatactgtaaatcaaaactaagtttttattttaacagtgtgttcagaatcccccaatgctatttgtcaaccagagggtacaagtgaagggtgagggaatatgaggggaagaagcttcttttaaagtaggatattcaagccaggcatggtgcctcacacctagaatctcagcactttgggaggccaaggaggaaggattgcttgaggccagaagtttgagactagcctgggcaacagagtgagaccccatctctacaaaaaatattcaccaggtatggtggtgcacacctgtagtctcaactacttgggaggctgaggcaggaggattacttgagcctgggaggtcgaggctgtagtaagccgtgatcatgccactgcacttcagcctgggtgacaaagtgataccttgtctcaaaaaaataaatacaaatttaacaaaacaaagtaggataatcaattgttgcttgattcatttcaaagaatatttaaatgttctggctcaaacaaggtaatgaccacacagtattttttggaggttaagagtttaggatggcaatgagtatatagtaaggttcaataaatggtagctatttttagttgtgtgactagtcccaataaatttcatcagcatggtagtaaaaaaaagccagtggagtcaggcgcagtggctcatgcctgtagtcccagcactttgggagaccgaggtgggtggatcacgaggtcaggagttcaagaccagcctggctaacatggttaaaccccatctctactaaaaatacaaaaattagccgggcgtggtgacacatgcctataatcccaactactcaggaggctgaggcaggagaactgcttgaacccaggagccagaggttgcagtgagccgagattgtgccactgcactcctgcctgggcgacagagggagactctgtctcaaaaaaaaaaaaaaaaaaaaaaaaaaagaagccagttgaatcagagggcaagtggggtgagagtaatgaggaaaggaacttcacaaatggcactacagttaagaaaagacattaccaaatgggtacttctccagttgtaaaatagtagcaagttctaagataacaaatggttttttcatctgctgagcatattttatttatgtacaagggccttgaaactgttagaattctgggtttataaattacttcaagtttcacaccaagagagtttctcaccataaactgacattcccagctgctggtagacagttgatgagctcaagcaaactgaagaaagaaatgaaagccagattataagaagaccaggcttcactatggcaaagggagggcctatttacagggatcccaaactgtcccattcacagtagcagcatagcaagtacactgtcactcacagttctacttggtttccaggggaacaactaacatggagcgggtattggaatctaatgtggatcatcctttcaagtttgtgcttcccttcacaaaaaacacaatcccataagaagtccttttctggccaggtgcggtggctcacccttgtaatcccagcactttgggaggccaaggcgggcggatcacgaggtcaggagatcgagaccatcctggctaacacggtgaaaccccgtctctactaaaaatacaaaaaattagccaggcatagtggtgggcgcctgtagtcccagctactcgggaggctgaggcaggagaacggcgtgaacctgggaggcagagcgtgcagtgagccgagatcgcgccactgcactctcgccttggcgaaagagcgagactccgtctcaaaaaaaaaaaaaaaaaaagtccttttctgaaaagttgagcttagacttcctgacgtattgcattaatcttccctgcctggaagaacatgcatagtatgcaaagaaaccttctgttaaagtttccctaaatttgacagcagcatgaaaaaataacagtagagcaaacagtaagctggaagagactttggcaatatattcactttccctacttctaaacagggtaagatcagcaaaaagataattcacttataattcaaaaaatgtcattaggcatcatgtatatataaagctctaggctgggtgttaaaaagtacatgtaaataaatcaaacacagactctctggacaataaaatgctagacagagtcaaaagacctagattctaatcctaaattaacctctaattcacagtttatattttcatgatgtatctttatttctccaagtagaaaagtgtttaattagtgcctagatactaaaaaaagtctattttatgtttactaattgtcaaccttcatctttttctttttaagtacctgaaacttccggaagcttctgaagcaagtctaagaaaagcatggatcttagaaacataaagacttggattcaaattctaaccctggcacttcaccagctatgtgaccttgacagcctccattttctcacctgaaaaatggagataatctttaatagtgttattttatgtgtgtgtgtatgatctatttacctatttccagataaccaggcaaataaaatcaactcaataggtggtaggtgctattattattattattattttttgagatggagtctcactctgtctcccaggctggagtgcagtggtgcgatcttggctcactgcaacctctgcctcctaggttcaagaaattctcctgagcctcctgagtagctgggattacaggcgtgcgctgtcatacccagctaatttttgtatttttagtagagatggggtttcaccatgttggccaggctggtctcgaactcctgacctcaggtgatctgctgcgcctggccagtgctattattattaacacccggattagttagaggtactattatttttactaacaccactaataatatcttttttttttttgggcgggggggctagagaggggcggggcgggggatggagtctcactcactctatcgcccaggctggagggcagtgttgtgatcttggcttactggaacctctgcctcttgggttcaagagagcgattctcctgcctcagtctcctgagtaggtggaattacaggcatgcaacatcatgcgtggctactttttgtatttttagtagagatggggtttcaccatgttggccaggctggtcttgaactcctggcctcaagtgatttgcctacctcagcctcccaaagtgctgggactacaggtgtgagccactgtgcccagccaacaccatttgtaatatctttactgtccaaacaatggaaaccatgggtgacaccatttgaccacaagacgaatgagaacaagatatgtgagaattggtagcaatatgggggcagggcagttaacatgaatgattcaaagtgaggaacaaagataaacaccagtgatggactaacaaaacatgtgaacacattatgctgttcgacagaaaaactcgatatgcaagacataaactctccctacgataagctagaaacagtgacttcaagaaaaatattgagtggattaatttttcttctacaaaactaaaaaataagaataggacaactctgaaaaagaataatagggcaaggggttgggctagccctattagatattaaaatatattaggaagcctggtggaaagatcaatggatcaggaaagaaagtccagaaatagaccaaatacatgcagaaatttagggtatgacaaaggtggcagttcagtgggagatcgattataaacatgatggtgggatgaccaagtaaccctgcctcacaaccttataaacaaaacataccaaaacaacaacaacaacaaaaaaaaaaaaccccacaaacaagcaaattctagattggccaacaatttaaaatgaaaaatattaatagaagagaaaagaaaatattttcataatttcagagcatggattggcttttataaacttgttaatacatgaagaagtcactaaaaaaaaaataaaacacagccaggcatggtagctcatgcctgtaatcccagcactttgggaggctgaggcaagtggatcgcctaaggtcaggagttcaagaccagcctggccaacatagtgaaacccagctctactaaaaatacaaaaaattagctgagcgtggtggtaggcacctataatcctagctactagggaggctgaggtaggagaatcgcttgaacctgggaggtggaggttgcagtgagccaagatcgtgccattgcactccagcctgggcaacaagagtgaaactccatctcaaaaaacaaaaaaaacaaacaaaaaacagcacacacacaaaatctatgccatgaaataatttttcaccgattagatcagtacacataaccaaaaaaaaaaaaaaaatcacactagtagagaaaggcagggaaacaggtatttgtctatgttgagggtgggagtagagatgtacctttctctacaagggacatctctgtaggcctacagagagcaatatggaacacccatcaaaattatgaatacatattcttcaaaccagagattcttactccggagcccctttttattacacagacgcacacacatgaagatgacatcctatagatacaaagatagtttatgtaccatatttctaatgaaaaaaagttgggaaacacctaaatgtgcatcagtaaagaagtactggccaggcacggtggctcaacacctgtaattccaacactttggggaggctgaggcagacagatcacctgaggttgggagtttgagatcagcctgaccaacatggagaaaccccgtctctattaaaaatacaaaattagctgggcgtggtggtgcatgcctgtaatcccagctactcgggaggctgaggcaggagaatcacttgaacccaggaggcagaggttgcggtgaactgagatcatgccattgcactccttcgtgggcaatgagagcaaaactctgtctcaaaaaaaaaaaaagtactataatacattagtatatacctatgtaatgaaatagtatacagctatcaaaaaagaatgagtcatatctagagacatgtaccaggaaaaaagattaaaaaaaaaaacaaaaaaaagaggcctctttctttatactgattcttttttttttttgaaatggagtttccctcttgtggcccaggctggggtgcagtggcgcgatctcggctcactgcaacctccacctcccagattcaagtgattctcctgcctcatcctcccaagtagctgggattacaggcatgcaccaccacacccagctagttttgtatttttagtagagatggggtttctccacgttggtgaggctggtctcgaactcctgacctcaggtgatccgcctgcctcggcctcccaaagtgctgggattataggtgtgagccactgcgcctggcttctttatactgagtcttaaaagatctctttaaaaattaagtttaaaaagaatagcacacatcagtatgtatgtatacgtctcatttatatgaaatcaggaaatatatatgttattacttattatacataaattgtctggaaggatatataagctattgtgaacactggttgctctggagagggaaagctggaaggcggttaatggagggaggccaacttacgttttactgtatactcctttgtaccatgtgaatgtattaacctattcgacaattagtttaaaaatttttttttaactattaaaaaggtatacattgtccttaggggaaaggtgtggtagaatttatagaagaaacaataaattttgtcccaaacccattatccttcccatacccactctgtaaggccactgctaacacagtctctgagcctgacctgacccaggcagggccccaaaagttctgcagtactggtcttgcttcctcaagaaaaacaaatcctctttctgcatttctttggaaatactgagcaaaaagagatggctgggatttcacagaaattacatgttaacttttagatcactgctgaaactaaagaatgggtctagaaaccaaaacgaaagaactggatagaacactggaaatctcaatgaatgctggaaagccctctacatactatttcattttctgccttggtaatagggtagctaatagaagataaaaacagagaagatgagaatgtcttatgcaaataacaacctttagcattctttactcacacagcagtattccttagtgggtacatactcatgcatagacaagctttacccaaaagaacaagtccataccatgcagaacacaatcccatgatgaaacctctctaaaagcctgactggctactaaaaccaattggtgttttttttaaattctggagttagtagctacatcatgcaagctgggaaacagtgattaagaaatagtgtcacttgtaggctgtgaaaaatctcaaagacaagggaacattttttgaaagctagattcagggaagccacgattaaatgtatacttttttggggaattgggggtggggggaaacggggctaccatttctaaatcttaaaggaatcatcttcttaatctcattccaattacttgactgaatagagccaaaaaagagtaaaattatgaggaacacaacatgggcaagttttatggactatgtttgatggacacagactatgcccaaaactcaaacccacatggaactgtggggcaatggatataagcaacaaactggtcaaaaaatgtatctgtatcattgagagatcatttcccattactagaaacacaaataaatcggtgcctaccaatgctggtttgaggccaccatttcctcataaggaggtggactgatttcatttaacctaaaagcagtttggatatttagtcccaccagcacaagctacatataaattgaaaaaaatctcatgcacatagctagacatgaaatattttctttcctcctgtgaatccttataccaagtaatgattaaaatttagctgtaaacttgatacataggaggcacaattttaaaaaaattaagaaatggatgatgataggtcttttgttagacaattcattgaaaattcaacttcccctaaaattcaacgttcagtgctgggtaaaaaaggcatgcaaccaagttaccagcctcctcaagcaggacacaaggaacacattggctgcagaaaacacaccgtagcagttataggtttcatgccaacaaaccaatgattaacaaggatgattagagtctggatggagccaagacacaagctctttgcctttctgatgctgactcaaaagccacaagcacacacatttccccatggcaggttcataccagcggacttcagttgcttatgtctctcttgttcctggattgtagactttggcaaaagtggagtaagtcctcgggacttggtgggtctcatgtagcctttcattggttctgccattctgcttttatcttcctttttcccttctcctggtgtctttgattcagatttttctgtcattttctgaggtgtctccaaaatcttatctttgggttctgggagtcgaacacccttggaagcagtcattattactaacgtatccgccacctctgaaggaggagcttcgactttgctatgtaagaaatctgactggatttctggtgttggcaaggaaacgctttccaattccgtgattttacaagccagactaatttctttcaatttatcattttcactttttggagacaaaagagtcagatctaccttcttattcaaactatctgaacctttggaatttctatcttgagcattttggtcctcacaaaaactgagcttttgtgctttgtcttccagtaagtcaggaatctgaactgcaacagacccttctttagtctctttctcttcattcactggatgtgctgggaaattacctctatctgcatatccttctagggctctggcctctcctggtaggctctggtcttctactggcactccaggaaggaggtgaccttttgctagctctgtgactttctctactgaatgcttagacgcaccactgtgcactgactcagattctcctatcacatgcccttcatcgatccctgcttcatttttcatggaatcagcaagctcagctttattcttaagagagtgatctccatgaatgttaactgtttctatggctgttgtaataggtagagcaactcctcctgtgcttgtagagggcacaacagcagagggacccttgggtctttcttgacctgggactccatctttggtgtagttatctaccattaatgatttggaaatctgggctggggctatctcttgcccattttttgccaaggtatctggaaaggaatcaccttcctttactacttgaggagtaggagtgggcagtttttcacaggctgctgattccagaacctctagaggagatgatttatttatcagctctgatggtgttctgggacaggtaaatgtaatatttctattttcgtccatataggccattccttcaattccctggtcccctgtggtttccatgggaacatgtatttttgttgcatctatcttattctccagaatgtgcttctcaggagaactatttttaacctttttactttttccatcattactccttttacttggtttgtcagccactgcagtgtatctattggctgcatctgtcttattctcctcagatactactgaaggaacaaatcctgccccctggatttgctcttggcagctcacatctgtcaccttggcaggtggttcagtaacagtagaagccttgactgtgcttatcttgttttccccaagagtcccaagctcaacaaaattaacctgaaaatttccacccttcctgtcaactgcttccactgtgggtgtatctggtgtatgtgagaacgaagaatcatgcattttggggaaagtaaatcctatttccttgcttttatggggaatactaccagtatctccatccttcccttcaaaaggtgggttaaggatttcttccttcctctccattctagcaggctgtgtggaataattatttttaaactttttgcttttgccttcattgcctctctttttaggcttttcagaaatccagggagctgcctcatgatccttccatggacaccttccttccttgctctggttattgacacccatatctttgactacatctcctgtttctgtgctaacaccagaagtctgagtcatgcctgatccactttccaaaggaatcaatgcctgcatggtgcctgccaccttaggctgagtcatctctttaggctcccccatcaccactgcctccgtgagatcagccttagtgcctggttgctttgaagaattcagccccagctcctcactcttatcctgagtagtcattccttcagttttagagactggctcactcggtatgagaacagcccttccgtccttctggctgtccagaagaaatggcagctcagattttgcttttaccttcccagaatctgttctcattttcccagaacttccccttcccttcctgcttttgccatcacctgccattctcttaaatggttcattctctaccccagggacctgtaccaacacttggccctgcagctgctcagaagtaaagatgctgatctcttgtctttcgttgggaaaagcttccttttttagttctttatcctcttcagctccttcaggaaactccttcagtttgacattctgcagtttagtcattttactttcattattcccttcttttagattacattctaatggattacttgctatcaaagtgggtaccaaatttggtatttcttttgctgctgtgggttttgaaactacacccataacctcttggtccaagaaaggagagcaaccctctttaagtctgatatccaaaggggtttctacattgtatgcagaaacttctgctaggggtcctttcagattgagagggcctactgactggcttttatctacaggagtcttcaggtggggtgcaggctgtggtttgtattcatgttgcttcagcaatttcttgtcttggttttgtagtactgacttgttacttttgctctcttcctctactctcagcttagactgagaacttattgcagttttgggggcttcttcagaaggatataaaggaattctgagactctctgagacaaagttctcagctaccagtctggctgcactggagttaactaaacattcccttttcaagttttctccagatacaagtccatattctgtacccatagtggtaggctggctggggagaacacctgatttttgtgtgtcagctgcaaatggatgacctttaggcttatctgcattgtcatcatccgaaggtcctccagcccgtggttgagaatatctcttttgctttggtttcttcttctttttcttcatcattattggtgtgctttctatatcccaggcctccctgccaagatccctctggggttcaagtgagtcaacatgaatactttttctttggttcccaggcccaccacaggaggatgaaccagagacccaacctgactcagacaaagagcagtggcccagcctgtgatcaagagtcttccatggaggagagcctcccagcagctcaggagggaccctggcaggcttgggccgggttgacctgcggtcactgggtctgcaaacttgtttggcttgtgtgggaggggtaccgcaatacatgaagttggctaaaattccaaacaaaaaactcctcgttattgtttcttaaaaacaacaaaaaacaaacaaacaaacaaaaaaaccagaccatataaatgactaatttaaggaggctattttcactaatacatatagtacttactgtaatttgctcaggaaaacagtcttttctaaaacatttctcacttttaactggcgctagcaaaaatatttaacagatcatcatctcaggtaaagattgttttcaaacatttataaaatatttgaaatttcagaagtagcaggattgaacttttaaaaatgaaacatttcacatcttttaacctctaaaaataagcacttactgcctgtaaatctcatctgatttatattggtcattcttagtgcttgcctctttttggtgaaatttattaattgcttcagttaaatatacatgattttggacaaaatttataattctaagactaggtcaccaatattaaactaatacttgtcaaacaaaccagacagattctgggaactagatcagaaggccagacttaagtcacttcacgcacacacacaaaatatactgaatccacattttggtcagagaaaaattctcatgattccagaaccagagcatcctactttgaaagacaaatatgttaaatttcaacattctgctcctaaatgtacttcccaaaagacagagaaatatatataatgttaagtaggataattaattttaacaattaagatgagtacctttggaagagtttcagcaggtgatctggtctaaccttcctcccagttaatataatatggatccaagatcctggcaagagtctcattaagagcaggtatatgccagctcctgtcaagtctgacccaataaattgatttccaagaatattataatatgtaaatagtggatttcattcttgtccttacccctccaatatcctctaaatcctagcctttgtttaatatctcaggttaattattgcatcgctcaaaaaattgctaggctatagtatcccccagtatttataacatttaattcagcaattaatcagcagctattcagtgccatcttttatactattttattcaattattatgtaaatcttgggtttcagagttcatgcctgagaacttatctcttcattcaggttataatataataattcagggggcaaggacggggacttaaatatctatatgccttaacatggtgtattttgtataccataagcacttgataaatctttactgatttgttgagtcagtaaaacaacatttaaaaaaaaaatcacacatttatttaagctctagtcttgtgctaggtagtgtgcaaagcattagagattctaagtgaaataagtcatgggcccttatgtcccatatgtcaggatgtccacattccaatcatagtcacagaaaagtaaacagaaaatcaagttgataatcatatacatatgcttctgggttattaaaaacaggtaatcttcaaattcactgaataatcaaactttaaattggaaagtatcttagagcagtacctctcaaagtttaatgaaaattagaattatctggggatctaattaaaatgcagataataattacaaaggcctaaggtagagcccaagattctgcatttctaccagcctctcaggtaatgtagatgctgttgggccatggaacactgtaactagtaagactttagagaacatttgaccaattaatttatattatagctaagtaaactgagatataggcaagttatgtaacttgcttaagaccacacaggatagaatagtgaatagctgaaccagatcaaaatttgggtgtcctttcttcactatgaaaacagtggagaaggccaggcacggtcgctcacgcctgtaatcccaacactttgggaggctgaggtgggcagatcaccagaggtcaggagtttgagaccagcctggccaacatggtgaaacctcatctctactaaaaattagccgggcatggtggcaggcgcctgtaatcccagctactcaggaggctgaggcaggagaatcgcttgaacccagtaggtggaggatgcagtgagccaagatcacgccattgcacgccagcctgggcgacagagtgagactctgtctcaaaaaaaaaaaaacaacgacaacaacaacaaaaaaaacagtggagaaaaaaaaaattaggtatcctgatttgctgtagtagtaatttttaaagatataacaagctgacattctgtctaaaccagataaaatctgtctaagagaattgacttcataaactatactgctgattaccaccatacaacagggaactagagacaatgtctaccatcactactctatcgcccctaatttgtttcaaagagttcattttgttttcctaacttacctgaggtctctgaagaaagctcagaaggttgactgttgcatggtttcctttcccctagtttttctaacacagaatcctcctcggccggcaagctgcactttttccccgttcctgtgacggtttctaaaggtaataacaaaagccacacacgtttcagagaagcatgatttcagctattttccatctgccagaaattggatatgggattagtttctgaggagttctcctacaaggggcagcaaaggagtgaagtggtagttggaagctgaagttgggaaggtatgtctagttatgttacttttttttttttttttgagatggagtttttcactctttgttgctcaggctggagtgcaatggtgcgatctcggctcaccacaacctccgtctcccaggttcaagtgattctcctgcctcagcctcccgagtagctgggattacaggcatgcgccaccatgcccggctaattttgtatttttagtggagacggggtttctccatgttggtcaggctagtcttgaattcccgacctcaggtgatccgcccacctcggccgcccaaagtgctgggattacaggtgtgagccaccatgcccggtcaatgtttcgttttttaagatgggaaaaataacaaacgtttgttaaatgggtgggaatgatccaatgaaaaaagatttaaattggtatgaggggcaaaaaagggaagaatacatggggcaatatatcgagtaggaaagaggagatggaatctagggcaaaatgaggagaggttggtcttaattaggagcaggaacagtttacttataaaaacgggaactttcataagcagagaccatggatacagatacaagtagttgggtagataatggaatagaagtttgtcgatgttctattttattgcttgacttatctgcaagaaaaacaggacaatcagcagagaatgaacatagaaaaggtgttggaggtgggaggagggtaaaggcgggaaagagttgtctaggagagcaggagtatgaataaacttgcaaagtacagtgtgactgtctgtactttacctggcatgatgtttgtccttagtcttctcgagactacaacctggtagagagaaatactgagaataagcacaagcacgtacctggtgaaatcatgaaagtaggtgcagctgactgccccacatcctgcagagattctaaatgggaatcctcacttattcctttttgtgtttgtgcaatttccatgtctttaattggaactggtgttgcctctgtttctgagagtggtggaacatctttggctggagtcacattgttggccagggtcagaaccccatccttagccaggggtgcttctgttttgagggctgggacctgatcctcagtcagggccacctccatttctggaggcagacatacgttcttgatgagaactacttctgtttctggaggtggagtcacatccttgcccagagccatttctgtttctgatagtggagacatgtccttcaacaagcccacttcttttactgtggacggagccacatccttggccggggctatttctgtttctgggagttgagccatgtccttgactggggccacctctgcttctaaaggtagtgctttatccttggtcaagatcacgttggtttccgggggcagtgtcatgtccctggccagggctacctctgtttctgaggacaaagccaccttctcagcagaggatatttctgtggatgatataatgtcattagcctgtgccacctctatttctgagagtaataccaaatccttggctgggactatcttgttttctttgggtggtcccatgtccttggaaggagccaagtccatttttataggagatgccctctctgtttctttcttgttttctttgggtggtcccatgtccttggaaggggctaagtccatttttataggagatgccctctctgtttctttcaacagtgtcacatccttggctggggctacctctgtttctgtgggcagtaccacattcttggctgaagatacatctgtttctgtgggccatctgacatccttaaccagggccacttctttttctgtgggtagttccatgtccttgactagggccatatctgattccatggatggctgcatgtccttggccagtgtcacatctaatttggtgggtgattccatatctttagccaatgccacctcggtttttgtagctagtgccatgtccttggcgagggccatctctgtttctttagatggtgccatgtcagtagtcttcagtcccatcattatttccaatgcttgtgctggtggcctctcttctgatgccatttctatctccttggctagctctaagggaactaaattggaaatttaggacacatcattgtctactcatacctttgcattaaaaatgcttactttcttcaggcatgagagtatttggcttttgtgaccataagactgtacacataactaagaattaatgttaggccgggcacagtggctcacgcctgtaatcccagaactttgggaggccgaggcggatggatcatctgaggtcaggagttcgagaccagcctgacaaacatggtgaaaccctgtctctactaaaaatacagaaattagccatgcagtggcaggcgcctgtaatcccagctacttgggaggctgaagcaggagaattgctagaacccaggaggcggagtttgcaatgaaccgagatcacggcattgcactccagcctgggggacagggcaagagtccgtctcaaaaaaaaaaaaaaaaaaagaagaagaagctaatgtcaagtaacatattctgcctactctttgacagtctcaacacttggaagaataagatgtaaaatactgggaggacaagtagtggaggagaaatggcaaagaagagagaaaacataggcttcaaaaataacacgggcacagaattagtattagaaagataatctgtgggacagcaggtcagtcatgcttcctatcaagaaaaactccagagttctaaatctgtactgaatttttgtttttgttttttgagacacggtctcacgctgttgcccaagctggagtgcagtagcatgatctcggctcccgggttcaagcaattctcctgtctcagcctccctagtagctgggattataggtacacgccaccacgctgagcttatttatttatttatttagctctttcacccaggctggagtgcagtggcgcaatctcggctgacagcaacctctgccttccggtttcaagtgattctcctgcctcagcctccctagtagctgggattacaggcacctgccaccacgcccagctaattttttgtatttttagtagagacggggtttcaccatgttggccaggctggtctcgaactcctgacctcaggtgatctgcccgccttggcctcccaaagtgttgggattacaggcgtgagccaccgtgcctagaccaatttttgtattttttgtagaaatggggtttcaccatgttggctgggctggtctggaactcctgacctcaagtgatctgcctgcctcagcttcccaaagtgctgggattataagtgtgagccaccacaccaggccgtaaatctgtactgaattaaaaaaaaaaattctgatacctaatacaatgaaaatgtgatgaaaaaaatatatatatgttaaaaaatttaaaaaaagtatttatgtgcccgttaaccctaagtgttatagttcaacaatttaattcctccagtggtgatatcactaatataagcaaaacatttgtgattgttctgaaatttttatacctgctgtaagctgctaaaaaatacacctgatgatttatattgattaccaatactgcaaccattaactgataaagggagtctctaatagtttacctgccgttggctgaggaggttctgcaacagcctctggggaaacaaaggactctgagtgtggagagtttaaggcttccacagaccacccctgaggtacaacagctgtgttgcagggagacatacctaatattgaaacacaaacaaatacattttgaaacttagtaaacattggaaacaaaaggtatttgatatatttttgttttgttttgttttgtttgttttttttttgagacagagtttcgctctgttgcccacgcagacagagtgaagtggcgtgatctcggctcactgcaagctccgcttcccgggttcacgccattctcctgcctcagtctcccgagtagctgggactacaggcgcctgccacagctcccggctaattttttgtatttttagtagaggcggggtttcaccatgttagcccggatagtctcgatctcctgacctcttgatccaaccgcctcggcctcccaaagtgctgggattacaggcgtgaaccaccgcgcccggcctaagaggtatttgatatttaaaatcagctgcatatattgccaggaagacacagactaataaaaaacaatgcaaaaaaagttttttttctttttttgagacagagtctcgcactgtcgcctgggctggagtgcaatggcacgatctcggctcgctgcaatctctgcctcccaggttcacgccattctcctgcctcagcctctcaagtagctgggactacaagcacacaccaccacacctggctaatttttttgtatttttaatagagatggggtgtcactatgttggccagattggtctcgaactcctgacctcatgatccacccgccttggcctcccaacgtgctgggattacaggtgtgagacaccgcgcccggccgacaacgcaaacaagttttaaaggaaacactgctgacattcttcaggttttagctagttgttagtaggtggtatagtatatcccagtagtgccattaatcaacattcactggctactttctatataatatataaagggtaatataaagattcaaaatattaatgattgaactctagttccaacaccacaaccaacataatatactatagtaaaaaactgcgagtcttaatttcttcatctgcaaaatgagattaacacctccctttccaacattagaagacaattttattaaaatactttgtagcagttttgttgttgttgttgttgttgttgtttgcccagctaattttcttatttttattatatttatttattaatttttgagatggattcttgctcgttgcccaggctggagtgcaatggcacaatctcagctcactgcaacctccacctcccaggttcaagtgattcttctgactcagcctcctgagtagctgggattataggtgtctgccaccactcccagctaatttttgtatttttagtcgagacagtgtttcaccatgttggccaggctggtctcgaactcctgacctcaggtgatctgcccacctccgtctcccaaagtgctgggattacaggcatgagccaccacactcggcctaatttttctatttttagtagagatggggtttcaccatgttggccaggctggtctcaaactcctgacctcaggtgatctgcccgcctctgcctcccaaagtgctgggattacaggcatgagccattaggcccagcctaatttttgtatttttagtagagacgggatttcaccattttggccaggctggtcttgaactcctggcctcaagtgatccatccgccttggcctcccaaagtgctgggattacgggcgtgtgccactgcacccagatggttttttttttttttttttttttttaagacagggtctcaactctgttgtccaggctggagtacagtggcatgatcatggctcaatgcagcctcgaccttctgggctcaagcaatccttccacctcagcctcttgagtagctgagactacaggcatgtgccaccacgcctggatgaattttaaaattttttgtaggacaggatctccctatgttgcccagattggtttcaaattgctgggctcaagcaatcctgtcacctcagcttcccaaagtgctagggttacaggcatgagccactgtgtctgcctgtaaatgaagaagtagaaaaatgtggctgggtgcaaaggctcacgcctgtaatctcagcactttgggaggctgaagcgggtggatcacttgagcccaggagttcaagaccagcctgggcaacgtgacaaaaccccatctctacaaaaaattagccaggcatagtggtacacacctgtaatcccagctgctcaggagattgaggtgggaggatcacctgaccaggaggccaaggctgcagtgggccgtgatcgcatcactgcactccaacctgggtgacagagtgagaccctgtctcaaaaaaaaggggagatgacagcccaactgtgaatctgtgaattgtctcctttgattaatccaaagagagccttgtcacacccacagcccctaaatctgacttttcttagtggttagcttcaaaggtgatgtgtgaaaggccatgttgattgtttggcattaaacaactaaaggacaccagaatatgccaccccaaaatacgctactttggcataaggacttttttaagctgaaggctattattagcctggagatggcaccataggaatctacacagcaacctttactaactagcttttacctaccatttacctgtctcccacaatttgcggcccctagagactcaaaagtcttttccttcatcttctcacctctcaaaaaaaaaatttgtcattctttattgaagaagctatataaggtggaattctaaagccacctcttgcggagttactcattccctaggtacctctcatgtacatattaaattcacattttaaactttggtctcttttttcttgttaatcttttgtcacagagccctagtcagtgaaccaaagatgagtaaagaaaaaatttttttccttccctacagaataaatccatttgaagaagccataccgtaactgtctttcaagggatcattttgtcctgcaaatattgaagtatcagctgtcgcactggagggaaagaccaaatctgccaggtcatcatcatggtacatcttaaagggatctggaatatagaagaaatccaaaactcattcctggtgaatgcaactagaaagattaatatttctttctttctttcttttttttttttgaggtggagtcttgctctgttgccaaggctggagtgcagtggtgccatcttggttcactgcaacctctacctcccaggttcaagcaattctcctgcctcagcctcttaagtagctgggattacagatgcccgccaccatgcctggctaatttttgtatttttttgtagagacaaggtttctccacgttggccaggctagtctcaaactcctgatctcaagtgatctgcccacctcggcctcccaaagtattaggattacaggcgtgagccaccatgcctggccaatatttcttattatcctatgatgaatatagatgagttgtcaatagtaagtaaaccgaaatcatatgtgactgcacatggtagagaatcaatattcactaattcatttgttatgagttaataataaataatcccttctctaagatttggttatgtacatcagatagccaacaaatgcataaaacaaaaagggcaactaatgctcagctgtataacaaacactctgagaggtgaaagtataaactaaattttcaatatatatttatataacattcattttaagttactttttaaaaagacagagccattaacaagcttaaaaaaaaaaaccaacaagtaatttttcacctcatgtggacatgatgaagaaaactgcatttcaaaactgtctgaatgggacaagataaacaattgttatcctaacagaagaaataaactcttgactcaggagctggcatgaataaaagcactcaaaacatcaggtaaactctttgtgcttttgtacatgaaaaaaaagcagggccgggcatggtggttcatgcctgtaatcccagcactttgggaggccaaggcgggcggatcacgaggtctggagattgagaccatcctggctaatagagtgaaaccccgtctctactaaaaatataaaaaaattagtcaggcgtggtggcacgtgcctgtagtcccagctacccgggaggctgaggcaggaaaatcgcttgaacacgggaggcagaggtggcagtgagccgagatggcgccactgcactccagcctgggtgatagagtgagactgtctcaaaaaaaaaagaaaaaaaagcaaagctgttcaggctaaacaagagttccactttctgaagaggccttcttggaatttattttattatcttaatcatcctgaagacttgttaaaaataaagattgctggttcctgagaatctgcatttccaactagttcctgagtgacactaacacatcactcccttaagacacttcaattgtcagagacagccgcataaaagcccaggccttgagagaatgttcattttcttggctctgaggcagctataccaccctctttttgtaagaaatttcaggattaggggagaccactgcatcgggaagtgtgaacaagcagaaggcaatattgggaaacttgttgaggcttcttcttcagaaaaccatgggagcctggaaaagtggcacacaccccagctacttgagaggctgaggtgggaggatcttcttgagcccaggggttcaaggctgcagtgcactatgatatggcgactgtgaatagtcactgcactcctgtctgggcaacacaccgagaccgcccatctttaaaaacaaaaaacacagcctgctttttgtttaaaaaaaaaaaaaacaaacccttattttcaaaaaacggaaaaattagccaggcatggtagcgcatgcctgcagtcccagctactcggaaggctgaggtgggaggatcacttgagcctggggaggttgagtctgtggtgagccgtggttgtaccactgagctacagcctgggtgacaaagtgaaaccccatctcaaaataaataataaaaacagaacaaaattaagaaaaagaaaagatggggagatagaatatgagagagatgataaacattcattcttcccagttctatatggtttgggatagctcgctgcttgctctgcctctcacacttcccccttgagggaaaaaaggattcttaaagcatcaaacagactaaattctggatggtttgcactttaagatgggagcttgctaaattacttgtaaaaatagatgattcttacagagttctgtcatttagtcattaattttttactgggtgcctaccacatggcagacccagtatgctctaaaaaacccaaagatgtacaaggtcagggatgggaacatttatatatgttcccacaggatatattttggttcaagtcaagggagatctttgcttgataagtatttaagctgagaactaaagaactgagtggttatgaggaggaagacaaaccttttctctctctacattccctctcctctaatcccacagtttaaaattccatctataggttgatgacacctgaatttataattcaagacctctagacctctcaccttattttcagacttttatgtagcatgtttccaaatctactcattatatagtctttccatctctaatggcattctatccttctatgttttttgcaaaaaaccttggagtcatcctggacctcctctttttcacacaccacagccaacccatcagaaaatccattgcccttgaccttcaaaatgtgccccagaacctatttctcccccagctccatgactagggtttctcacaaggttgcagtccagcggttggccaggggctgtggtgatctgaagacctgactggggctgcagaacctgcctgttaagatggcttacgtggccgttgaatggaggcctctgctcctctcccatgtgtgcctctctatatcagctggctttcctcatgattagtaaacacagagtgatcaagatggaagctacgatattttttttttttgagatggagtctcgctctgtcgcccaggctggagtgcagtggcgtgatctcagcttactgcaacctccgcctcccaggttcaagcaattctcctgcctcagcttcccgagtagctgggactacaggcatccgccaccacacctggctaattttttgtatttttaggagagacggggtttcaccatgttggccaggatggtctccatctcttgacctcgtgatccacctgcctcagcctcccaaagtgctgtgattacaggcgtgagccaccgtgcccggctgaagctatgatattttctgtaatttaatcttagaaatgacacactattatttctgccatctattctacaatcacacagaccaaacctagtaccacatgggaggtgactacacaagggtatcaataccaggaggcagggatcattggacgccatcttggcagttgactaccacactcaactttccgctgaggaaattaaactccactgaattttttttcctactcaaaattggtcattcctttgttacccttgctggctcctcttcttcctgatttaaattatttatgtacttatcatttgagcttgggcggtcaaggctgcagtgagcccagactgtgccactgcactccagcctgggcgacagagggagattctgtctcaaaaaaataaaataatgaacaaaatatggtatagccatataatggagtattacgtgtccataaagaaagtactgatacatgccacaaaatgcaggactcctcaaaacagtatgctaagtgaaaaaaagcagtcacaaagaaaccactttatatgattccctttatataaaatgtccaatctaagcaaatttatagagacaaaaagcaaattggtagttgcttagggttgcagtggatagggagatgggggtgatatttaaaaggtacagagtttctttttgtggtaataaaagtgttctaaaattgaatctggttatggttataaccataaatagataaatagataggtaagtagatagagtacaattcagcggaatttttttggagacagagtttcgctcgttgcccaagctggagtacaatggcacgatcttggctcactgcaacctctgcctcccgggctcaagtgattctcctgcctcagcctcccaagtagctggaattacaggcgtgcaccaccatgcctggctatttttttatatttttagtagagatggggtttcaccatgttggccaggctggtctcgaactcctgacctcaggtgatctgcccacctcagcctcccaaagtgctgggattacaggcgtgagccaccacgcccggccaattcagtggaattaagttactctattttatttattttattttattgagacagggtctggctctgtcacccaagctggagttcagtgggacagtctcggctcactgcaacctctgcctcccgggctcaaacgatcctccaacctcagcctcccaagtagctggcattacaggcgcccgccaccatgcccggctgatttttttatttttagtagagacgaggtttcaccatgttggctgggctggcctcgaactcctgacctcaggtgatccgcctgcctcggcctcccaaagtgctgggattacaagtgtgagccaccacgcctggcctaagttactccatttatctactctatctactctacctatctgtctgtctgtctgtctacacatctatcagggacagggtcttgctgtattgcccacgctagagtacagaagcacgatcctaggtaactgcagctttgaagtggcagactcaagtgattcccccaccccagcctcccgagtagctaggactacaggcatgtgctgccacaaccagctaacttttaaaatgttttgtagagacagaatcccattatgttgttcaggctggtctcaaactcttggcctcaagtgatcatcccacctatgcctcacaaagtgctgggattacaggcacaagtcactgaatctggccgaactatatactttaaatgggtaaactgtatggtactgtgaattattggccaggcgcagtggctcacacctgtaatcccagcactttgggaggctgaggtgggcagatcatctgaggtcaggagtttgagatcagcctggccaacatggtgaaacctggtctctactaaaaatacaattagttgggtgtagtgggcacctgtaattccagctatatgggaggctgaggcaggagaatcgcttgaactcaggaggcagaggttgcagtaagctgagattgcgccactgcactccagccagggtgacagagcaagactctgtctcaaaaaaaaaaaaaaaagaattgtatctcaatacagctttttcttcaccctccccccataattactttgtacctaggaaagccgataactgacaaatggtacagaacatcacatactaggttatttgaaacaaacgatgagcatcttataagttagatgtcaaaaaagaagccatatttaagtggaaacataacttgagctctcaatctggctaacagggaagtaccaaagctattcctttaaggctcttttggaactcattcttcctaccaactctagctctgggctactacagataggcttttgtttgtttgtttgtttgtttgtttgtttttgagatggagtttcgctcttgttgcccaggctggggtgcagtggcgcgatctcggctcactgcaacctccgcctcgcaggttcaagcaattctcctgcctcagcctcccgagtagctgggattacagacatatgccactacacctgcctaattttgtatttttagtagagacagcgtttctccatgttggtcaggcttgtctcgaactctcgaactcaggtgatccgcccactttggcctcccaaagtgctgggattacaggcataacccaccgcacctggtctgtttttaattttatagaaagtgggtatgaatcagctttctcttctgtcaaaagaggatacatatatttggcagagttaggtaagaaataccgataatgtgtatataaaggctctagcactgtgcctggcacagaacagcactggtttaacattaccataataattccttctggaagaattaaggttctaaggtactatggatcctctaatcttcagtgtatatgaatttcacataatgtatttaaaataggttttgaagagcagggaactagagggcattaagtgtctcaaaggaaaggataaatgaagaagagaaagggacaaaccaatgctaaggttgtactttgtgatctatacttaagctaaagcattttcatctgaatggtggttgtagctttttcacatttatgtcatagcacacatttagtagtcacgagcaagccaacacttaccagtctggataggatcgaccacttgctcaggttggaaacaaaagttggtatcttctggccagttctggctatttgggtattcctggtaggccattttctcttcaaggaattcagttggagacccttaaaatagagacacaaaacaaaagttacaagatattacagttttctcctccactacagtggaatttctacaaagtattacagctagtacaatataaaaaatcctatctagctagtgtcttacaagaaaacttttttcttttaattgaaagataaaaggagctgggtgcaatggtgcgtctgtagccccatttacttgggagactgagagaggattacctgaacccaggagtttgaggctgtagtgcactatgatcacacctgtgaacagctactgcactccaacctgggcaacatagcaagactctgtcactaaaaaaaattttagatagaaggaaataaagtaggtcattaaggttaaaaaaacactacagagtgacttctaggttatgcaggcacgaagagggtagtgatttctccacatgaaagaacaaggataaaactgtcaaaagcaacaatttcagggagctggaattaaaaaaaaaaaaagccagcctaaataagtggaaaggtataacatgctcaggaatgaaagattcaatactgttaagatggcaatcctgaaaatgaccaatatattgaagaaagtacaaaataagctcattccataatttatataaaaatgcaaaaaacctagaaaagccaaaacaattttgaagaaaaacagttgaagggcttacataacctgatttcaaaagttattataaatgtaccaactcaggctgggagaagtggctcaccacctgtaatcccaacactttgggaggctgaggcaggcagctcactttgaggtcaggagttcgagaccagcctgaccaacatggtgaaaccctgtctctagcaaaaatacaaaaattagctgggcatggtgatgcatgcctgtaattctggctactcaggaggctgaggcacgagaatcacttgaacctgggagtgggaaggttgcagtgagccaagattgcgccactgcactacagcctgggtgacagagcaagactgtaccaactcagcatggtattgacaacgtggtattggaacagaacaggttcagaacgtggtactggaacagaacaggttcagaaagaaacatacaaagttagggtcaactggctatctacaaacataatataattcaacataattatattcaacccagaaacaaattttttttcaacaaatgatacagaaacaattggacactgaccacataccatatgcaaaagttaactccaaacagatcaaagacctaacgtagctcacttgctaacttattatgcaaaaaaaaaaaaaaaaaaaaaaaaaaaaaagacaagacaaagacctaatgtaagagttaaaactaaaaaaacttataaacaggaaaaaatctttgtgactttggattaggcaaagatttcttagacatgtcaccaaaagcactatctgtaagagacaaaatatataaatgggacaccatgaaaatttaaaacttttgcttttcaaagatgctattaaacggccaggcatggtggctcatgcctgtaatccctgcactttgggaggccgaggcaggcggatcacctgaagttaggaattcaagaccagcctggccaactgggtgacaccccatctctactaaaaaatacaaaaattagctgggcctggtggcctgtgcctgcagtcccagctactcaggaggctgaggcaggataatcacctgagcctgggaggcgaaggttgcagtgagctgacattgtgccactgtactgcagcctggggcaacagagtgagactgcgtctcaaaaaacaaaaccaaacaaaaaaacaaaagacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaacaaacaaacaaacaaaaaaaacaaaagacaacaacaaaggtactattaaagaaaatgaaaagagaagtcatagacttcgagaaatatctgcaaatcataaatctgataaaagatttgtatgtagaagagattataatctcttacaatacaattataagataaacaactcaatttaaaacttgatggccagctgcagcggctcatgcctgtaatcccagcactttgggaggccaaggtgggcggatcacaaggtcaggaaatcgagaccatcctggctaacacagtgaaaccctgtctactacaaatacaaaaaaaaattagccgggcatggtggaggatgcctgtagtcccagctactcaggaggctgaggcaggagaatggcgtgaacctggtaggcagagcttgcagtgagcggagatcacgccactgcactccggcctgggtgacagagcgagactctgtctaaaaaaaaaaaaaaaaaaattggctaaatatttcaatagacattttaccaaagaaaatatataatgcgtaatatgcacatgaatgaagctcatcagtccttagggaaatgcaaattaaaactacaatgaactcctactacaaaaccactaaaatggctgttatcaggccaggcacaatggttcatgcctgtaatcccagtacttcgggaagctgaggcaagaaggtcacctgagcccaggagtttgagaccagcctgggcaacatagtgagaccctgtctctacaaaaacatacaaaaaaaaaattagccaagcatggtgacgagtgcctttagtttcagctactcaggatgctaaagcaggaagattgcttgagcctgggaagtcgaggctgcagtcacctgtgatcacactactgccttggtgacagaaaaaggccctattttttaaaaaaggctgtacaaaaagactgacaggagcaattttgagaatgtgtaaaatggtagtttggtggtttccttttatttacttatttttgtttttctcaaagttgctctttttttgttgttgagacagggtcttgctctgtcatccaggctggaatgcagcggtgtggatcatggctgactgcagcctcaacttcccaagctcaagcaatcctctcacctcggcctcccaagtagctacaaatataggcacttgccaccacacctgcctaatttaaacaaaatttttttttttttttttttgtagagacagggtctcattatgttgcccaagctggtctccaacttctgggctcaagcagttctctgatctcaacctcctcaagtcctaggattacaggtttgagccactgtgcctggctccatctgtatttttaaagactagtcaagtacaacagtgagaagcagggaaagagtggaacgtggagttcaatctgtaactgactgaacaattgagataactcactacctttggaccagcctctttttattttttaaataacagttttatcgagtataattcacaaaattcactcttttaaagtcgagttcaaaggttttttagcatatacacagttatacaaccatcaccactatctaacttcagaacattttcttcactccaaaaaagaaatcccatatcttttctcctttcccactttcccctacccctcggtaaccactcgtctactttttgttcctaaggatttgcctaatctagatatttcatataaatgaagtcacacaatatgtcatcttttgtgactgacctctttcatttagcacaatgttttcaaggttcatccatgctgtagtatggtaactgaactttattcctttttatagccaaataacattccactgtgtagatccaccacactttgtttatccattaatcagctgacatttggttgtttctactttttggatattgtgaataatgctgctatgaacattcacgtacaggtttttgtgggaacgtgtttcaattatctttgatatatccctaggagtagaactgctgggtcataaagcaactttatgtttaatattttgagacactgccaaactgtttccaaaatggctgcgtcattttacaatcccaataacaatacatgaggactccagtttcttcacatcttcaccaacatgttgttatctttttttatcgtagtcaccctagatgtggtaagaagtagcatcttattgtggttttgatttggactgctctaatgactaatgatgttgagcattttttcatgtgttcatctggcatttgtatgttttctttggagacgtgaaatgagtggggtctcattatgttgcccagactattcgggtgcagcggctgttcacaggtgcaatcatactgccttgcagcctcaaactcctgggctcaagtaatcctcttgcctctgcaagagacacctacagctgagaccacaggtgtacaccaccatgcttggctatctttttttgtttttatttttgagacagtcctgctctgttgctcaggctggagtgcagtggcacgatcacagctcactgcaaccttaaactcctgggctcaagagatcttcctgcctcagcctcaagagtagctgggactacaggtgcatgccaccacacctggctaatttttttttaatttttgtagagaagaatctcaaaagcattatgctaagtgaggaaatcaagataccaaagaatatatattgtatgattccatttatatgaaatttctagaacatacagaactataacaggaagcagatcaatggtcacctgaaactgtaggtcagaaaagggactggctttgtaaatgggctcaagggaacttttagggtaataaaaaaatgttctaacgatggattacactgatggttgcacaactccataatattactaagaatcatttcgactccgtaattttactaagaatcatttacttccacacttacaacaggtaaatttttgggtatgtaaattacacctcaataaagtttttttctttcttttttttgagacagggtctcactctgtcacccaagctggagtgcggtagtacgatcatagctcactgcagcctcgacctccctgactcaagcaatcctctcacctcagcctgccaagtagctgggactactggcatatgccatcctgcccagctttttttttttttttttgagacagagtcttgctctgtcacccaggctggagtgcagtggcgcgatctgggctcactgcaagatccgcctcccagattcacgccattctcctgcctcagcctcccaagcagctgggactacaggcgcctgccaccacgcccggctaattttttgtatttttagtagagacagggtttcaccatgttggccaggctggtctcaaactcctcaacccaagtgatctgcctgcctcagcctcccaaagtgctgggatgacaggcatgtgtcactgcacctggccccaaaagccaactttaaatggcatttcaacacaagtaggttccccagagctgaatgtggtgaaattgggttaattatgtagtttaattttctgtactctatgtatgtattcatcaccatttcagtagatatgtaaggccaattttacataggtcacacatacttgtttttaaacactgctggagaagaaatctcaaggctgaccgaagcaacagactcaggcactgggtaaagagagggacaggacatcaagagctaatctactggtggtgaccaggcagcactgaatcaacagcaccacaacatattaaataatttttttaaaaaagtgattagggttttgaaccctacttttccccagtcaaatttctaccctttcaataccttttagtatctgctgtatactgatggcatagttttgagacagcgtctccttttgtctcccaggctggaatccagtgacttgatctcagctcaccctaaactccgtctcccaggctcaaattatcctctcacctcagcttcttgagtactgggactacaagcacgtgccatcacgctcggctaattattgtatttttggtagagacaggatttcaccatgttacctaggctggtcttgaacttctgggctcaaggagtccacccatcttggcctcccaaagtgctgggattacaggccaccgtgcctggcccagtctgctttcttataaacaatattagtgcggctcataatttacatattactaacaaacgaatcagtgactccttctatttcacaccctcagctctttccttgtttttttgtttttttcccccagtggtaacctcagaactttaaagtgaaaggaacctagaggatcacctaatccaaacctctgaagtttaaaccatgccacatttgtccagataattcatttaccaatttaagcacatactgtcaatcgctactccaggcattagtgattcagcagtaaaccaaatggtgaaatgtcctgctctcatggaacttagatcaccaccatcaccaccctatgcttaggcactacgaaaacacagaagcaagtattagcctagttgagagtttaagacatgcccaatgatgcaaacctctgcaagctttagttttcataactaatacctacttcataaggctaagatatgtgaagtgcttagaaaattatgagaaacatgctaaattattgctaatcctataataaccattatggtttatgtaggacaagtgtctacaatgcagtaagtgctacttataggagtttaaagaacagtcacataacacagtcgtgggatgatctaggatcttcctgtaggagactagaacttaattgaatctaggaagatagaaggatgtaattaaatgaagctgggaaacagagaaagagacaaagtggggaagacacacagcaagcaaaatagaagttagggccatgggcaagaatgggaaaaccaagagcatatcactttggatgaaacacatttatgaaggacagcagttcttcataaacggcagctagagtttcaaaggccaaatagaaacttaagatttgtctgcctgaatgccttctaaagggaaacccacccctaggaaccatcccattcctctatttggtcctggtgttttgctttccccaccgaagaagtagacttgtgattcaagcaggcccaaagcccttttggagaaacctgatatacagacattttaagatattgaaccataataatatacctgagctggccaggcgtggtggctcacacctgtaatcccagcactttgagaggctgagacgggtggatcacctaaggtcaggagttcgagaccagcctgatcaatatggtgaaaccccatctctactaaaaatacaaaaattagccgggggtgtggtgacgtatgtctgtagtcccagctactcaggaggctgagacaggagaattgcttgaacccgggaggcagaggctgcagtgagccgagatcacacaactgcactccagctgcagtgacgtagtgagacttagtctccaaaaaaaaaaaaaaaaaatattaggaatatacctcaaaaaaattaagaattttatataagaatataaaattaagaatatagctgccagtggccatctttctcaaccctgaaagacactgcctaagaatgaagccaaagaaggtgtagggaggaaagaaggggagaaagaggagggtgggagagagacaaagaaggagaagaaggagagaaagaggccaggcatggtggctcacacctgtaatcctagcactttgagaggctgaggtggtggatcacttgaggccagaagtttggcaccagcccgaccaacgtggtgaaaacccgtctctactaagaaaacaaaaaattagccgggtgtggtggtaggcacctgtaatcccagctactcgggaggctgaggcagaattgcttgaacctgggaggcagaggttgcagtgacccgagatcacatcactgtactctagcctgggcaacagagcaaaactctgtcttaaaaaaaaagaaaagaaaaaagggggaggagaaaggagagacttatggatcaggtattattctaaaacccttatatgttaaaaaaaaaaaatctagctacaagcacgcaacaaaatatacaaatatacaatgcctagttcttataatggcacacgtaacattgaggaaatctctaaaaacaaagcttcttcacaggacagaaaagcaatctaaaccaaaaagagatatgctaaagaaggaaaacagaactagaaaacagaatcaggagcccaggcacggtggctggcgcctgtaatcccaacactttgggaagccaaggtaggcagatcacctgaggtcaagagttcaagaccagcctggccaacatggagaaaccccgtctcaactaaaaatataaaattagccaggcatggtagcgggctcctgtaatcccagctactcgggaggctgaggcaagagaactgcttgaacccgggaggtggaggttgcagtgagccaagatcgcgccactgcactccggcttgggtgacaagagcgaaactccgtctcaaaaaaaaaaaaaaaaagaaaagaaagaaaacagaatcaggagacccaggttctaatcttgactctgccacttaactttgggtgtgaccttaagactgttagagctacactactcatccagaattaaaaaaaaaaattgtgctacataatttctgaagcccattttaattttaaaattaattctgagacttttgacttatccattcatctttataattctcaaaaatctggtaaaacataacttacaaataagactcagcagttattagacagatgaaatacttggtcatttaagtagatgaaagtactcattacttgtctaagccagaaaaatgacgatgaattaaagaacaaaccacagcatcctcgggaaggttcacaagtggcatatacactgagcagaggggaagaaaaggtgatgaaacttggataaacgcctttttaaattagtaaaaatattaaaagcaatatgttttttcataggattaatatatttgtcttagttcttgaatcacaaaacacaaatgtaataaaacaaccccattctggattactgcagtgaaattaatcagaaaattataggagaaagatgtttctgatgttctcaggttgaaggtaggaatcaatctcagaacctttggctaccttcaagaacagcttttcctttttcttcttcttttttttttttttttttttttgagacgaagtctcactcttgtcccccaggctggagcgcgatagcacaatctcagctcactgcaacctctgcctcccgggttcaagcgattctcctgcctcagcctcctgagtagctgggattacaggcgcctgccaccatgcccggctaatttttgtatttttagtagagacgaggtttcaccatgttggccaggatggtctcgaactcctgacctcaggtgatccgcccgcctcagtctcccaaagtgctgggattacaggcatgaaccactgcacccagccatttttcttcttttattattattattaaatattctaaaaaatctatagagggaaaggagggagagaacagctgggcaccagcagacatatttgagttcttacttttattttattgagacaagatctctgctgggtgtggtggctcatgcctgtaatcccagcactttgggaaggcagaggcaggcagatcacttgaggtcaggagttagagaccagcctggccaacatgatgaaacgctgtctctactaaaaatacaaaaattagccacgcatggtggcgcacacctgtaatcctactcgggaggctgagacaggagaattgtttgaacctgggaggtggaggttgcagtgaaccgagactgtgccactgcacccagcctgggcgacagagcgagattctgtctcaaaggaaaaaaagaaaaaagggaattgttaattgagacaaggtctgactgtctcccaggtatagtggcgcaatcacagctcactgcggcctcaacttcctgggctcaagcaatcctcccctctcagcttctccagtagctaaggacacagatgtgtgccactatgcccttctaatttattattgttattattttgggggtagagacagggtctccatacattgcccaggctggcgttgaacaactgggctcaagcaatcctccggatttgacctcccaaagtgctaggattacatgcatgagcctctataccaggcccatatttgagttcttaaccctggctttgccacaggctaaccatgtaaatttgggacagccctttcatctctcttagtcacagtaatgacctctaaggatacttgttcagttctaaaattatggttaagtaaaaaacattcttcaagtcacatcctatttagagaaggtgcacctatccatctatttcaaagcttataaagacgatgtgtttagggcttcaacaacacaaaacattattacggcaaatgttagatgctaatctaaagccttccttacccatcaaatgaacccatcccaggcttgttccctactactccaacaggaaagtcatgcagtaagtatgctgtcccctcatggctcctgctagagcctgtgctccactctgcccctgtgcctttgctcatgagatcactgatcccctgcttgaaatgtctcctccctgatccaattccaaagccaccacttgggcctcatagcttccacagaacctctctgatgactttaatgctcattttccactacttagctcttttaccattcactgttactaggaaagaatttagtccttaagcacatgttttcctgttagtctttttttaaaaaattaaaaagcctttaagtattctatttatcattaaaattttcattattttacatgttagtaagtgaactcattaatgtttaaaaagaaaatactgtgcttttactacttttatttcctcacaatgcctagctaactgcatgagacagaatagtattcaataaataagttgctatcaaattatcacaagatcattatttgggctaaatgatgtaagttaaattcacattatacaccaaacttcttggaaagtgatttgcatttattataaagagcataaggttggtgacataatgtttttttttaaaaaagcataaggaattccaaaataatttaaacaatagcctatcatttctaagatagacattaaaaactctgattctgcttatatttcttactcatggtaagaaactgtaaagaaatagttttttttttttttttaaacaaccacctcttgatcaaaaaataagtttttaatcagagaaatgggtacattttcctcacccctcctggagaaggagcatgaaagtctgttttttgttgttgttgtttttttcatttttttaaaaatttttttgaggtggagtctcactctgttgcctaggctggagtgcagtggcatgatctccactcactgcaacctcccaggttcaagcaattctcctgcctcagcctctcgagtagctgggattacagatgtgcaccaccatgcctggctaatttttgtacttttagtggagacgaggtttcaccatgttggtcaggctggtctcaaactcctgacctcaggtgagccacccgccttggcctcccaaaatgctgcaattataggtgtgagccaccacacctggcccaaatctggttttaagatgcagaattttgctggttattcccttccacagggtgcagcacagcctggagcagctatctcaacagcaaagttcagaatcaccagtcccccgccaccattattattaaggagcatgtttgaccagaggctcactcccacatctttattcaatactgctgacctagattttgttcttaaaactacacagcagaagcaggcaaactcccctgtagaaacaacagccttcagaataaattttttagcatacttgcaatctactcagagagtctatttcagtaaaactatggaaaatgaaattctaaacaagaagcaatttacataatgcagtagaaaaaatacttaccactaccactggccatccctagagactttgattctcctataaaagtagaatggggaaggacaggggacagttttctatctctgtgaaattgaaggcatttaacagaaaaggcatatggctaaacacttaaagtactaattaaacaagtagcatatctacatatcaaaactagactaattctgtcacatatgatccattccaagtgcaagatagactaatggattttaaataacagtacaaaaagttcattgatatggtttcagattccccattgcaaacaacctttaagaaactaccacttggctaggtgcagtagttcacccctgtaaaccacagcactttgggaggctgaggtgggagaactgcttgagaccaggaatatttttttcatttttggagacagagttttgctcttgctgcccaggctggagtgcaatggtgcaatctcggctcactgtaacctctacctcccgggttcaagcaactctcctgcctcagcctcccaggtagctgggattacaggcagccaccaccacacttggctaattttttgtatttttagtagagacggggttttaccatgctggccaagctggtctcaaactcctgatctcaggtgatccacccacctcggcctcccaaagtcctgggattacagcgcctggccagagcccaggaatttgagatcagcctgggcaacataatgagaccctatctctaccaaaaaaaaaaaaaaaaaaaaaaaaaaaggaagaagaagaagaaaagaaactaccatttgtgaagttttgatgtcaaatcaaatacccatagttacctggaaaaaaaactgtcaaaatattcctcctcctaactacatatttgtgtgaaatggattttcttcatatactgcaacccaaacaacatattgtgacagactgaatgcagaggcagatataaaaatacagctgtgttctattaagacagacattaaaaagatttttaaaagcgaaaccatggctgggctcggtggctcacgcctgtaatcccagcactttgggaggccgaggtgggcggatcaagaggtcaggagttcgagaccagcctggctaacatagtaaaacacagtctctactaaaaaaacaaaaacaaaaaaaaaaaaaactgggcatggtggcgtgtgcctgtaatcccagctactcaggaggttgaggcaggaggactgtttgaacccgggaggcagaggttgcaatgagctgagatcgtgccattgcactccagcctgggcaacagggcaagactccgtctcaaaaaaaaaaaaaaaaaggcgaaaacgctaccactgttcttactaatctccttcatttttgaaactatacttctcaataaaaatattgtttattattactttttaaaatgagataagtatttttcaggtttctccagttttagtttgataaatagatataaccctcacaaacacaagctctttgggggtctttactaagggctgtgctagtatttggtctctaaactcctttacagttttagaagtctgttagtccaaatccctatatactccagtgcaagctcacacttctagcctcctacagccccgttcttccctctccccattccctgcagaaagtcaagaaatccaagacaaagttcaggcttcattatgcttttgggatagaagcttagccatgtgagaaatgaaaaaatacacaacacagtatctcattaagagctaaacttaatcataaagacgttaaaatggcataacaataaaaattaagaaaaattaatgctggcaaaggtgcttcacagaaaagaaaggggaaaatgtctgaatgtggtattttcatttactactgacagttttttttaaattaaaaacttttttttctatttatttttagagatggggtctcactttgttgcctaggctggagtgcagtagctattcacaggcataattatagctcactgcagccttgactgagctcctggccccaagtgattctcccacatcagcttcccatgtagcagggactacaggtacatgccactgtgccctgacaatcaccactgtttttgttttttgttttttgcttttttcatgcacacagggataccagttactgttgacattgtaagtaacacatgtgagaacatcttagattattagatcaaacaaaggtgacaaggaaaatacgtgtatattcatatacatacatatcttacagaatgctaaaatagttgtggtaaaatcgtattgattgttgaatctggaaaaatgtataaagttctttcaacttttctataaatttgaaattatttcaaaataagctgggcatggcggctcacacctgtaatcatcgcaatttgggaggtggaggcaggaggatcgcctgagcccaggcattggagaccagcttgggcaatgtagcaagaccccaacctctacaaaaaaaatttaaaaaattagccaggcacggtagtgcacacctgtcgtcccagttactttggaggctgaggtgggaggattgcttgagccaggatttcaagattgcagtgagctatgatagaaccactgtattcctgggcaacagaccaagaccctgtctccaaaaacacaaaagaaaaaaaactttcaaaataaaaataaaagtatttcaataaaaaaagtgacaggagaaagcctactcctttctcagattttcagccgactccattttttataattaaatagatccaaatgttcatatccaactatattagcgtccttctccactgtattaaactagcaaaaagcccactaacctttcttgatttaaaataatattttaggccagatgcggtggctcatgcctgtaatcccagcactttgggaggctgaggcccacagatgacatgaggtcaagagttcaagaccagtctgacccatgtggtgaaaccccatctctactaaaaatacaaaaattagccaggcgtgatggtgcatgtctgtaatcacagccactgagactgaggcagaagaattgcttgaactcgggaggcagagggtgcagtgagcccagatcccgtactgcattccagcctaggtgacaaaacaggactctttcccccactctccccaaaaaaggcttcaaacccatctcaattaaaaaaacaaaaataaattaatgatatttgacatccctacaatggttggaagactctgagtttagccctctagcaatatttgaaaacaccaaggcatttgaaggaaatctccagcaggaaggagataactttaagatcacatagcacacttgttttgcttcaaccagaaattctgctggatgtgtctcagagtggccacaggtgaaggatgctaccctgagaccacaatacaggctaagttggcagtagctgagctgtcaactcagaatactgaatagtttcagtattctacctcctacaacacttgatttattatcatactgaatgtacttgttcctataaacacacctctctacacaacttcctataaaaacatgtgtccctggcaaggcgtggtggctcacgcctgtaatctcagcactttgggaggctgaggcaggtggatcacaaggtcaggagatcaagaacagcctgatcaacatggtgaaaccctgtctctactaaaaatacaaaaattagctgggtgtggtggcacacgcctgtaatcccagctaatcaggaggctgaggcagaagaatggcttgaacctgggaggcggaggttgcagtgagccaagatcacgtcactgcactccagcctgggcgagagagcaaaactctgtctcaaaaacaaaaacaaaaacaaaatgtgtccccatgcaacttcctttctcattctccacagtctgttatacatactttcttttccagctcactccatccaaaatatagtattttactttatagaaaatgatattatatgactgctgtttcctctaccataaatttatctacatcagagtccatcattacttctttccttcctatttatgagaaaaatataatcccccatttttatttctttttaatttggggaaaatgctaaaccagagaatatgcaaaatacacgtgattctcctttccaaggacagcaaatatgccctttatcaccttcttgccacccagtcctccaaccttctagacttaatttttcattccttctctcctcatttctccccctctggctatgagcacagttaaatctctggcatctttaaaacacaagtaaaatccaaactgtttatatatatatcccctatagaagaatctatggattaaaataaatttagattctaattctaacgagctagttttttttttttaattatgagataactggtgaattgaatactgactggatatttggtactagggaaccggtgtgtgtttgttaatggtattgcaattatgctctaaaaaggaacctttttttttttttttttgagatacatgctaatataaagatcaaatgatctggggtttgcttccaaaaaacacctagggttaaatggagggagtgattgggaacagatgaaatcagattgctggccaggcgcggtggctcacacctgtaatcctagcactttgggaggctgaggcgggtgaatcacctgaggtcaggagttcgagaccagcctgacccacagggtgaaacccctctctactaaaaatacaaaaattagccaggcatggtggcatgcgactgcagtcccagctactcgggaggctgagacaggagaattgcttgaatccaggaagcagaggttgcagtgagctgagatctcataaatgtatgtcatgagaacctatgcatacatttaaaacatgtagcataggttctcataatgtatgcataagcaacctatgcatacatttaaacatctgaatacaagatacggttcctccattctctgtttagtcctttgagaacaaggactgtgtctttctcttcactattcccagcaccatgtatctggcctgatacctaggtggtgcctaataaaggatgttgaatggagaaatgattgtaatttggaggggaaaaaattcatctggagataaaaatactggctggtattcttatgagtttttcttaaaagatgcaatctacaaattaagattcttctttttgcaacacctttgttctactgaattttatttactttttttgctgaatattaaaatattataatttaatattttttatttttttggaggcagggtctcactctgtcacccaggctggagtgcagtggagcgatcttggctcactgcagcctcaacctcctgggctcaagtgacctcagtctcccaagtatctgggactacaggcacacatcaccacacccagctaattttttgtatttttctgtagagacagggcttcgccgtgttgccaagactggttttattttattttattttttttgagatggagtcttgctctgtcgcccaggctggagtgcagtggcacaatttcggctcactgcaagctctgcctcccaggttcatgccattctcctgcctcagcctcctgagtagctgggactacaggcgcccgccaccatgcttggctaatttttttttttttttgtagttttagtagagatggggtttcaccatgttagccaggatggtctcgatctactgaccttgtcatctgcccacctctgcctcccaaagtgctgggattacaggtgtgagccaccacacccggccccataacttaaatgctcaggactattacactaatttagtttaatttatactaaactaaatcaacacattctaagaaataaatttgcctggtcagagtaggccaaaacaagagtaaaataaacaactattggctgggcatgatggctcacgcctgtaatcccagcattttgggaggctgaggtgggcagatcacctgaggtcaggagttcaagaccagcctggccaacatggtgaaaccccatctctactaaaaatacaaaaattagccgggtgttgtggcacaaacctataatcccagctactcatgaggctgagacaggagaatcgcttgaacccaggaggcagaggttgcagtgagccaagattgtgccattgcactcctgtctgggtgacaaaggtgaaactccgtctcaaaaaaaaaaaaaaaaaaaaaaaaagaagcaactattaacaattatgtcaggataatagacataataaaccagggctatcatatatctatgatgtgatatacaaaacaggaattccctttaaatgtcaataacttataatgaaccctatttctattttcacattctgttaaacaggttaagcaggttatatttatgaaagtatttaaattatgccagaaatttaaaagtttttggtttaaagccagaaaaatgatttacaagtagccataatcaaaatcaactgtggcagaaatcacatgtaaacattaaactgtattcatatccacgctcaattttcaatggcttcaaacccattctaccaattgactccaggcaactataggtaactgagattctagctctaaactgaagaagaaaaaccactttcccaagtacagcaaattatttaaggatatttaatatcctccttatagaagattattagaatcctaaaacattacaagaattaaggaaatttatgtccaaacattgtacttttttcttgtctttggttccctcagattctgacagatttcttcacacttgaataagaagtctgccagcagggtcagtgggtccttggaggggttttccactccctttttaccccttcctcctcctggcacccagctggacttgtggcccaatctcctaccccaaggcagcagagccacattcagccaggtagggattttgattttaatccctggtcctctcattcaacactcaaccttgggtacctttctttcctactctgcctcatttcctcttagtgtacaacaagggaggaaaggccaaatcatctgccagaactctcctagaagagagaaatctcaagccgggtgtggtggctcatgcctgtaatcccaccactttgggaggccgaggagggcaaactgcctgagctcacgagttcgagaccagcctgggcacaatgaaactgcatttctactaaaatacaaaaaagttagccaggcgtggtggtgggcgcctgtagtcccagttactcgggaggctgaggcaagagaattgcttgaacccgggaggcagaggttgcagtgagccaagatcgcaccactgcactccagcctgggcgacagagagagtctcaaaaaaaaaaaaaaagaaaagaaaaaagaaaaaaagaaaagaaaacaaaaatctctgcttctttgcattactaataggtaattaaaggctatgacaacaatacttgatgcagcaatttgctttctaccttgaaacatgcaataaatacacaagtctatgtcttttgtacccactggtcataaccatgacctattctttctttttttttttgtcatggagtttcactcttgttgcccaggctggagtgcagtggcacaatcttggctcactgcaacctctgcctcctgggttcaagcgattctcctgactcaggctcccaagtagctgggactacaggtgcccgccaccacgcccggctaattttttgtatttttagtagagatgggatttcgccatgttgggaaggctggttgacctattcttttttttttttttttttcttgagataggtagggtctcagctctgttgcccaggatggagtgcagtgttgtgatcataattcactgcagtctcaacctcctgggctcaagcgatcctcctgcctcaacatatggagtagctgggactgtgggcatgtgccaccatgccaggctaatttttgtagagacaggtctcactatgttgcccaggctggtctcgaactcctgggctcaagcaatctttctgcctcagcctcccaaagtcttgggattacaagcgttgagtcaccacgcccaacccataattgtgacctattctatagaaaggggtgttaacagtgtgtacaaacacataccaagtcatcagaagaggggtcaatccatgctctggcaggtgatcaattttcttttttttgagacagagtctcgctctgttgcccaggctggagtgcagtggcgcaatctcggctcactgcaacccccgcctcccaggttcaatcagttctctgcctcagcctccctagtacctgggattacaggtgcccgccaccatacccaactaatttttttgtatttttagtagagacagggtttcaccatgttggccaggctggtcttgaactcctgacctcattatccacctgccttggcctcccaaagtgctgagattataggcgtgagccactgcgcccggccgatcaattttcttaaaccaaatcaaataaggtgtcctttaactcagccactcagaattctacattaatccatttcagttggttgactaggtcaaactgcagtttttctttcactaatttggatgaatctaacataaaaaagacaacaatttaacgctatcttgagctgtaatcacttattcattcaactatcccttaagtacatatactacgtgccaggttccatttaggttctagggataaagcaataaaaaatcaccacccagctgggcacggtggctcacgcctgtaatcccagcactttgggagcctgaggcgggcagatcacctgaggtcaggagttcaacaccagcctggccaacatggtgaaaccccgtctctactaagaatacaaaaactagcccagtgtggtggtgtgcatctgtagtcccagctactcagaaggctgagacaggagaattgcttgaacccaggaggcgggggttgcagtgagccgagattgtcccactgcactccaacctgggcaacagagcaagactgcgtcccaaaaaaaaaaaaaaaaaaaaaaaagaatcaccacccatagagagcttacattcttggcaagcaacatcaacaacatagtaccaggaatgatgcggagtggggtaggtatcctgctctacttatgctggctaaactacatctggaaattgtattccattctaggcataggttaagaggtatgatatattagttatcaatttattgcctttcagttccaaatctatactttactgctctgctttgcaataatgaagctggactcttcaaatgtttttcttatgccaatagcaagcactggaggaatactacaggaggaagaggatttcctcctggttccactgtgttttcctcttctttctcccgtggcctcatgtgatgcgtgggacacccagcggtgctcacccaccagttttagggataccacaatgagtggcttcaggtgagttccagtcaccccagctaacttcccagtgattttcgacagcaccacccagagcagcttcctagacagttttgttggcactccagcaaacaatactcttgcttttaaccctcggctggtgccatcctcaggaacttaaaactgcaacagactacagctttacctcctcaaaaggtctgaatctccgccttgggtaggctctctctccaatctgtctctttctttcatactctgcctcaggcacagagggagtagctgctcctatagctgatacacctacatctttcagagttctctttaccctttaatggttaatctattactagttaataattctttatgttaactttcccttgttcaaattgcaatatttctgtttccagactgaaccctgatccagaactggtacaaaaagtagggtgatctcagaggacggacttaaaaacatgggatttagaaattggtttggtggcactcttgggtttaagtgcagtgctaagcaccttgccaatgggaaaggggatgctagtaatccaggacatgcaagatcgtggcaataatatactggcaaaaaccttcagaacatgtgtaggagtagatcatatagctggaggtggctctaacagttcacctcattggttgactgaaattttagactcgagtaaattatgtttaaaaaaaaaaaccaaaaacaaatttcagctgtggcacatgactgggcttggtggagtttcaagatgctgatgaatttaaggtctggcgcttgaaagaatcagtgaagcttttcaagtagatgagatatatttgaatatgtaacctttagtaactacagaatagaggttgctttttttgtttttttggtccctttcataggggtagcaggggtgaattctgaggtggccccaatcatctgtaggaatattcacctgacagtttcgtgtttctccccatagctgagttggtcttgtagaaaatttctacggaattcaattccattatttaaagtagcttttctatgaaccagctgtggtctgtaacttgacagtgttaataccaaatagcaagacctaatcatggttcacatactcaacaaatatataagactagtttttcaagtaggtcagttttggaacacattaattgtaactagattagctattttacaattaagacaactttataaactgctttaatttataaaggttttaaaattacattcttttgactctaaagattgttgttttacagcatattcttaaatactactgttgagccatatatatgacaatggtgaactttaatgaatatctgcacatctgtagtaaaatgcaatgctaccttcatttttttgttggtatgctgaagaaactttttaaagtatctcactttttaaaaaattggtcagaccctctccctctccctcctctccctcctctccctctccccacggtctccctctccctctctttccacggtctccctctgatgccgagccgaagctgggctgtactgctgccatctcggctcactgcaacctccctgcctgattctcctgtctcagcctgcctagtgcctgcgattgcagacgcgcgccgccacgcctgactggttttcgtatttttttggtggagacagggtttcgctgtgttggccgggctggtctccagctcctaaccgcgagtgatccgccagccttggcctcccgaggtgccgggattgcagacggagtctcgttcactcagtgctcaatgttgcccaggctggagtgcagtggcgtgatctcggctcgctacaacctccacctcccagccacctgccttggcctcccaaagtgccgagattgcagcctctgcccggcagccaccccgtctgggaagtgaggagcgtctctgcctggccgcccatcgtctgggatgtgaggagcccctctgcctggctgcccagtctggaaagtgaggagcgtctctgcccgcccgccatcccatctaggaagtgaggagcgcctcttcccggccgccatcccaactaggaagtgtggagcgtctctgcccggccgcccactgtctgagatgtggggagcgcctctgccccgccaccccgtctgggatgtgaggagcgcctctgcccggccgcgaccccgtctgggaggtgaggagcgtctctgcccggccgccccgtctgagaagtgaggagaccctccgcccggcagctgccccgtctgagaagtgaggagcccctccgcccggcagccaccccgtctgggaagtgaggagcccctccgcccagcagccaccccgtctgggaagtgaggagcatctccacccggcagccgccccgtccgggagggaggtgggggggtcagcccccccgcccggccagccgccccatccgggagggaggtgaggggcgcctctgcccggccgcccctactgggaagtgaggagcccctctgcccggccaccacccagtctgggaggtgtacccaacagctcattgagaacgggccatgatgacaatggcggttttgtggaatagaaaagggggaaaggtggggaaaagattgagaaatcggatggttgctgtgtctgtgtagaaagaagtagacatgggagacttcattttgttctgtactaagaaaaattcttctgccttgggatcctgttgatctatgaccttacccccaaccctgtgctctctgaaacatgtgctgtgtccactcagggttaaatggaaaaaataaataaataaattaaaaaaaaaataaaaataaaaataaaaataaaaaattggtcagatcgcgagatcaggagttcgagaccagcctggccaatatggtgaaactctgtctctactaaaaaatacaaaaattggtcgggtgtggtggcatgagcctgtagtcccaactactcgggaggctgaggcagaaaaattgcttgaactttggaggcagaggttgtagtgagccgagatcgcaccattacactctagcctgagtgacagagcaagactccatctcaaaaaataaataaaatacaaaaaaaaaattggtttgtgtattttatatgcttacatatttttccatggtactgtaggtcattttagtgattaaatttgacacttttgacagaaaaacaggtcaattagttccttgggatcaaaaaggggttgattgcaaaggggcaggagggaattgatagagtgattttacaatggttctgcatcttgagtatggtatgactatgcatttgtcaaatcttagggtgaactttactgaatgtaaattcatgcttcaataaacaggactttaaaaacttacaaaaaaaaacacaaaacaacaacaaaaggactgggtgcagttcacacctgtaatctcagcaggggggccaaggtaggaggcttgagcccaggagttcaagcctagaatgagcaacacacagagaccccatctccacaaaaaataaaaaattaaccaggcacagtgtcacatgcctgtaatcccagctactcaggaggctgaggaaggaggactacttgagcctaggagttcgaaattacagtgagctatgatcacgccactgcactccagcctgagtgaccgagtgagagcctgtctctaaataaataaataaaactttctttaaaaaagagtccactatgtttaatgaggtggagatgccaaagtttccctagcaagatgtagaagaggcaattcaaaaacttagggagatagaaatgttggaatggatttttcatgtgtaacctatgttgcaaaaaaaagctcggaagataatcctttcactcaggcattgagaaatccattagtgaggtgggcatggtggttcacacctgtaatcccagtactttgggaggccgagccaggtggatcacttgaggccaggagttcaagaccagcctggccaacatggtgaaaccccgactgtactaaaaatacaaaaattagccaggtgtggtggtgcacaactgtaatcccagctacttgggaggctgaggcatgagaattgcttgaacccaggaggcagaggttgcagttagccaagatcgtgccactgtactccagcctgggtgacagagtgagactctgtctcaaaaaaacaaaaaaaaaaacaaacaacaacaaaaaaagaaatgcattagtgaggggatcaccttcatccttgaaaagctctgtggttgctcccctttgcagtgtgtccctgttcccctagacatgggttggcaaactttatttataaagggccacagataaacattttaggttttacagtccctaaggtctctgtcacaacccctaggtatggccatgggaaatgccaccactaagtgggttccctgatttaaaggggtaacgggatcctaaaataacagaggccaagtagcagcatgtaatcaccaaagacaaggtgggaaatctactataaatacagtaaagttgtactggtaatcagaacaccttggcccaccaggatctttggcagtaattgatcacacagtattccacaagcagcctaccaaaacagattcatctgtacaactgaaaaaaactccagctctggtagtaaaaacctgactagaaaagttttgacctctcatctaatttctagacccaagtcaattaacaagcccaggtcccctgaggaaaaacctgtagtgttcccacaagtacaagtacatactgtaaatcctcatccaagcttccccaaaggccatttactagagtgactacggattagagaaaaggaaatacccagacctttcagggattactaattcctggggactcaaaatgctactgtggcctatcagtcaaagtgagtgctgacagtggtcaggtaatagatgaaatgcttagctcaagtccacctcacagtggaccccatagtacaatgggcctactttgttgttatctcctcagttcctgaataaatacttggaacagacatacttgactattggcagagctcccatattggctttctgacccaactgataagagtcattttaatagtaagggctaaatggaagcccctagaacttaccctccctactaagatattaagccagaagcaataccacatctcaagaattaaagagcttaatgtcaccatcaaaagacttgaaagaaacagggtagtgatacctattatatcttgatttaactcgccagtttgtcctgtgcagaagtcagatggatcttagtgactatcataaactcgtggactatcataaacttaatctggtgatgattccaattgcagctgatgccccagatatagcatctttactggagcaaatcaacatgggtcacggcacttggtatactgctattaacctgaataatgcctttttcttcatacaaatctgcaagaaccaccagaagcacattgcttttacctgccttttacgtgcctatgaatctagcctcagggctatgccattctcctaccataatgtagcccacagagatcttgatcgcgtgacattccaaaaaaataaataaataagcacgtacacacacacacacacacacacacacacacacacacacacacacactagtcaactatactgacattatgctaattgggtctgataaatagcaagtagcaaatacgttagatgctttagtaagacatatacaaagtagttgatgcgagataaaccctacaaaaattcagagacccactgcagcaatgaaatgtcaggattcaattgctcaaaacatgtcaaaatttcccttccaaggtgattaagttgctctaattaacatcaccaacaatgaaaaagagggtacaatgtttggtaggcttcaacccagctacaaagttacctacaaggttgacagtttagagtgggtttcagagcaagaaaagattctatagcaagttcaagctgtggttcaagctgctctgccatttgggccttatgatctggcagatccaatgatacttgaagtgtccatggcaaatagggatgctgaatggagcctttagcaagcaagaataagagaatcactgcccagacttctagaattttgagaaaatctatgccctcttttgcagaaaattattcacctttcaaaaaatagtttcaggcttgctattgggtcttggcagagaccaaatgcctaaccatgggacataatgcaaccacgtgtcctgagcttctcatcaggaactagatgttatccaacctatgtagtctagcttggcatgtgcagcacgatctatcatcaagtgaaaaacacgtaaaaaaaaaaattcaagcaggtccagaaatatgagtaagttacataggaggtagctcagacttcagcattgagttctgttgcattgcttcctctccctcaatccaagtcaatggcctcctgagagctccatatgaccagctgactggggaaagaaaaaactcaagtctggtttacacatagctctgcacaacatgccagtatcacccaaaagtggggagctgcagcactacagccccatttaaagaggtaggactgaagggcagtgatgaagaaaaatctttccttcagagggcagaacgttgaggggtacatttggttttcccttttgcctgaggtaagacatggccagaagcagagatttatactcatttatgaacaattattaaggattttgttggctagttaggaacttggaaggaaatggtgacaaggaaatctgggggaaagatatgcagatgaaactctcagaacaggcacagactgtgaagatatttgtgtcccatgtgaataatcatttgcattcactgtagaggaggctcttaataagcaagttgacaaaatgacgtacttcatgaatataaatgttagacactttccatagctacaagagtgcttgctcaataaaacccatggaaaaaatcatcatgaaggctgtgcatggactcaacaacatgatcttcccctaaacagggctgacctgactaaagctactgctaaatgtctaatctgttaatggcacagactaactctgagccctgaatatgcaccatttcccaaaaactagctaaccacctggtggcaagttgattacgctggacttctattatggggaataagggcaggggtgagggaagagatttgtcctcactagaatagacatgtattctggatacagatttgccttctctgcctataatgtttttggcagttccaccacccatgaacttatatataagtgcccaatctaccaccatgacattccacacagtgttgcggctgcttctttttttgagatgaggtctccctctgtcgcccagtctggagtgcagtggcacgatcttgtctcactgaaacctctgccttctgggttcaagtgattctcccgcctcagcctcccaagtagctgggactacaggcatgtgccaccatgcccggctaattttttttgaatttttagtagagatggggtttcaccatgttagccaggctggtctcgaactcctaacctcaggcaatctgcccgcctcagcctcccaaagtgctgggattacaggtgtgagccaccatgcttggccaaaaaaaaagatgtatttttaaaatagagacaaggtctcactatgttacccaggctggtctcaaactccttggctcaagtgatcctcctgccttggcctcccaaaatgctggggttacaggcatatgccaccatgccaagcccacacagcattgctcctgaccaagaaagtcatttcatagtaaagaaatgcagaaatgggctcatgtccatggacttaactggtgttgtcacatcctatcacacagaatggttggcctaattaaaatagggaattgattactgaagactaagttacagtttcagggagacaacaccctgaaaggatggggtaatgatttcaatcagagacaccttacatggtgctgtctcctccctcaatcagaatatacaggtctgggaatcaaagggtagaagtatgtgcggctccactcactattatatctagcaatcactgaatttttgctttcactcctaacaactgagttctgctggcttggaagtgctagtccctaagcaggaaatatatctactagcatacacaacaatggttcaattgcattagaagatgagactgccacttggctacttgggactccttacaccactgaaccaacaggctgaacctactggttgggaaagattgagcccaattgtcaaggggaaacggttgctgctacacagtgaaagcaaggaggactatgtctgaaacccaagggattatctaaggcacctcttaatacttccatgccaaaaataaagattaatggaaaactacagcaaccaaaaaaggactggactaatgagggaataaatgtttgagtcatttcaccaggtaaagaacctcaaccagctgaggttcgtgctgaaggcaagggaaacatgaaataggtaactgaagaaagaagcctagatatcaactgtggcctcattactaatcacagaaatgaggatgaactttctctttgttatatttggtatttgtttgtatattctaaccattttcttctttccttcttcccattattataagttggaattagttcagtttagttttgtttttttgagaccgagtctcactctgttgcccaggctggagtgcagtggtgcgatcttgactcactgcaacctccgcctcccagcttcaagtgattctcttgcctcagcctcctgagtagctgggattccaggggtgtgcaccacacccggctaattttttttttttttttttttgagaccaagtctcactctgtcatcaggatggagtgcagcggcaagatctcggctcactgcaacctccgcctcccaggttcaagcaattctcctgcctcagcctcccaagtagctgggtctataggcgtgcaccaccacacctggctaatttttgtatttttagtagagacggggtttcaccatgttggccaggatggtcttgatctcttgacctcgtgatccacccaactcggcctcccaaagtgctgaaattacaggcatgagccaccgcacccgccttgaaattagatttataatacaacttttggtaacaaactagtcagtggaactttgttttctgccacatgaaaatctttaaagcttatgctgacgcatatctgaatgcttgtcatcaaagtgtgcagtaaaaaaaaaaaaggcagtttaagaaaatttgagcatttcaaagaaagcacttttaaaaatgtatatacatgaaggtggccgggtgtggtaactcacacacctgtaatcccagcacttttggaggccaagcgggtggatcacctgaggtcaggagttcgagactagcctggagaacccccgtctctactaaaaatataaaaatcagccgagcgtggtagcacacacctgtggtcccagctacttgggaggctgagaggcaggagaatcgcttgaatctgggaggcggtggttgcagtgagccaagattgtgccactgcactccagcctgggcaaaagagcgattttcaagggaaaaaaaaaaaaatgtggctgggcgcagtggctcacgtctgtaatcccagcactttgggaggccgaggtgggcagatcacaaggtcaggagatcgagaccatcctggctaacacggtgaaaccccgtctctactaaaaatacaaaaagaaattagccggacgtggtggcgggagcctgtagtcccagctactcaggaggctgaggcaggagcatggcgtgaacccgggaggtggagcatgcagtgagccaagatcgcgccgctgcactccaccctgggcgacagagcgagactccatctcaaaaaaaaaaaaaaaaatgtatatacatgaagaacattttgctatatcatgaaataaatgtagcgctgtaagataaaggaagatgaatataaatggagttttggccatttttatttttttttgagatgaagtcttgttctgttgcccaggctggagtgcagtggtgcaatcttggttcaatgaaacctctgcctcctgggttcaagcaattctcctgcctcagcctcccaagtaactgggattacaggcactcaccaccatgcccagctaactttttgtatttttagtagagacagggtttcatcatgttggccgggctggtcttgaacttgggatctcaagtgatccgcctgcctcgcctcccaaagtgctgggattacaggtgtgagccaccatgcccgggcagagttatgcccattttgcccctccacatgctgcagccatctttaacctgtttaacttaatgattatagttttgtttttcttttttcatcttattcagtatatttcaggctattcagcagatgcttgtgattctggaggttcaaatcactggtaaaagtttattctgtttcctcagtttttcaggagcttttctccattaaatgatctgctgcctaaagtaccctctgtcttcctcatcaacaggcgctaaattcaaaaagtaccttactgaaacttttttgttcataactttcattgttggagttaggtcatatcctgctaacaacagtcttattgatcagttgtaaccccatatgttgtgtttttattcttacttataagaggtaaatttttgtaacagtcacatcctttaaatgatacttcattatattcaaattctatatgtagacaatcttcaatgcccacttccatcaggatagctggcaagttggtgaacagtaagatcacattctttttaccaagtctgtcagtcttcttactactaacacttcaatacatcaagaggacattagcaccaatgtaagattctcatgacttttcaacatgtataaattccaaatgacaacttctgagtcagctctccaggtaaggctagttctttcactaggtttacaaactcttgaatattactcttatcatagaaaagttcaatttgacgtacaaattcaattctaatgttgtggtgctctagctctttctagactctttcacctttcctgaaacagattctccatcatagaggagatggtgtttttctacttcgccattttcagttttcacttctgccattttctttgtttccttatcattaaggacaatatcaatctcacaaatcagaccaaaaaagcctccaaaaaacctcactgtcagtgatactgccacatcccccaatacttcactcctcttccctcagaactccaagcccctggctcccatcacatgaccttggccctctgaagctggaacttctatttgaggactgataaacagccagcaggccaagcacagtggctcacacctataatcccaggacattgggaggctgaggccggaggattgcttgagctcaggagtttgagactagcctgggcaacacagcaaaaccctgattctattaaaacaaacaaacaaacaaaaatatagccagcaatggatacaatgactatggggctgagcatgtcctcattcctcattttagaacaagggtgagagtttcaccctctgacatagctgtatcttgttaggtagaaacataagagtttcattgttatatgggagctcaaatgtgtgtaaagtgcatatggaagctaagtagccaaaataataggctatgcaagtaatcaatatattgcctctcaattccaaatctacctttcattgccctgcctgtaataatgtaaacatttcttcctagagagcgggcatgatgacactaagcttagtagagggcatggaaggaaagggtttctcttcctggttctagtgtgcttttgcatcttcttacttccatggtgctctgctggtgtgcagaacaccccatggtgctcatcccaacaagctttagtgggcattctcatggacatcttcccaggcaagttccaccagtgcctcaaacaggcttgctggtgatgccgcagcacccccaagtacagcttcctgcttaactacctttgaggtagaagaccagcaggacttaatttcctgtcgcaccctgctgattggaacaagatctggctgaaaccagcagatgctgacaaaagtaacctcgagttgccctcagggtttattagcataaagacactcctaccagtgccatggcagtttacaaatgccatggcaacagcctagaagttaccttatctgattcccagaaacttccagccccttttccagaaagttctaaataacctgcctcttaattagcatgtaattaataacagatataaacagctagctagcagctcacagacaccgattctgggcacactgcctatgggttagccctgctcagcaagaagcagcactggttcaataaaagtttctttctctcactactggctcacccttaaattctttcctggcaaagccaagaaccctcctgggttaagccccagtctgggggcttgtttgccccacatcaccctgacctgcagcaactcagcaaacatctttactaccaaatggagacttcctccaagatatgcaatcagctttgggggcagggtgggggaggggcgcatacttttccaaatttgttatttctttgtgtactctgccccagccctaagggtagtgactattccctatatctgtcattcctgtattctttagagttctctttacccctatagtaaattctctgttcaatttatggtgtagcttctgtctcctgaatagactctgatccaaatattggccattaaaaacagcataaatctacataataggaaagagtggaagaaaaaatgaaagatgtttaacccaaagaaaataaatcagaaggcaaatgttaatctctaaatgtctaaaaagctatcacctaccgcagaacatactgtatctctgttgctcagcactaacagcagcagcagaaacagcagaatgcctgttcgttttacacagaaaaactgaagaccagaaatattaatttgttaaatagaaagcaaaatccttcaatgaagacctctaaggagtctaatgttaatacttaagtttacagttgacatagttttgcatcttctcatttcattttaaattgctgaaaacccactggagggccaggcttgccagttttttgcagtgagagtcctaagttaattttttcacaagaaacaaaacaaaaaaactcttctttcagtctgcctggagctcacttttgaagtttcacctccagttttgtcctctagaaacagagcatttctgcttcacaatggaccaatatgctccagttacatccgattaaaatactgttacacaaccaattaagtaggaaaaggggctgatggtcaaacagaatgatttaacaaaagtatataatgggttgaactgtaagaactttctatgtggacattaatcatcattctaatatcatcttacatttaaatattaaccccttcaacgaggtttcaaagcactgaaaataatttctgtcacttcaggcaaacaactatttttatagagctctccttttacacagcaggaatcttagcctcaaagagggcaaacaacttgcctaagaaatcaaagctagtaggtgctctatccacagcttcctcaaaatttaaacaaattcatgacagataacatatttccagaaagatgcgtaccaataacctggcaagaattattacgattgtatctggtcttgtttttaagtttcttttcccatgtgaggccagaaacaaatagatattaaagattattcattcaatagctacagaggatctactatccaccagacagtgttctaggtgctgggccacagcagtgaccaaaacaaaagccctgtccctctcataaaatttgtttctataatatcttcttctggtggggaaaggcagatgagataagtaaactatacaaattattagaaagtgacatgacaaaagccacgaagaaaattcaagtagaacagtgggacgaaaaaatagaaggggtgcaatttttaaaaagatagtcgagaagtactcattgagaaagtgaagagtcaatcatgaatatatcaaagggaagaacattccaggcagagaaaactgctagtgctcagagctcaaggcagatgcccacctggcttgttcaaggaacagtagcaagaacaccatgaagcaaagtaagtaaaggggtaactaagaaaagatctggtcagaaagatgacaacgacatcatagggccttgtggtatttcataaggactttggcttttactttgagatgggcaaccactggagggttctgtgcaaaagaacagcatgatcaatgtacaggaccactgtagatgtttttaagaatatgctgcagggagcaagcaaatggaagcagagagactaatttgggaagttattacagtagccaaggttaatgatggtggtccaatcagggagagagcagtggaggtggtgagatgtggtcaggttccaaatatctttttctgacaaactgggtgtggggtgtgagaggagcagaagaggatagggaaaccaaatgtttagccttaacaaccaggacagaatttccatttaaggagatggggaggcaggtggtttttttcttctttttcttctctgttttgattttggggtggggcaatcatgaattcagtttagaacatttcaaatttgagatatcaattctacatccaaatggagatttcaagctcgaatttcaaatttccttagttctcactcaaccccctcatggaatttaaccaatattgtatctgttcttacaaaatgttccccataactgcttagcatttaagcaatgttgacatatttgtgtatttctctctgcaactggacaaaccagaacaaacgtacaaaatacctaacatataaagcatccctttaattctgaagagatctgtgatatgatggttaatttgaaatttttttccctttaaatatgagctgcatttgtttatttctacgattttaacgatttttaagtgtacagttcagtggtattaagtacattcacactgttgtgcaatcatcaccaccatccatctccagaactttttcatcttgcaaatcagaaactttgtacccattaagcaacaccaaacacatccattccccgcctctcccagcccctgggaaccaccattctactttgtttctgtaaatttgactacttaaggtaatttatataaatggagtatatttatatttgtttctgtaaatttgactactttaggtaccgcatataaatttgtatttttgtgactggcttttttcacttagcatagtgtcttcaaggtttattcatgttgtaccatatcagaatttccttcctttttaaggctaaataacgttccattatatgaatgtaccacatttttgtttattcattccatgtgttgatgggacatctgggttgcttccatcttttggccactgtgaataatgctgctacaaacatgagtgtacaaatatctgttcaagtccctgattccaattcctttgggcatatatccagaagttgggttgctggatcttacaataattctgtttttaattttttgaggagccaccatactattttccatagcactttcattttacattcctatcagcagtacacaagggttctaatttttccacatcctcgtaaacacttgttaatttctgttcttgttttcatactagccatcctaatgagtatgaagtgatatttcattgtggttttgatttgcatttctctaatgattaatgatgctgagcatcttttcatgtatttcttggcaatttttgtatcttttatgaagaaatgtttcttcaagtcctttgcccatatttttaatttttttttgttgagctctagaagttatttacatattctggatattaactcctgagaagatataagatttgcaaatattttgcctccatgggttgccttttcactctacagagatagacaaaaattttcaattttcatatagcctaatttatctgttttttcttttgtcgtctgtgtttttggtgtatatccaagaaaacactgccaaatccaatgtcatgaagatttccctctatgttttcttctaagaaatgtatagccttggtgctttgtttaggtctttgatccattttaagttaatttttgaatataagataatggtcccaacttaaaaaaaagagagggagagacaggatttctctctgtctcccagggtgaatgcagcggtgtactttaccatagctcactgcagccttgaactcctcagctcaaaggatcctcctgcctcagtttcctgagtagctgggactacaggcccacactacctttttttttttttttttttttttttttttttttttttgagacagagtcttgctctgttgcccaggctgaagtgcagtggcgcaatcttggcttatgtaagctctgcctcctaggttcatgccattctcctgcctcagcctcctgagtagctgggactacaggcgcctgccaccatgcccggctaattttttgtattttttagtagagacggggtttcaccatgttagccaggatggtctcgatctcctgacctcatgatctgccctcctgggactcccaaagtgttgggattacaggtgtgagccaccgcacctggccaatttttttttcttttaagagatgaggtcttcctatagtgcctaggctggtcttgaactccttgcctcaagcaatcctctcacttggcctcccaaagcgctgggattattggcataaaccactgttcccagcaggatccaacttttttatgtggatatccagttttcccctcatcatttattgaaaacaccatcctttcccattgaatggtcctggtaccgttgtctaaaatcatcttaccatgtataaaagagtttatttctgggctttccattccgttccttgatctatatgtctccctttaagtcaataccacacagttttgattattatagcatttcagtaagttttgaaaatcaacaaatgagacttccaactttgttctttttcaagattgttttgtctattcaggagggctccttgagattccgaatggatttttctatttctgcaaaaaacattgttcagattttgaggaaaaaatatcatcttttaaaaacacatttagggccgggtgcagtggctcatgcctgtaatcccagcactttgggaggccgaggcgggcagatgacctgaggtcaggagtttgagaccagcctgaccaacatggagaaaccccatctctactaaaaatacaaaattagctgggcgtggtggcacatgcctgtaatcccatctacttggaaggctgaggcaggagaattgcttgaacccggaggcggaggttgcagtgagccatgaacgggtcactgcactccagcctgggcgacagagcgagactccgtcacaaaaaacaaaacaaaacaaaacaaaaaacacatttaggctgggtgcagtggcttacgcctgcaatcccaacactttgggaggctgagatgggcagatcactgaggtcaggagtttgagaccagcctggccaacatggtaaaatgctgtttctactgaaaatacaaaaattagctgggcatggcggcaggcgcctgtaatctcggctactcggcagggtgaggcaagagaatcacctgaacctggaaggtggaggctgcagtgagccaagatcatgccactgcattccagcctgtgcaacaaagcaagactccttctcaaaaataataaaataaaatacacatttaggccgggcacagtgactcacacctgtaatcccagtactttgggaggccgaggtgggaagaacacttgaagcaaagagttcaagcccatcctgtgcaaaaaagcaagaccctgtctctacaaaagattttaaaaattagccaggcatggtggtgtgcacctgtagtcctagctacttgggaaactgaggcgggaggattacttgaacccagagttccaggctgctatgatcacaccactgcactccagcctgggtgacagagtaagaccctgcctcaaaacaaaaaaacactttaaatcgtcctaccagcgaccgacatttcaactgctgcttctgaggctcatagttgtagcgatcatttgtgtgtatctttcttatccacaaccgtagcatttttcacaaggaatttatccttgagaaatgtaaaaagcatgtaaaatttaaagctaacagaacttgagcaaacaatagactactcaataataattgttggatactgcaatacctcactttcactaatggatagaacaacaagacagaataccaacgaggaaagagaagacctatataacactatacaccaactacatctaatggacatcttacagaacattccacccgcatcaagagccgaatatacattcttcttcaggacagaccatatgttaggccagaaaacaagcctccatatattgaaagggattgaaagaataccaattatgttctccaaccacaatgggatgaaattagaaagtaaacagaagattggggaatgcacaaatatgcagaaattaacacactcctaaataatcaacacgtcaaagaaatcccaaaagaaattagaaaatactttcagatgaatgaaaatgaaaacacaacatatcaaatcttaagaggtacagctaaaacagtggtaagagggaaatttatagccataaacacctatattaaaagaataaaataaaataaaaatcaccaatcactaacataaccttctaccaaaagaaactagaaaaatagcaaactaaactcaaatgaggcagaaggaaggaaataaaaaagattaaagtggaaataaaggaaacagaggagagaaaatagagaaaactcaccaaaactgaaagttggttctttcaaaagatgaaaaaaattgacaaacttttaactacatttatgaagaaaaaaggagagaggattcaaactactaaaaccagaaatgaaaaggagatatcactatgaatcttacaggaataaaaaaggtttataagggaatactaagaactgtaggcaaacaaattatataacctagatgaaatgaacaaatttctagaaacataaaaactactaaaactaactaaagaaaaaaacgtttgggtggaaaattccaaaactaacatctgtggctatctctatagtttctaacaatgcagctcaagaattagcacctggctaggtgcagtggctcacgcctgtaatcccagcactttgggaggcgaacatgggtggatcacctgaggtcaggagctcaagaacagcctggccaacatgctgaaaccccatctctactaaaaacacaaaaattagccagacatggtggtgggagcctgtaaccccagctactcgggaggctgaggcaagagaatcacaagccctggaggcagaggttgcagtgagccaagatcacgccattgcactccagcctgggcaataagagcaaaactctgtctcgcggggcgcggggagagaaaaaaaaaaaaggattagtaccataatagatggagttccttcaaatttcctctacagagttgaaggatctcatcctctatggtaaggcataagcagacaaatcttatgttaagagaatcttgctttgaagtaacctcttggttagacacttcttgtgcccccacctcacactctgttaagttcactatttattctagctattgctacagcatccagctgcacataggtgtgatttgacagcactttgtatcaaccaaaccagagttttctgccctacaacttctctgacaccaagagacaagacatctgcatcctggcaccacacatgtgcaaatccagaagtacaagagtgttaggcccaggaggcagagcttgcagtgggccgagatcgcaccactgcactccagcctgggcgacagagcaagactctgtctcaaaaaaaaaaaaaagagtcttaagcaatgagagatggtaaatggtgaataaatgttatccacttctataaccaagatactcaggtagtgaacactgagaggcattctatacaggtcctcaaaagaccccaaaagacttaagcccactttgcccacagcagtgactaggtcagtagtcatacttcactgtattcttttcctctaatttcacttttcccagtatcccactcttgtgccctggggccacttcccaaaataaactacctacatgcaaagcccttgcctcaatatggattttctctcagtaactagaacttaagataggttttttaaaaagtctttaaaagctgggcatggtggctcatgcctgtaatcccagcactttgggaggccgaggtgggtggatcacctgaggttgggagttcgagaccagcctgaccaacatggagaaaccccgtctctactaaaaatacaaaattagccaggtatggtggcgtgtgcctgtaatcccagctacttgggaggctgaggcaggagaattgcttgaacccaggaggtggaggttgtggtgagctgagattgtgccattgcactgcgctccagcctggggaacaagagcaaaactccatctcaaaaaacaagaacaaaaaaacccaaaaaacatcagaaggctgggcgtggtggctcacacctacaatcccagcactttgggaggcagaggcaggtggatcacctgaggtcaggagttcgagaccagcctggccaacatggtgaaactccatctgtactaaaaatacaaaaaattagctgggcatggtggcgggcacctgtaatcccagctacagcaacttgggaggctgaggcaggagaatcgctcgaacctgggagacggaggttgcagtgacctaagatcgtgccattgcattcaagcctgggcaacaagggcgaaacttcgtctcaaaaacaaaaacaaacaaaaaaaaatcagaattatattttcacttaaagctcaagaagaagctattttgtcttattcaatacaaagccccaaaagaaactgaaataacgtggcttagagtattaattaaatgcttggcttagaaaaggattgtagtccatgagctggtttcaatggagtcctaaacactctaaacgtaaatgtaacatcttgtatatgggtatatgtggacttttctgaagagaaattctgtatttttattagaaaaccatgaaccaaaaaaactttaagaaacattacgtgctgttaatttgctgatgtgtctccagcatgcaactcattaactggaaaatgaaagaaaagaaataaaactttgttccaggaatttggtggagttcggatggatgtcttgctgtctatacatagcaacataatgtgcagcttatgtctgggctccacttgtgagttatgatgccaatttacagcgtggctccaatagctgttcagaaactctaacacaccacagatttatttatctgttaatatttcacatttttggtgcttttgcatttttctgatgctaaatcctttgcatcctaccagatgagatagtgatgaagcacacagaataccttctgtgtcatgatattctaaaaaagtagatttactgtttcactgctggcatgactttacacatgcaaacagttatcacaatagtaaactgtttacctactctaattacgatggaaacaaccagtaacactgccatttgtacagcacttagtgcaatgtgtctagccccaaacactataaataagagtaatttacctccatggtcgcacagagctttatcccacaaataatttgtagttaagtcttgttaaaccttcactgtaatggaaacggcatcaacataaaattgaggataatacagtattacacatgatttaggaatgaaactaacattctgtgcctgctggaccagtcctgtgtctttgcctagaacaccctctagcctcccaccatattatcaagtcaataaggaggaagaatccaaatgaagccaggtttcacttcgcatcagggatgaggacaataacaaaattcaagaattgcttcaattaccaaaagctttaaacctagggtatgtataagaaagttaatggtcaattattccttatagtatttaaaatctgtgctttaaacctgagaacagattactgagctgttttaataaaaaggaaatctaaaaacattaaattaagtgttcttaactaaaatgtctgccaagcttaaaaagttccttatgctatgcaaattacttagatataaaatatttttaatgtcttaattcagtcaacatattgtacttgcaaccctactgtaaacaaacactaacccagaatggctagggaactgcgcattttgttgaattcttcccagatactgcatactgggttatcaaataacaaagttatcaaattaaatgttactgaatgtagtaaattttatctgataattcaggaggcactttaggaagactttgaatgtgaattttaactgcactaaactaaatgtagtgttagaaattaataaatgtagtattagaaagcatctaacaacaattgatataccatggaaacctccttttggaataacttcttcacacctttctgtcaagtgactttctcaccaaatgacattaaatatcagtagtcatttgaacttcttaacttttataattctggataaaagagagtttacaataactatcaaaaatcataagtgggctgggcgcggtggctcacgcctgtaatcccagcactttgggaggctaaggtggccggatcatgaggtcaggagatcgagaccatcctggctaacatggtgaaaccccgcctctactaaaaatacaaaaaattagctgggcgtggtggcgggcgcctgtagtcccagctactcaggaggctgaggcaggagaatggcgtgaacccgggaagcggagcttgcaatgagccgagatcatgccactgcactccagcctgggcgacagagcgagactccgtctcaaaaaaaaaaaagaaaaaagaaaaaaaaattcataagtgaaaatgcttgacaaaaacttaaaagtccatacaattaatccgggtgggattagaagctatattagacctagaacttgggcctcaagtctttacccaacttgtgttttagtaacattatatttcaacaattatgaccccaaccaaatccagtccataaggtgttaatgtaagatgtttattagtggaatttatttagtacagtaatcacattagaagtcccaatatacaaactgttgaagtccaaagtcacaaaaaatacaaacttaggtatacgaatgaaattataaaaacattatttaaaaacaaagttctacatcttcaacattgggccaaaaaaggaaaaaaaaagagagagagaaagagaaagaaggcatatgaaaatcatcacatttcaacaaagcagccctgaccagtctggctgcctcaccattgagatactggaccacttgggtgtgaccactatggcaatacagcatttcattatgggactggctactttgtataaaactatatgtgaaacataaaatttctttctttcaaaatgaaacgtccaagtgaaacagatagagctaacatataccaaattttagctggctgttagtagaaaatttcaacaattctgtaagttcaaaaaggaaacatatttgaaaaaaacaaatttcaaacaaaaataagcataaccaaatggaaataaaagaataaataaatgtcaatcatgaagtgtgagtgtacacaacggaaagtcatacccaggcttctccacccataacttagacagctacagggactggttacgagcaatagaaagatgtcaaacatgatttttaaaaataactactaccagttttgaaaagatccctggcgaaagaaaccccaaaatcaacttaataaataactgtacaccaaagggaaagggttgtgttttctttgatggtgtattctctatggcaagagagttttaatattttatcaactgctaagaagataagcataacctctttcctttaaaacatatcaccctcaagtgtcttctgtccagaatccatagaagaaatttttgtcagagaatccagcccttgtgaccagacccctgtagaagagggaatgcttcctaaattccggaagtcgctgcaaggattcagtttaaactttcatgatattctaatcttaccatctcaaaagtagttctgtatcaggggatctaaaacaatgtatatctggccaggcacagtgtctcacacctgtaatcccagcactttgggtggccaaggcgggtggatcacttgagatcaggagttcgagaccagcctggccaacaaagtaaaaccccgtctctactaaaaatacaaaaattagctggtgtggtggcgcacacctataatcccagctacttgggaggctgaggcaggagaaccacttgaacctgggaggcagagggtgcagtaagccaagatcgcgccaccgcactccagcctaggcaagagtgagaccctgtctcaaaaacaaaaaacaatgtatatctcaaaatctttctcagaacatggtgccaattatttcttttaagctgaaataatctgtaccttgggggttataagaagctgcataatcagtaaaaggatagaaaactttaaagtatttcagattttaaaccagaattcctctaagatttcaaaacatggtccatgttttatgttatatttctataaatacaatcaaagcataccattgtacagtactaatctcaactggttctagatttaagcaattagtttgaaaaaattaggaatgggaataagaaagtcctgttgaaacaatcttagattgttaagagtccgtctccaaaaaaaaaaaaatttggcccaacttgcaaataataaaggattatttaatttggaaaaatattctaggattactcagaactactcaatttaaaaacttaaaatatctatcattatttagattttagtaaggtggagagaaacataggtagcctgtaagattaaccttccctaaaagcaagctcagagaaggaaggaggagggagaagaaaaggaaattcgctgcagtactggtggcctcaacccctttatgaaaacacatgttctcatttggtgttacactattctgattcatgttgaacatttgaaaaccaaaggaaaaaggtcaactaaaaatatttaaaggaaaaaaatgtgagaatgaatcaaatgataaaatcataaagaaaacaagaaataaaagacattagataacctttgtaaaaattactaaaattaaaaagaattcattttgcactttgtgttcacaaagggaaatgaggctccatcaaaccctgcagagcacaagaggaagcaggttgtttgctcaggcatcagcagaaataggccccgaagaactaccctcagtttcttctacatcatgtccaggaatgaaaagcaaagctctgcaaaatgctgaaggttttagaagtataacgatgcttaggaaagatcactggtctggtgttgcagcagccccagtgttgagagacacgctaggcttctaggaggagaaaaatagagagggaggaagaagtaggaaggggaagaaaagggtggaaaagcacaggtcattagtaaacagcaagttcaatatcacaagatgctcataaaccaaagctattaatgaagctggtttgctctcgggactatagataacattctgaaggaaacagaaatgggaattttcaaaatggcattgagttagatgctccaggtagtgatggccaaattagaatgaagtcaccacatgctccaaaaacatgcactgccatcccctccctccaccttccctccccaaataaaacatgcatattttcagtaaagtatctttttttttttttttgagacggagtcttgctctgttgaccaggctggagtgcagtggtgcgatctcggctcactgaaacctccgcctcctgggttcaagcgattcttctgcctcagcctcccaagtagctgggactacaggcacgtgccaccacgtccagctaatttttgtatttttagcagagatggggtttcaccatattggctaggctggtctcaaactcccaacctcaggtgatccgcccgcctcggtctcccaaagtgctgggattacaggcgtgagccaccgcgcccggcctagtatctattttaatacagttaagtggttcaattcaaaactcaatccaggtgtgcaaactatatgctacctaagggcagagaggtatccaagaacagaacgacctactctcataatgccactgggtagttcataaagagccaggttcttttttgtcacaagggaatcctgaaacagtgagggccaggatacagtttttacccttctattctgtactactaaggcctggcagcggtaagcacctgctacacagagtttgagtctcttctggtcaggcatgacttcctactggagaagaaatctactcgtttttgtagttgtttccttcctggatgaaaatggcatccactctttcaactgcctaatcaagtcaatcccctccagcctttccttaccctggttaactggttcctgcttaaagaaagctgaatttactcattttttaaaagttcatgttcaaacttctcctttaatcacagggatatttgcataaatgttttcttaaaaaccacatcacatagatgactgctttcaaagcagacacagaaagtcaatactacatttgactgagattatcaaagaaatacaaaaacatcaattcacaaaactggaagataaagtggcatttctggttgtttctagcttctaaagtaaagagttcctaatttattaagttgctaataaggatgtatatgtcacttggtaaacattcacaacaaaaagaacttggtcatcaaaaaatctgatgtataaagatatatacaactttcctatggtcatagaataaagaataaatcctagaatagctgctattgctaacagaaggctttctggaagccttagaaaaagagaaatactgtggtgcctcacagaagggcttctcatagctgaggtatgcatataagagaaatacagaaatatgacaaatctagtaactacctccactgcaataatatgaatcaaatgtatggcccagttaagagcacacttgcaggaaacaatgggattgatcattagaagtcaactcatttgggttagcagtgttggcctgatcacaactgcaaagtaaatgcaggtatttatgaaaataaaacacgcaactctcacatcagctacttaagaaaatatttatatagtatatccctgggactcctgctactgctttgagaattttgctcactacaaagacattggggcagggggttggtgctggttatgagacaggaacccacagaaactcaatgctaactgaaagaatatcaaaaccctagtaaagagctaagagtttaattagaagtaaatttcaaaagcaacagttaagggaaagataaaggaaacacactgggggcaaaataaataactcctaatttgttgttcactggcttcctaacattgaactgtagaaagctaaacgcaatgtgattcagggaacagacctgctgttttaagagttgtagtggccaaattcctcccatgtaacatattttggtgatcattattctgcatctacaaaagtattttaaggttgatccagttcttgtgtggtacagctccaataaatattcaaaaaatatcaaagcaaactcattattctccttccattgttggagattttacatggcaatgtcctgggtttaaatacctccaacaagaacactaccaccctcagaaataattcatatgcttccattaataatgctcttcaaaggagattatcaaggtgttcattgtaagtgcatcacctacacatttggggaatcctgggaatcacttacctgtagtatcgctcccttctactccatgaccaccattggctaggagtgttggtttagaagatggagtatctgcaacaatgacaaataattacccattgtgacagacagaaaaatgaaaaacagatccaaccactgtcttattaatggagtttttctcactctttgtagcattaggttaaagcaattaaaaactgttcaaaatttaaacatttaacaaaaggaaacccagaaacagaactgaacagaatcattaattcctagggcacccaagctctgtaaagtaccagttccataggagagcccctcataatagcaagtctaaatctttttcattctgtaaattatcaaagattaccattaaattcagtaaaaccatcatggagcaacacaggtttggtatcagcaattcaaatccaaatcaaacgctccaagaacacgagggcatttgttttattattattattatttttgagatggggttttgctcttgtcacccagactggagtgccatggtgcaacctcggctcactgcaacctccgccttctgggttcgagtgattctcctgcctcagcctcccgagtagttgggattgcaggcacccgcccccatgaccagctaatttttgtatttttagtagaaatgggatttcaccatgttggccaggcgggctcaaactcctgacctcaggtgattcaccgccttggcctcccaaagtgctgagattacagatgtgagccaccatgcccagcggaggccatttattaattacttattaattcccacacaggaaatccagggtaccatcattgcttctggatgaagattgcatggaggtaaccagctgtatttctggaagcagaggactcctttttttttttccctcttttttttttttttaaggaaattagttgtatcttattccctaatgactaaggatgttgagcatcttttcatgtgtttctctgccatccctttgtcttctttggtgacttgaatggtcaaattttttgactattttaaaactgaactgtttattttcttattattgagttttgaaaattctttatgtattccaaatatcactcctttatcagataaattttgtaaaaatttcttccctgtttctaacttatactgtattttcatttacttaactgtgcctttcaaatagtttttaatttttatgaagtaggtcacaggatttttttccccatgttttcttctagaagtcttatagttttcatatttacatttcatattgaggcctacggtacattttgagttaaattttgtatatggtgtaatgatgtgggtctaagtttctattcctgtacattcctaagtttctattcctgtacctaataattaggtgattaggtagttacctaatcacctaataattaggtaattaggtaattattacagagtcatttgtggaaaaagtcatctgcattctattgaattgcctttgcacctttgtaaaaaaatcaactgaccatattacattgggtttatttctgggctgttatgttccatcaatttgtaaggctatccattttgccaataccatcctgtcttgattactgtatttgtacagtaagtcttcttgacagggagtctctctctgtcgcccaggctggagtgcagtggcgcaatcttgacgctctgcaacctccacctcctgggttcaagagattctccaggctcagcctccccaagtagctgggactacaggcacgtgccaccacgtccagctaatttttttttgtatttttagtagagacgaggtttcactatgttggccaagctggtctcaaactcttgacctcaggtgatccgcctgcttcggcctcccaaagtgctgggattacaggcatgagccactgtgcccagccataagtcttaaataaggtaatatgagccctccaacttgagtcttttccaaaaatgtttttgtttgttttgttttgttttttcgagacagggtctcattctgtcactcaggctggagtgcagtagtgcaatcgtggctcactggagcctcgactgctcaggctcaagcaatcctcccgcctcagcctcccaagtagctgggaccacaggtgcatgctaccacgcctgcctaatttttcattattattattttttggaaaaacggggtctccctatgtttcccagactgctctcaaactcctgacctcaagcaatcctcccaccttggcctcccaaagtgttggtattacaggtgtgagtcactgcgcctggccttgttttgtttctttgcttttccatataaattttagaatcagtttttgatttatactaaaattcttgatgggatcttatatgcaattgcatataagactatatagatcaatttggggattgactatatagatcaatttggggatgtacaactttttctgaaagtctctgactatatctaacattttagcaaccagcctagctctgcagtcaccttgctgaccgaagaattcagagatattattcctaagacaataagtgaatatctacaatatatgctactaaaataaaaaatgcaagattttactttggaagaccacaaacatgctgtccaaccccttagtcctcataaatacaaggcagaaatctttcacacaagcttcttgttgaaaagatcattcattctgttacttaagaggaacagccaaagagaacaatctaaaagaacaaggcagtccaaaaccagaatataatttaaataaaagaaagaaataaggaaggaaagacaacagaattctattaaatagccgctatgtaacatataccctgctaagtcttcacaaactgcattttacttatccagagagatgccataaatatgctccatcccacatttggcataagtaaattccctttcacattcacacaataagcttataagatttattcttcctcgctcaagaaagaatgcatatttttaaaaacttgcttcattaaagaatgcatattataagaaaatggaaattacaaaaactgatatccagcgagtggtataagagcagctattacagtgataaaaccttttaaaatttgataaccagcattgacaagggtaatttcattacatcatttgggggaatgtaaataggaataacctttttatgagacaatttggcagcctatcaaattctgcaatactcaactcaacaatcagttttaggtatttagttcaaaaagagacataaaagtataaaaaagtgaatataaacagaatgtttatgatggcactgcttaaaaacaacaaatgtccaccaacagattataatattgtaaaatagtacacagtaataaaagaaatgagagcacttcgtgttaccgatacaggaagataacaggtatctaatagctaaatatagataaaggccaagacaccctagggtatgcctatagtcccagctattagggaggctaaggcagaggggtgtcttgagtccaggaatttgagaccagcctgggcaacatagtgtgaccccatctctaaaaataaataaataaataaataaattagctgggtgtggtggcacacgcctatagtccttatctcgtaataaaaaataataataataaaaaagaacctggccaggtgcagtggctcaagcctataatcccagcactttgggaggctgaggcaggtggatcacttgaggtcaggagttcgagacctgcctggccaatgcggtgaaaccccatatctactaaaatacaaaaaattagccaggcatagtggcgtgtgaatcacaactactctagaggctgaagcacaagaatagcttgaacctgggaggcagaggttgcagtgagctgagatcgtgccactgcactccagtctgggcgacagagcaagactccatctcccaaaaaaaaaaaaaagctttattcccatatatttacctatgtgattagggtttcttcactatgatagctacaaaaacaggaaaaattgccaatcctatttcatcagagaaagaaatattgatccacagacccatgatttaattgagaaaaataacagaccccatcatctcataagaaaagcatttccaataaaattcaacttgtatagtaataacatcaaaaattacaacctatgttggccgggcacagtggctcatgcctgtaatcccagcaatttgggaagccaaggtgagcagatcacttgaggccaggaattcgagaccagcctggtcaacacagtaaagcccatctctactcttcttgaggaaacaaataggattaagtgaaaatgaagggagatttaaaaaaaacataatacatgcaatagactgataaatttcctctggaccaagttaaaacacagaacctttgtcacaggaactttaaaaattaaaatttaagtttacatacatatttagtagcagaaacatattagcacaatcaagaaaaaacttttaagcataaaaatatattacattaggataaaagtctgagacatgttatggaaataaaagttcaaggactcaaaagaagaatttaaatttccaatgataaagaacagcttgttcgtatatttttaaactagatgatggaaaccaaaatgctatatatttagaagcatttggatacatttagcagaatgaggtaacttatttttatgtggcaaaagtaaaacattctcaaaattacatgttttacaactaaacttttgctacaaaattttagatgtaaacttaatgtacaaagagacagaatttatcagaattctgagtatgtgaccaaaagttaagaccactactttagaccaagttaaaaagaaagcttgatatatactgacagaaagttttctaagataataaactaaaaaaagcaagttaaaattcatacgatttgattccatttgtaaaatggaatcaaatgaaagtaaagccactaaattttttattgtatgtttgtaactgcaaagaataaagtcttaaaagatctacccttcttgaggaaataaataagattacatgaaaatgaagggagttttctttgttttttgtttgagacagagtctagctctatcgccaagactggagtgcagtggcgcaatcttggctcactgcaacctctgtctcccgggttcaagcaattctcctgtctcaacatcccaagtagctggtagctgggactacaggcgtgcgccaccactctcagctaatttttttatcttcattagagacaggttttcaccatattggccaggctgatgtcaaactcccgacctcaagtgatctgcctgcctcagcctcccaaagtgatagaattacaggcatgagccatggcacccggcaaagattttgacttaatttttaagagagagggttttgctctgttgcccaggctggaatgcagtggtataatcacacctcactgtaacctcaaaatgctgggttcaaatgatcctcctccctcagcctcccaagtatatggtgacaacaggtgtgcaccgccacagttggcttatttatttatttatttatttatttaatttgagactgagtctccctctgtcacccaggctggagtgcagtggcacaatctcagctcactgcaacctctgcctcccaggttcaagcgattctcatgcctcagcctcctgagtagctggggctacaggcatgtgccaccatgcccggctaattttttgtatttttagtagaaacaggatttcaccgtgttggccaggctggtctctaactcctgacctcaggtgatccacctgcttcggcctcccaaagtgctgggattacaggagtgagccaccacgcccagacaattctatttgtataaagacagggtctcactaagttgctcaggctggtctcaaactcctgggctcaagtggtactcctgcctcagtctcccaagtagctgggactacaggcgtgagccaccatgatcagcctcgtccactgagctttaattcaatgctactttatttattttgttgctcaaatttttccagtgttggctattgggaactctttcagttgactcctgtgtccctctgacacactatctctgtcattgtgggctttggagcataactccaacagtctttttataaatgatctgtgcaattaaaggtaatttttttttccagtgaagggcataaataatgagatttaattgcgaataatatgcataatggaagtctcatttgcacatatctgtttactttctccctgcctttcctcctgcctcagcctcctgagtagttaagactaccaccacacccagttaattttttattttttttttctttgtagagatgcagtcttgctgtgttgctggggctggtatcaaactcctggcttcaagtactcttcccgcctctgcctcccaaagagctaggattacaagtgtgagtcaccatgcccggcctccctggtatttttgacctaaaatgtgcaaaagggaatttctgattcataaaatgtgactttcatataagatgcagcagaacacatttcaactggcttggaaaccagaaaattattcaaaagctatttgcttagatactaaaatagtaggtgaaagttggattagatacaggatacatacatagcctcaaaatatctcctcacaaattacttattcattacaaggagaaaaatataaattttacagtaaagaggctgggcgtggtggctcatgcctgtaatcctagcactttgggagggtggggagagcagatggcttgagcccaggagttcaagaccagcctgggtaacatcacaaaaccctgtctctattaaaaaaaaaaaaatacacaaattaaccaggtggccaggggtggtggctcagcactttgggagaccgaggcaggcagatcacatgaggtcaggagttcgagactagcctggccaatatggtgaaaacctgtctctaataaagatacaaaaattagccaggtgtggtggcacgcacctgtaatcccagctactcaggaggctgaggcaggagaatcacttgaacccagaaggcggaggttgcagtgagccgagatcatgccactgccctccagactgggagacaaagtgagaccccgtcttaaaaaaaattaaaaaataaaaataaaaattaggctggggggtggctcatgcctgtaatcccagcactttgggaggcagaggtgggtgaatcacctgaggtcaggagtttgagaccagcctggccaacgtggtgaaaccccatctctaccaaaaatacaaaaattagccaggcatggtggtgcatgcctgtaatcccagctactcgggaggctgaggcaggaggatcacctgaacctgggaggcggaggttgcagtgagccaagatggtgccactgcactccagtctgggcaacagagcaagactttgtcaaaaaaaaaaattaaccaggcatggtggtgcatgcctgcagtcccagctacttgggaggctgaggctggaagactgcttgagcctggggaggtcaaggctgcagggagccaagattgtgccactgcactccagctagggtgacagagtaaggccctgtctctaaataaataaatgcttttttttaattggaaaaaaattacagtaaagaaaacaggcagacactaacaagtgatgaaagttattatcaccaataatgtgatttagtgacatcatgtgcttcctgatgtggtgcacttaggacacatcatatttacatagtactactgccaaaaatgtggaacttgaatctaattatgaggaaatgccaggcaaacccaaattaggggacttctaaaaaataacttgcccatactattcaaaatattaaggtcatgaaagacaaagaagagttgaggaactgttccaattaaagaagactgaagagacatgaaaactaacgtgattccagatttaattgcagacaagaagaaaaaaatgagaaaggaatgtgttgaatctgttgggacaactgatgacaatgaaataaggttcgtggattagacaggaatatctcatcagcatttaacttctgatctctatcatcgtattcttgtaatgtgctaatgcctagttcttcggggaaagaggtgtgagttctgcagtttgttctcaaataatccaaggggaaggaactatatgtaaatataacaagaatgataaagcaaatgtgcaaaacagtaatgataaatccaagtaaagggtacatggtaggttcttggctctgttcttgcagtgtgaagtttaacaaagtcatttgcttgcagaatattatttaagaggtggggtctttggggtcttgctatgttacccaggctggactcaaactcctaggcttaagcaatcctccttcctattaagtagctcgggcagggctacaggtacataccaccatcctggcttgcttgcagaatatttttagcaatgaagtggtttttttgttgctttgttttttgttttttggggggtttttttgtattttttttgagatggagtcactctgtcgcccaggctggagtgcagtggcacaatctcagctcactgcaacctccacctcctgggttcaagcaattctcgtttctcagcctcctgagcagccgggattacaggcgcatgccaccacacctggctaatttttgtatttttagtagaggcggggttttgccatgttggccaggctggtctcaaactcctgacctcaggtgatccatctgcctcggcctcccaagtgctgagattacaggcttgagcccccgggtcccggtcccctgctcttctttcagactagggtactattattatgaactatacattttggtacgatattttttttccccaaaaagaactattagttatgagataaaagtctgttttcaaatcaaagtcagaaaataactatttttgcaaaaatgtcacactaattttttatgcatatatataaacttccctaaatatgatcatgagactattaagagggtttaggattagaccaagtacacctaccctaaataaatatctaccattttggagacacaattgtttgttagtctgtacattaacacaacccaaacctgaataaactgacaaacaaaaaccatttcaattcagtgtaataagcaatgattacacatctatcatgtgccaagagcagtggtctctaatgcagatctggccaggtttctcagtacccctgcgccctcagtttctcacaaaccatgagattcttcataatttcacttgatctgcttctccatgattctctccggtcacttgtcactgtaacctttgatttcttaaccctgagaaacttgaggtcgctagtaaactttgattatgctgtgccatcctgctttcgctaaatgtgtcattctccatgaaatatggcagtaaacaaaatattattcctgtgctagagcatgttaataagtgtaagataacaaatagcttaattatgatcttacaagtaccacagaggaaagaggaaagttcagggaagaaaagcacttaccaagaggaagatgaaaagaaaggctggcagggtgtgggggtagtgggaggtctagaagggaaagggaacagaagtcagggaatgttctggaaagttacatctaaatccaatcttaaaggattttagaacaacaactctagcaaaagctttatataacatcaacctccagcccagaaccgtcctccaaactccggactccttatctgtgtatccatcttctccatttcgatgactagcaggtaactaaatgtgaacatatcccaagctaaatttcttctcttcccttcaaatcctactccttctgtagctttccccatctcagatgatggcaattctttcctttcagttgctcaggcaaaacccctggagtaatactggatttgtccttggcaacatcaaggccttatactttaggtaagagaagttttggggtcatgcatatgttaaagtctgatgagagtgaattcaagaggaaatggaaggaaaggaattggtgacaggtagtagaaacgtctctttaaaagaaggcaggccgggcacggtggctcacgcctgtaatcccagcactttgggaggctacggtgggcggatcacgaggtcaggagattgagaccatcctggctaacacggtgaaaccccgtctctactaaaaatacaaaaaattagccgggcgtggcggcacacgcctgtagtcccagctactcaggaggctgaggcaggagaatggcgtgaacccgggaggcggagcttgcagtgagccaagatcgcgccactgcactccagcctgggtgacatagcaagactccgtctcaaaaaaaaaaaaaaagaaagcaaagcaaaaagatagatgagatggatgtgagattcagacaggattttttttttaatgataaaaaaattatagtatgtttgatgctggtgaatgacccaattgaaagaaaagaactgatgatgcaggagacagaagaggtaactgtgacagcagtggcctgagtgacagcatgaacagttcacccataacagaaaaagagcagacaataagggcatagatgaacataggtgaggaggaaatatgtggtgggaccatgtggaagttctgttctgattaagccaattaatttatgaatatgacttatgaatatgaacaggagagcaagtgccagaagtttcagagagtagatgtgaaacagttgtctaggaaagtgaaatattttacaaactcatgtgaattagtggcagagtccctcagtttgtgctctgtattgaaatgaagcaagattcttttacatttcctgaacatacatctaataattctatttgaatttaaaaaatggatttttagtttttaaaaactatcagtgagatactagatcaagtagaaagtatgtgttcatgaaaaaggtatagtttcacagaaagaacaggggtttattttatttatttattttttgagacggagtctcgctgtcgcccaggcttgaatgcagtggcacgatcttggctcactgcaacctccaccttctgggttcaagactctcttgccccagccccctgagtagctgggattactggtgagcaccaccacgcctggctaattttttgtatttttagtagagatgagatttcaccatgttgatcaggctggtctcgaactcctgacttcgtgatctgcctgcttcagcctctcaaagtgctggggattacaggcatgagccaccatgcccagccagaacaggggtttaaaatgagaagatccagtagctcatgtctgtaatcccagcactttgggaggcctaggcggaagggctgcttgaggccaggagtttgagaccaacctgggcaatatagcaagaccacatctctatttaaaaaatattgttttaattgtttaataaaaataaaagtgagattagaagatctgggttcaggttgtgctgtcattattaactaaatgatcaaatgcaaccttctcatttctaatacttaagcttcacctgggaagtgggactaaatgcagtaatacaggatgtcaactgtacagtgctaaatagtaattgttattctcactgttattagctattgttattctcactgttattaactatatgttgaccaactgtaaatttatctatcaaccacctatagaataactgtaggctgatcaagaaactttactagaataaaataaaatgaaagcaagaagaggttagaaaggaagaagagaagctggattctactatacatacaacacctcacaatctaaaaatataagcccaggagagaataaaaacaacgtaacaacactaaaaacaataaggttgacaagtagaaaaaaggcttgtatatttccctgccagataagacatactggaccctaatcatactgcacattactggaaaagtcctaattcaaaagatgctataatgtgttttctcactgactgacttccccagagaacccccatttcatgaaatgaaaactttctcagtgaaatacacacagcatcgaaaatagcacactttttttttttagaaactaatcacattctctgagatataaagatattcaaatttactttattttgttgattccctctccccaggagatgtcagattcccacagcaggcaaatcagcttggcagagaagtagcaagaacctgagaaggcatgtgtgctgtgagtcagccttgggcaaaacagccaggtctcaatgcaagggaaccctctggtgctgtcagacccatgccaacactgccctctactggccaattaagctggttgcaattttctgcaaaagaaataccagtgtattaaggagaaattctgcagtatctattaatagttgtcacttaggcccttttccatggattagtgtttctcaatcatgcatgtgtatccgagtcacctattatggcttgttaaaacagactgctggtgtgtggcagggtacggtgtctcccacctgtaatcccagcactatgggaagtcaaggcaggaggatcacttgagcccagcagttcaaaaccagtccagtccaggcaacacagtgagaccttgtctttactaaaaatgcaaaaaacttagccaggccattgccctgtgttaacttcttattctatgggaataagcttttagcttcaaaggccttatggaatgttgaggagaaagcattttctcgacttcagaagaagaactatttaatcacacagagaacagaaaaattaagtgacttgttccataaatgtgctatttgtgtctgagggtcaatactgtgctagatgatcatctgaaagaacaagagtcacagatgtttgcttcgtcattcacatctaagagaaagggttctatcttttgtctccctcacctagaaaatagggccatataatgctgataatgaacaattaaggaaaacaccattttttaaggaaaaaagtcaggaagtacataattttctttttatttttttcttattacagccgtggtgcaaaacaagtagtacacatatcctgaaaaagtatttgagaattgtttcccaaggtgataggcattttagaagaagagtttgacaccaattttatttctaggtattggtatttagatggtttacacaggcaatgctaagataaaatacttgtagaagcaagaataagttgaagtgcaaaaggaaatgagtatagtagatccaaagaaaaggaataaaggtcggggggttcttgtgttgccaggcatgaaggcagaaatcatacttagagaaaaaagcaattttcctactttgtcataaatgccataaaagcaaccctgctttcttacttctcattttataagttgaagacaattagggtggacatgtaagaattaaaggaaataaaacaccattgttcaaagagttctattatgtgtaacctactcaaccgtcccttctatatctagaggcaagaaaatggttgataaacttccactggttggcctaactaagcctgttgtaagaacatatcgagagcactaggctgggtgtggtggctcacacctgtaatcccagtgctttgggaggctaaggcaggaggatcgcttgaggccatgagttccagaccagccagaggaacacagtctgactgtcgctataaaaataaaaggataagcaaggcacgcgcacctgtagtccaagctattcaggagcctgaggcaggaggaacgtttgagcccaggagttacgttagatgttgcagtaagctatgattgtgccactgcactccagcctaggtgacatggaaagaatctgtcttttcttttttttttttgagacggaatttcgctcttgttgcccaggctggagtgcaacaatggcacgatctcggctcacggcaacctctgcctcccgggttcaagtgattactcttgcctcagcctcctgagtagctgggattacaggtgcccaccaccacgcccagctaatttttttgtgtttttagtagagacagggtttcaccatgttagccaggctggtctcgaactcctgacctcaggtgatccacccgcctcagcctcccaaagtgctgggattataggcgtgaaccaccgcgcccagtaagaccctgtcttcaaaaaaaaaaaaagtgtcagcaatcagcagtagtttactgaacctcatctaagaacaaaatcaaacttaaagttagatgtataataaaacattaatgaagtctagggcccttccatcacttctaaagatgtattcagaagaacatcttgtttagaatgttctccaggaaaaacacaaatatgaaacctgtcattatggcaaaaaccatcagtccgataatgtataaaaatcagacccacagcagagaagtctccattcataaagaactcactaattgcaccagatttctacaagactaaataaggcggcttccttcgtttttcttatttgatgtctccaaacagccatcaccccttcctttaagttaagacttctacaacttttaggaagctggtatggaaaaaatgtagtaatttacaacctatcataattataaactttattattattattatttttagagacggggtctctctctgtcacccaggctgcagcacagtggtgcttttatggctcactgcagcctcgacctctggggctcaagtgattgcctcctacctcagcttcctgtgtagctcggactacaggcgcacactaccacgcccagctataattataaactttaaacatggtatcttcaacaagttcgtggaaaatgcattctatgaaaaaattattcatggatttcaagggagtttttttgtatcaaaataactcatactccagcctgaccaatatggcgaaaccccatctctactaaaaatacaaaaattagctgggcatggtagcatgtgcctataagcccagctactcaggaggctgaggcaggagaatctcttgaacacaggaggtagaggttgcagtgagccgagactgtgccaccgcactccagcctgggtgacagagagacactccatcttaaaaaaaaaaaaaaaaagctcatactaacttgttataacacgtctgaacaggatctagtttgaagcactaaaaaggataaaacatcagtttgaaaagagcccctaataaagcaacatgaattctgctaaaattgaagcaaaagcaaatggtaaatttatggtgaagcttggatgaaagaatggtgaaatcactgatgctttgtgtaaagtttatggggacaatgccccaaacaaatcagtagtttacacatgaataacttgttttaagacatcagccagatgcagtggtccgcacctatagtcccagctacttggaaggctgagacaggaggatcacttgagcccaggagttcaaggctgtagtgtgctatggttacacctgtaaatagtcactatactctaatttgggcaatgtagtaagactctgtctcaaaaaaagaaaaaaaataaaggaggagatgatgttgaagatgaagcccaccgtggcagaccaccaatatcaatttgagaggaaaaaagaatgatctaattgaagaggattgacaattagcagaaacaatagccaataccacagacatctcaattggttcagtttatacaattttggctgataaattaaaattgagcaaactttccactcaactggtgccaaaatggttgcatccagatgagctgcaaagagcagagctttcgatgtaaattttaaacaagtgggatcaagatcctgaagcatttctttgaagaattgtaacaggagatgaaatatggttttaccagtataatcctaaagacaaagcacaatcaaagcaatggctaccaagaggcgtaagtgctgtagtcaaagcaaaagtggatcagtcaagagcaaacacaagagttttttaggatgctcaaagcactttgtctgttgactttctggagagccaaagaatgacaacatcttattatgagggtgttttgagaaagtcagccaatgctttagcagaaaaacagccaggaaagcttcatcagagagtccttctccaccaggacaatgctcctgttcattcctttcatcaacaaagataatttgtgacagttttgatgagaaatcattaggcaaccaccttacaacagtcctgatttggttccttcttttttgtttcctaatctttaaaaaaatctttggtagcaacaaaaaattaaaaacttaaaccaaaaaaaactttaaagggcatccatttttcttcatttcttcatttttcttcatttaataatgtaaaaaagccaggcacagtggctcacacctataatcccagcacaaaagaaaaacaaatatttactccaaaaaatttggattccttaatggaaaacgggaaaatctattctctcttaatccataatgcacggtggagacatttgttctttgactgactaacataaacaaagaaaacctagtatgaagaaaggaatgataagatgtaaatatggtagcaactagtcatggttgagatgctcttcccatcctaatattaacttaccctcatcagtcataggtgaaagaagctagctgcttttcgttttctaatttcctttaactgtgcattgtttccatcatctgggaatgagcctaggtggataaggacagtgaggtggtagcagtagattttcttgtgcttcatcttgagttatttgatccatgtaacattaacttggcccaagaggaggaaagtttttaagacattattttatttataaaaaattaaatcctccctgctacttttgatatgtaaatggtggctcatgcctgtaatcccagcactttgggaggccaaggcaagtggatcacctgaggtcaggagtttgagaccagcctggccaacagggcgaaaccccatctctactaaaaatacaaaaattagccaggcatggtggtgcaggcctgtaatcccagctactggggtgttgaggcaggaggatcgcttgaacctgggaggcggaggatgcagtgagcagagatcgtgccactgcactccagcctgtgcaatagagcgggactccatctcaaaaaaaaaaaaaaaaagttcattaactcagaaagactactccagaaattggcgagtggttactccaggaaggagaactgtctggctagggtgtagggattgggagaatttgttttaccgtacatccctttggaccaattggattttgtacatgtgtattttttagcctgttcaaaaaatgtatgagtttctggaaaattgaattaaaggataaaaataaaatatgaactttacttctcaacataagcttttgcaacatcaagatacttttgtaagcaatgatagcaactttttttcttttcttttttttttttttttttgagacagagtctcgttctctcgcccaggctggagtgcagtggcacgctctccactcactgccacctccgcctcccaggttcaagtgattcttgtacctcagcctcctgagtacctgggattacaggtgcacaccattacccctggctaatttttgtatttttagtagaggtatggtttcaccatgttggccaggctggtctcaaactcctgacctcaggtgagccacctgccttggtctcccaaagtgctgggattacaggcgtgagccactgcacctggtctggagtaaatatttatatggatataattagaactctcggtacttttttaaatgagttgtggtctgccccccctccccaacacacaaattaaacatatattaaggaagcaggttttcttcttccacttggctgtagaaagccaaaagcaacgtcactcccaccctaacaacaagaaacagccatatcaactacaaaaaacttgaattaattggaaagccacctagtagtatgaaatccaaagaaaaacaagcccctccaggaaatatgggaggtgaacaccagctctcctgtatcagagcatgtgcagaagagacattgggtaccctacaagcaggtaagaaaaattcaagtaaaaattgtagtgatttgtcaaaggtaaatgaaggctagcatgagactatggggcccctcaaatccacagacacaaagggaattcacactcatttgcaggattgtcttcacagatgtctgccgcatgctcacaggaaagattggaagcagggtgagggaccagacagagcctccctccatggtacagacctggagaaggccaccaccattaagggaaaagcatgaacccctcccactgggatctttctctcctggggaaggagtacaaaccctgtcaaccccagagcacacaagaagaccggctgtagctagggaaagagtaatagaaacatactttataaacctgagagaggagcaagaaaaactcctcatccaggatcctacaccaataccatgagaagacgctactactgtgaaaaggataataacgttgagaaagacccaaaccgtgagattaagcacaggattaagcacaaaatgggacaataaaaaaacaaactctgcctgccacctggctagaactcttccgataagagagaaaagagcatggacaaggacccctctgaggcacgggtacacagggaaggctgaaagagtggagcaagcacattaaagaaataccttccagggcctcagtccccactctaagcatagaattaaagggattgaagacagtagtacactgaaggcaattacggtaatgacaaaacccaaaactagctcagctcctgttaaaatgactaaacccaagagacatgcctatttccaaccataacaccttttggcctcagcctactattttacatgtgagatccagcattcaatcaaaaactaagacacacacacacacacacacacacacacacacacagagcaatcagactgagagatgacccagattttcaaattatcacacagagatttaaaacaactatgattaatatgttaaagtctacagtagaaaaggtggaaaacataggtgaacagatgggaaattttgacagaaataaggaagcttataagagaggcaaacagaaatgctagaaattaaaaacataaaaaatgctaaagtagataatgccactgaaagctcatcattagattcaacacaactatgaaaagatcagggaattggaagataggtcaaaagaaagtacccaaagtaaaacacaaacagaaataaagagagaaaaaaaccaacaatgcatccaagagatacaggacactatccaacaatttaacaaaaatataattggaatcccaggagaaaagaaaaagaatggggcagaagaaatattttaaaagataatggccaaaaatttcccagctgacttaaccacttcaaaagcacagatcaagaagctcagaaaagcccaagaagaaaacttccaaaatatcatctaaacacaacatatttaaactgctaaaaaaaaaaaaaaaaaaagataaaatcttaaaggcagacacaaagaggaattcacaaaggaaatatttttaaatatttttaaatgaatgaaaataaaaatacaacatatcaaaatccatgggacacagctaaaatggtgattagagggtaatttataacattaagtaattacattagaaaagaaatgtctcagatcaaaacctgatttaagctgtcaccttaagaaaccagaaaaagaataaatcaacttaagtaaacagaagaaaggaaaaaacaaagatatgagaagaaattaaaaacagaaagacaatagaaaaaaattaatgaaaccaaaagctggatctttcaatacaattgataaacctctacctagacttatcaaagaaagaaagaaagaaagaaagaaagaaacatcacaaattactagtataagaaatgaaaaaggggacataatagatcctacagacattaaaagcatatctccattaatctgcaacatttatgccaggaaagggaccaaggaattccttgaaagatacaaactaccaaagctaacttaagaaacagataactggaatagttctatgatctctgaaagaaactaaattcctagtttaaaaatccgacagaaaattccaggcccagatagctttattgatgaattctatcaaacactgaaaagaagaaaaaatatcaattctatgcaaactattctagaaaagagaaagaagggaacacttcccaattcattttatgaagtcggcgtgacctcaattctaaaactggacagaagacattatgagaaaactacagaccaattccctcatgaacacagatacaaaaatactcagccaattattagcacatctgatccaggaaaatggcaaatttctcttaaaggctttaattatgctttaatcctgaggtgggatgactccaaagacaacaaatggcatctgattccagtctaaatgaagttctgatataaccgcagaattttatttaacttttcaaagctactttcagagaaaaggcacagtagacagtttaatttaggaaattaagaagaagattatatggttgttgaaacattagagaagaaacattagggttaaaagtcatccacagactcatgaacgctcactcaaagggtggtaagtctacctcctcggtatctaacaaagaaacataaagttactagcctacactaaaaaaactcagctcaattctcagtttccaagattataccaaaggcataatccctaacctgctttctgaacatatataagcagtctggtttaaatacttaccttcaatctggctagtttctgagcacggtttcttctttgactctgagttcccggttttctcatcaacatccaggagaggaatatagtctgtttttccaacagtttctcccacaacatcatcaaaggcctctgcctctagtgtggcaatgaagtcccgctttatctctccctcaatgtctggagatggttctgttaatgcatctgcaagactgaggtcagccattctgcaccactgcaactgcctggtgaagaggaaaaagatctttcatgtaacgagcactgcaaaaggaaaaacatttctagaaactcttgtcaattgtttgaaacaaacaaaagaatcaaaatctaagattttacagctagaagaggctccctcatttgaaagatgagaaaaataaagctaagaaatggacagtctgacccaaggtaactcaccgctagttactcttttctcacatttctgggggtggagggaggtggtggtggcaggacaaagcaattgcaattgtgtcctttctatttataagaaaagtgaggtgtaaaaaaaccccacaatcaacatatccaaagctatagccagtaagattcaaatcaggtctttacatagttacattactatcggacaaatgaaatcaactttcttgaccaaagactgtgagtatggatcttatcttggagtgagtacctgcttcttcatgaatcacttgtggatagtcctgtcaaccaaactacttagccctgccagcataaaaaaaaaaagacacgtttccctcaattagctaagggagatggtccctctctgtagtcacgtatattaccatttttacagactaccagcttcttaattacataatctgcagttaagtaaatctactggcagccataaaaaagaacgagatcatgtcctttgtgggaacatagatgggaagcaggaggatattatccgcagcaaactgacgcaggaacagaaaaccaaataccacatgttcttacttgtaagtggaagctaaatgataacttacgaatacaaagaaactgcagacactggggtctcctggagggtggagggtgggaggagggaaaggagcagaaaagataactattgggtactagacttaattgaaataatctgtacaacaaacccttgtgacatgtgtttacctatgcaacaaaccttcacatatacccttgaacctaaaataaagtttaaaaaaaaaaaaaaagtaaatctataagcaaaccataggtgaatagcctagaaaatacagaaataatgtagtaaaaagagccaaaggggccaggtgcagtggctcacacctgtaatcccagcactttgggaggccgaggcaggaggatcacttgagaccaggagttcaagaccagcctggccaacatggtgaaaccccatctctactaaaaatgcaaaaattagcaaggcatggtggtggacacctataatcccagctacttgtgaggctgaggtacgagaatcgcttgaacccgggagatggaggctacagtgaaccgaggttgcgccactgcactccagcatgggcgacagaggaagtctccgactcccccatcaaaaaaaaaaaaaaaaaaaaaaaaaagagccaaaggcctgcaataaattgggcaccattcaaatgcagggcataataggaaataaagtgtgcaaggtactacgcctgctttcaaaaagtctaacagaaactccaagagactccataggataagttgacatataagctatgttgttgacaaggtaaatacaagtcaaacagatccttagttgcacaatgtaatggccactacttgtgtttgtccagaaatctattcttcctatctcccctaatacaaaccaatccctacccctatagggtttgggacatgactagagttgggtcaatcagaagtcaagaagaagacagttggaaaggatcatttattgactacacgctggaagaaaagtccatgagtgacagctatttagttgccctggttgactacttcaagtctaagtgagcggccttcatctttcttttgcctaatttagccaatctatttctgttgtttacaatggaagaatctcaactaatacacagtctttctccaacccaaacttgaaaaagtaaaaatatactatgattcaagccacttaattttcaggctttcctttcaagctgttatccaccgtctacctctctccaacaaatgtacttaggaaaaagaaatagaattaaagcaaggaatatggtcctatcttccttccttcttattttatcttcatctttgttcccacacactcctctcctcccacttacatgctgtgaggctaccatgattacaaaacatgtacaaagcaaatacttccagaccctgaaaaatcagaagtcatcgtacccccaattcccaaatccaacaagcaaagggtgttgctatatattagagtggtggcacagaggcttaagaatcaagatccgatacccaaataagtacagacaggataattaaggccaggggcaagatctacatcttctaggcaagtgtctagaaaaaaaagatagtatgtgttcagtactgggaatgctggagatagtttgtctctacctatatggagcttagtgaaaacattcattacatattctttatattatctaagaaaaaaatacaataccaagatttggaaagatattaaataatcaattatatttatatagacttccaaataaaatctaaaaatttcaaataaatttaagccttcttccatgtgcctaattttatgagttttcctatttgaaataacaaccttaattcctcatcaataattttaaatgattatcttttcaaattctaggtagtaccattatacaaaaatgtagtagaaaagagctgtttctctgatttcttttctttttgaggcagagtcttgcctcactgcaacctccacctcccaggttcaagtgatcctcctgcctcagcctctctagtagctgggattacaggtacgcaccgccacacccagctaatttttgcatttttagtagagacagggtgccaccatgttggttaggctggtctcgaactcctgacctcaaagtgatccacccacctcggcctcccaaagtgccaggattacaggtgtgagcccctgcgcccagcctgcttacttttcttaaagcaaatgtgatatttaaatttcctgtgactatactaatgagttcctaaatcatatctttttattttttatttttttcagacagagtttcactcttgttgcccaggctggagtgcaacggcaccatctcagctcaccggaacctccacctcccaggttcatgcgactctgtcatcatactacttggaatttgatgaagttcatttaggtctcaaaaaatgtcaaaagatacgtgtgacccagatgtggtggcatgcacctgtagttctagcctttcaggaggctggggcagggagattgtaactaggagttccaagctatagtgtgcaatgatcacgtctgtgaatagccaccacaactccaggtgtggagccacgattgcatcactgcactctagcctgggtgacagagcaagactctagtctcaaaaagaaaaaaaaaagaaaaaaaaaatcacactctgagccaggcgtggtggttcacacctgtaatcccagcactttcagaggctgaagtgggaggattacttgagactaggaattcaagaccagctaggcaacatactgagaccctgcctctacaaaaactaaaaaaaaattagctgggtacggtggcatacacttatagtcctagctactcaggaagctgaagtgtcacaatcgcttgaacccgggagtttaagactgcagtgagccatgattgtgatggcaccactgtactccagcctgggtgacagagtgagaccctgtctcaaaaaatttttaaaaataaaaataaaaaataaatagggtacagaggctcatgcctgtaaccccaacaatttgagagcctgaggcagctggatcacttgaggccaggagttcgagaccagcctggccaacacggtgaaaccccatttctactaaaaacacaaaaattagctgggcgtggtatcacatacttgtggtcccagttaggaggctgaggcatgagaatcactggaacctgggaggtggaggttgcagtgagccgagattgcaccactgtactccagcctgggtgacagaaaatttgtctcaaaaaacaaaaattaaatttaaaaacttttaaataaataagtaaaaaataaatcacactctggctgttaacattaaggccaaaaataaataaataaataaataaataaataaataaataaatttaattccatttagaaatatctaataactataataaagttaaatccaatttaatcagtctgttagaagaaaaatagcgacaagagcaaattatgtcaaagaaagacacgcactgagagagtttaataatagatgtcataaagaagctgttgaatcttctccataaaaaagtaaatatgggccgggcgcaatggctcacacctgtaatcccagcactttgggaggctgacgtaggcagatcacaaagtcagaagatcgagaccatcctggttaacatggtgaaacctcctctctactaaaaatacaaaatattagccaagcatggtggtgggcacctgtaatcccagctgctcgggaggctgaggcaggagaatcgcttgaacccaggaggtggaggttgcagtgagcagagatcgcgccactgcactccagcctgggtgacagagtgagactccttctcaaaaaaaaaaaaaaaaaaaacatattaaattgtacaaaactgttatgatcagccattccaaagcactggacatcaacaaactgtagaacacaagttgagaagctttgcattctcgaaatctgcttgagctttggttaagaccaggaagagtctatggcccttttgtctagagctgtttccactcccatcttagcccacagctcagtttggtcagcaagaattacacttttattagtgtgatggttaacactgagcatcaacttgattggaataaaggatgcaacattgatcctgggtgtgtctgtgagggtgttgccaaaggagattaacatttgagtcagtgggctggggaaggcagacacacccttaattgggtgggcaccatctaatcagccaccagcgaacataaagcaggcagaaaaatatgaagaggcaagaggggcctagcctcccagtctacatctttctcctgtgctggatactttctgccctcgaacatcggactccacgttcttcagttttgggacttggactggctttcctcgctcctcagcttgcagacagccttttgtgggaccctgtgattgtgtaagtcaatacttactaaattcctctttttataaacatacatatatatcctattagttctgttcctctaagaaaactctgaccccagactaacacagactctggtaccaggagtggttccagaggaacagaatgttaaggatggagttcttttgttggtttgggggtttctggagttggctgcttaatatgattgatccaaaaatgctgaggactctacttctaatagcatggagaacattcatagtccttggcgtgaactatttagagagttatgcaaaataaatgcatttgacactcctgattcactgctcatgaaaggtaaggactttagtgactctatacataatacctttgaccatatgtggaaaaccaacgaacataatgaagctggttggttgctcctaagttcagtgaacaaagtgatgaaagaaaatgatgaactcagggattctgtttcctggcttcagaagcagatactgagtctcaaatctgctaagattgccctgagtgagagtcttagctcctgttgagaaagagctgaaattgtggaaaaacagacataagctcttatcatgcgagtggctgacctgcaacaaaagatgcatgcacagccacctgaggtgtctactgctaaagtgagggcattgattggaaaagaatgagacccagaaacttggaatggggatgtgtgggaggaccctgatgaagctgggaacactgagtttataaactctggtgaactttttttgccagaaggaacagcttccccatcccccatagtggcagcataaccccccatccccgccatcaacctttccatctttgtctacggacataaaccctgagctgcctgaggcaagagtcatggcctcctctcaggcagttgccaggcaagataatgttgattctccttagaaggtacctgcaacacccatttgcttctagacctataactcaagtcccacaggtccctagaggtgaggttgagagtgtgacccaggaggaggtgcgctacactcaaaaagaactgttctcggccaggcacggtggctcacgcctgtaatcccaatactttgtgaggccgaggtgggcggatcacgaggtcaggagttcaagaccagtctggccaacatagtgaaaccctgtctctactaaaaatacaaaaaattagccgggcgtggtggtgcacccctgtaatcccagctactcggcaggctgaggcaggagaattgcatgaacccgggaggcggaggttgcagtgagctgagattgtgccactgcactctaacctggcaacagaacgagactccctctaagaaaaaaaaaagaactgttctctaatttatataaacagcaatctggagaacaggcatgggaatgggtattaagggtatgggataatggtggaaggaacatagagttggatcaggctgaatttattgatttgggcccactaagtagggactctgcatttaatgttgcagctcggggagttaaaataaggttctaatagtttatttgcttggttagctgaaatatgcattaaaagatggcccactgtgagggagctggaaatgcctgatatctcttggtttaatgtagaggaaggcatccaaaagcttagggagattgaggtggtggagtggattactcactttagacctactcatcccagctgggagggtccagaagatatacccttgaccaatgccttgtgaaatagatttgtgagggcagcacttgaatctttgaagagccctgtaattgctcttctctgcatgtcagacctaatggtgagaaccgcagtcactcaattacaaaattgaaatacgaggggaataactggatcccaaggtggcaggggccaagtagcagcactcaaccatcaaaggcaaggtgggcgtagctaccgtaatggacagcagaggcaaagtgacaatcagaatagtctgactcatgtagagctctggcattggctaattaatcacggtattcctagaagtgaaacggacaggaagcctactgcattcccacttaatttatacaaacacaaaacttctaggtcgaatggacaaaagactaatttgaattataaaaagagaatcatggcccctcactcaatccatttccagacttcagccagtttacagacccagaaccccttgaatgaaggggaggccaggtacccttgagaaaggaccccactactttactgacaatttatgcagtgaatctttctcccatccttccccaaggagacctccatccaacctttcactttggggactactggacactggctctgggctgatgatgactccaggggacttaaaacatcactgtggtcttccagttaaactaggggctcatggaagtcaggtaattaatgaagttttagcttaggtctgacttacagtgggcccagtgggtccctggactcatcctgtggtcattaccccagtgccagaatgcataattggcatagacatacttagcagctggcaaaacccccacactggctccctgactgctaggttgagggctatcatggtgggaaaggccaaatagaagcccttagagttgcctctacctaaaaaaatagtaaatcaaaaacaatatcacatccctggaaggtatgcagagatcagtgccaccatcaaggacttgaaagatgcagaagtggtgattcccaccacatccccattaactctctcatttggcctgtgcagaagacagatggatcctggagaatgatagtggattatcataagcttaaccaagtggtgactccaattgctgctgctgttaccagatgtggtttcattgcttgagcaaattaacacatctcctggtacctgctatgcagccactgactctgcaaatgcctttttctctattcctgtccataaggcccatcagaagcaatctgccttcagctggcaaggccagcaatatacctttactgtcctacctcaggggtatatcaactctccggctttgtgtcataatcttatttggagagatcttgatcgcttttcgcttccgcaagatatcacactggtccattacattgatgacattatgctgactggatccagtgatcaagaaatagcaaacacactggacttattggtgtgacatttgcatgccagaggatgagaaataaatccgactaaaattcagggaccttctgtctcagtaaaatttctagggatctagtgttgtgggacctgttgagatattccctttaagttaaaggataagttgttgtgtttggtctctcccacaaccaagaaagaggcacaatgcctagtgggcatatttggattttggaagcaacacgttcctcatttgggtgtattactccggcccatttactgagtgacctgaaaggctgccagttttgagtggggtccagaacaggagaaggctctgcaacaggtccaggctgctgtgcaagctgctctgccacctgggccatatgacccagcagatccaatggtgcttaatgtgtcagtggcagatggggatgttgtttggagtctttggcaggctcccataggtgaatcgcaatggagacttctaggattttggagcaaggccctgccatcttctacagataactactctcctttttttttttttttgagacgcagtgtcactctgttgccaaactggagtgcagtggtgcgatctcggctcaatgcaacctccacctcccaggttcaagcgattctcctgcctcagcctcccaagtagctgggaatacaggtgcgtgccaccacatccagctaatttttgtatttttagtaaagatggggtttcaccatgttggccaggatggtctcgatctcttgaccttgtgatccgcccacctcagcctcccaaagtgctgattacagctaactactctccttttgagagtcagctcttggcctgttactgggctttagtggaaattgaatgtttgactatgggtcatcaagtcaccatgcgacctgaactgccctgcctatcatgagctgggtgctttcagacccatctagccatacagtggattgtgcacagcagcattccatcatcaaatggaagtggtatatacgtgatcgggctcaagcacgtcctgaaggcacaagtaaattacatgaggaagtggctcaaatgcccatggcctccactcctgccaccctgccttctctctcccagcctgcactgatggcctcatggggagttccctatgatcagctgacagaggaaaagaagattagggcctgcttcacagacggttctgcatcatatgcagacaacacccgaaagtggagagctgcagcactacaacccctttctaggacatccctgaaggacaacaatgaagggaaatcttcccagtgggcagaacttcgagcagtgcacctggttgtgcactttgaatggaaggagaaatggccagatgtgtgattatatactcattcatgggctgtagccaatggtttggctggtcagggacttggaaggagcatgattggaaacttggtgacaaatttggggaagaggtatgtggatggacctctctgagtggtcaaagacaagatatttgtatcccatgtgagtgctcaccaacaagtgacctcagcggaggaggggtttaataatctagtggataggatgacccattttgtggacaccactcagcctctttcccctgccatcgcccatggccaacaaagtggccatggtggcagggatggaagtaatgcttgggctcagcaacatggacttccactcaccaaggctgacctggctacggccactgctgagtgcctaatttgccagcagcagagaccgacaccaagccctcagtatgtcaccattccttgggtgatcagccagctacctggtggcggattgattatattggacctcttccatcatggaaagggcagaggattgtcctcactcaaatagacacttactctggatatgggttcgcctatcctgtatgcaatgcttctaccaagactaccatttgtggaatgtttttttggtttgttgttgttgttgttgttgttgttttgagaaggggtctcactctgttgcccaggctggagtgcagtggcacaatcttggctcattgcaacatccgcctcccgggttcaagtgattctcctgcctccgcctcccaagtagctaggattacaggcacccgccaccacacccagctaatttttgtattttcagtagagacagggtttcaccatgttggccaggctggtcttgaactcctgacttcaagtgatctgcctgcctcggcctcccaaagtgctgggattacaggcgtgagccaccgcacccagctgactcatggaatgccttatccaccatcatggtatgccacgcagcattgcctctgaccaaggcactcactttacagctaaagaagtgcggcagtaggctcatgctcatggaattcactggtcttaccatgctctccatcatcctaaagcagctggattgacagaacagtggaatggcctattgaagtcacaattacaacgccaactaggtgacaatactttgcagaactgtgggaaagtcctccagaaggccgtgtatcctctgaatcagcgtccaatataaggtactgtttctcccatagccaggattcacaggtccaggaatcgaggggtggaactggaagtggcaccactcaccatcacccctagtgatccactagcaaaatttttgcttcctctcctgcaacattatgttctgctggcctagaggtcttaattccagagggaagaatgctgccaccaggagacacaacaatgattccattaaactggaagttaagattgtcacctggacactttgggctcctcctccctttaagtcaacaggctcagagggggagttacagtgttggctaaggtgactgacccagactatcaagatgaaatcagtctacaacttcacaacggaagtaaggaagagtatgcatggaatacatgagacccattagggcatctcttcgtattaccatgccctgtgattactgtcaatgcaaaaccacaacagccaaatccaggcaggactacaaatgatccggaccattcaggaatgaaggtttggatcactccaccaggaaaaaaacccatgacctgctgaggtatttggggaaggcaaagttaatacagaatgggtagaagaaggtagtcatcaataccagctatgaccacgtgaccagctgcagaaatgaggactgtaactgccatgagtatttcctccttcatttgttaaaaacatgtttgtgtatgtatacacatgtactaatatcttcactttatatttccttttcctttatcatgtgacataagatttattgatttcataacagcatttaagtattattaactttatgtaatagtatttgggttggggattggtgtgtttctggttgtatgaaggatagttttattacattaggtgtaattatgaccttattattgtctttattttaagattacatacgatctcagatgtatatgggttcaagttgacaaggagtggacttgtaatgttaatactgtcaacttgattggactgaaggatgcaatattgatcctgggtgtatctgtgagggtgttgccaaaggagattaacatttgagtcagtgggctggggaaggcagacccacccttaactgggtgggcaccatctaatcagccaccagcgaatatagagcaggaagaaaaacatgaagagatgggcctagcctcccagcctatatctttctcccgtgctggatgcttcctgccctcgaacatcggactccaagttcttcattttggggactcggattggctctccttgcttctcagcttgcagacagcctactgtgggaccttgtgatcacgtaaatcaatacttaataaactctcctttggagatatatcctattagttctgtccctctaagagaatcctgactaaaacaagtagtgtggggctcgtgacaaaaactgatagctttgctgccaaaggggctcctgtggcatgacagagctgttgtccacagcaaatgccatctcacactactggaattataaattccactatttgaataaccactgccgaattcaggatttagcagcttttctgaaggaaccataaataggaattcaatggttcctatagtaggaactggacttggtaatcccagcctgtaatctcccagcactttgggaggccaaggcgggtggatcacttgaagccaggagattgagaccagcctggccaacacagtaaaaccctatctctactaaaaatacaaaaacagaataactagctgggcactgatttttattatttagatggtatgcacctgtaatcccagctactcaggaggctgaggcaggaaaattgcttgaacccaggaggtggaggctgcagtgagccaagatcacgccactgcactccagcctacgtaacagagcaagactccgtctcaaaaaaaaaaaaaaaagttcctatagtagtagtggcacacctgtgacccatttacaacagacgaatgtgggtgggaagccctattctatgctcgtccagcctactttacatataaagtattattgtaactccagatcatgacagggaaaatgctgagaaatgagttcattaaagagcttttaaaagcctaacagattataatgtcaaagggttccatgaaaagcaactattcagttgcttttactattcggttatgccatttccctattctatctctgacaactattattagtagttatcctttgggagctgttatgaaccaaaaactaaaaaggacgtctgtaactagttttgatagaggcaagaggcaaacaaatgtctaggcagacaggggcgggtcctcagtgaaacccgaactttaatccggaaactgtcctgggtaaatcctgagatcggattaagaacctgccttcccgtttggcatgattgatccccatccttcacctatttaacctgtacctaccctttcctaattggttttctacactgtcctgcccaccttggagtggtgtcttcgctttgaccttttttgcatactcacaaaccaatgaccacacactcccattctgaaccaataaagagccccaggctcagccatattacggaactttcctgtcttcaggtagtagaaccacctaccatgttctctctttttgctaagagctttcctttcgattaatagattctactccactcactctttgatgtccacgtgcctaattcttccgctcctgagataagaacctggacctagttgagctaaggagcaaaaatcctgcatcagtttcatggtcaaagagaacttaaaaggacatctgtgccatccttaacaacataccataaaaatccaaaatttaattttccccagaaatacataatgacataagatgcaatctactcaaatcttttcctcatttaaggcacagggtaaaaatacagtcaaaaacaccaatacattttaaatatcatttatcagaatgcagattatcaaagggcagcttttatccattgtaatctttcccctatccaaccctcagcacccccaccccgcccccagccacacactctcagatgacttcctgggctgcatgtggttcatggaatatgaacagtagctgaaattcagcctaagagggtaaaactgatagaaaattatacaattggaaagtgggaaggtcatgaagctatgagcacatctagctagccacttagcatctgtatttcatcaacagttaagctattctttacttgtcaccacataaatagaatatgattttaaaatacacacacacacccccttatggaaaatgatcctagaaaggtaatgctagtgtcatctttcaagttaaagtactgttgttttttttttcccagaaatccccagttttcaataaattaaagcgattatccaattttatagttattttattctgaaacatgtataagtacaatacactctttaaatgctctatagatgttaaactggttcaagtattccaaaattaattttaataaattcatgtatgaatttcatctcacacagaatcacttgaagttacttactattcggttatgccttaaatgcttagttacatattttatggataaaaggatatgacactattattttcaaatctggatgttcaggaggatcaaaaaatgaacccttgtgaatgagaagcatttactctaaaaaaaaaacctctcactgaccaattgaccatttatactattcctcttctatccatacagataataaagttaactttaaatagatttgtgagtaagagtcaagagaatttgaaagctgggtacagaagtctgtatgctttactgaagcaccagtttaatctgacactcactgtggccttgaatgagtcacctttcagggctgagttctctaatctgtaaaatgagagtgttatgttaaatgtttactgaggttgattattctatcagctacttgtaattcagctgcatcatttcagttagctataaataaaccccctaagaccctcagtgtgaatatgaacaactatcatttcatattatttcatatatcaagtattctcatttataattgggttgaggtttattaaaaaaaaaaaaaaaagctttttggcaaagggagggactgaaaacaaattcaccactgcatggtgccctgcttgagccaatctgactggagcttaagaaactccacccagttctggctaacatcaaaggagactcaacaccactctgccagaaaataagccctgtattatctaaccaggcactaagggaacacacagttttcaagcacagcactttgtatatctgatctttcattctgatgacatgcctgaagtgaaactattagtgagccgggttttttaaaataggtaaactaaggcaagaggcaactacatggcatgatgataaaatactctcttgactacaatctcactattaagagctaggtgctcataaacaggaaataaggatatatgatgaggccacagtactttgttgtatgctttactttggatagttcacaaactctggaattaattactgtactaaaaatattttacaggtctatacagattaaacagtgttaatatctaacttaattacacagaagttctgaagaaccttttaagctccatgaagtcctcctgaaaattttaggtcattcgcatctagagccactcactcggggtctgtgctcattctgtctgatgagaaattggcaatctggtttaccaatggcctgttgctgtctctgtcctcttctattcaccccttgaaaggtgctactatgggagctaaaatgcagggaaaaaactcatgaaaagctagaacagagcttgggcaaaatggcaaaaccccatctctacaaaaacatgtaaaaattagccaggcatggtggcacatgcctgtagtccctgctactcaggaggctgaggtgggaggactgattgagcccaggaggttgaggctgcagtgagccactattgcaccactgcactccggcgtgggcaacagagtgaaaccctgactcaaaaaaaaaaagcaagaacagaagcctgattcccaccatcatactcacttttcctaaccactgtgttaggaaaccttcattttactgtgtcacattagccaaatttctaccgacattcatttgcagtagccagcattctctttttaaaagtatagaatcctatttcttaatttaaaagtgggtaagaaaatgtacatccctggaaagaccattgttcatcccagagatggttctattgaagatgtctgagttcttggttctggtgtgaaaaaggaagaaaaatattatggcaacatgggaactttcagggaataaagcagatatagatatggtatcaaagtagggaaagggtatacaggcccaggagccctaggaggcaaaagaaagggagttaataccatgccaaagacaagcttgctatctttcaaaatatcgcctcctgtcagtttcagcagaaagaaataaactttcttctcagtgacctaggctactttgaggcaaatcattttgagttccaaacaacccatttaataaactttaaataattattactaaaggtaggatactgcttataatgctcacttatattttctctataactgatagcctgtcctttttgggtgggtgggggcgggggcggttatggacaagacaaggaaccataaagatatctgggttaatgttttcttttatacgtttgtttttgcatgacatttaaatgacagagaattctaaagccaacactaagctgctatcctaggacattagtgagaatgctgtggccaaaatatagtgctcattcctcaggcttgaaaggaaccccacgtcgccagtgtgggagatcatttataatcttgatggatacaggtatagcctgcttcataataatttaatattcaacatcagatttttttttagtatgcctagcaggtttttagttactaattaactttattacccagatttgtttcttactgaacttctttcagaggcctgttatacatcaagctgaactttgtctggcagctgtgctgtttttaatttatttaaccacaaaaccttgatttatactttcaagcaaaatgatattttacttaaaaataaatctttagcaaggatgtctacaggaatcaactaccaacttacacagttcacagacacatatgattcctcagacaaatctgaatttctcctgcttctcctccaaaccagacttgcagatagcaacagacaactgaggaagatcttgactatcctgagcaataaactacaacccccctgaagaatatattaactgtccacccctaggttcctccctacacagttcaaggacaacagctgtgctattacaaactgatggaatttccaggcttgacagggttctgttcgtaaccaccatttgtcctgttcatcataggattagcaacagcagagagcccttgattactagaatagctgaggccatcacacagctacattcctacatgaaagaacacactgatataggtttaaagaagttatattttactttcatgtagttaccagagtcccccccaccccccatttaagggagccctgttctctggatataaaaatactgtatacacttgcacacacatactcacatacataaaaccttgcatcacaaagttaaaaggctaccttgcttacttacaggaactatccaggcagcttgtgttcagtcctgactaaatgcattttggatcaggcacctgccttcaacatttctgtccaaatgaatttcaatctatttctccaggaagaacacaccagatacctcccactgttagccatgtgatacaggcagcatgatgtctgaagtctggttacggttatgtaggccaaaataagaaatgacaatgacacagcacttacatttctgatatcaccaaccttaagaatgaatcttccattttatctaaattttttaaatgagtaaaactttaaaagattcttaatacctaacccctcaaaattttgaaaaaggagcattttttttaaactttacatttatcccacttccttcctctaacacaggaaaacattcagagttaatctataccaatccaaaaattatttctaaccacattctaaaggcattttttttttttttgagacagggtcttggcctgttgcccaggctggagaatgcagtggcatgatctcagctcactacaacctccgcctcctgggttcaagtgattctcctaactcagcctcctgagtagctgcgattgcaggcatgcacaccaccatgcctggctaatttttgtatcttcagtagagacgaggtttcatcatgttggccagactggtctcaaactcctggcctcaagtgatccacccatcttggcctcccaaagtgctgggattacaggcatgagccaccatgcctggctctaaaggcttacaccagttgaactgatctaggatccaatcccctcactttaatagatggaaaaaaaaatgagaaatggaaaaaacaagtcacttacaaatgaggctgagacaaaggatcggcgaaaagagccacagaacaccaaaaacagaagcagagcgtgacaaaataagcaaaaccttacagttttgtagtttctgcttttatctaacacaatgacttcgctgtacttcatataccttttgaattatacctgcttatacatacctttacctacctactacttatacctacctatcttttcttctgcaaggagggaggcaggcaggaagaatcctgaacatcaggaaaacattccacctgatctttaaagggaccccaatgcctagatgtctttttcttttttctttttttttttttttgtaaatccaaactcttacgtgtaatatcaaggctgactgacaagactcagtcctatcacccaccataatcatcagcagctttccatgtagggtctccctacaatttagtcacatgggaccatctaccatcttacattatcactgtacaccctatgctcatttgctctccaaacttgaagttatcttctctccctcctcatttgtgaaagtcttgaaatcaaggtccacataaattgtcttaccaccttttctgtgactgctttttagaatctttctcccagtagtattcagaactaatacatcatctgtacttgtaacagtagagtctgatctatactgtagttcagtggtccccaaaccttttggcaccagggacaggtttcgtggaaaacaatttttccacagatagcaggaggggtgagagggaggagatggtttcgggatgaaactcttccacctccgatcatcagtcattagattctcacaggagcatgcaacctagatccatcgcatgtgcagttcacaatagggtttgcgctcctatgataatctaaaaccactgctgatctgacagaaggcagaactcaggcacacttatcgcaaagttaatgtaatgctgttcacctgctgctcacctcctgccgtgcagcccagttcctaactggccatggactggtaccaatctacagaccgagggttggggaccccccactgtagttagttgtatataccagctcctgtaaactgctgggtcccagaagagaggaccacatcaaagtgatgtgcacaccttctctgttcctagtagactacagaggagacaggccaaaatgataaaaaccaacaaaacaaggggctaaaaacacatttctaaaatgacacgatgaaagttattagaaattgaatctaatttgaaattaatcagaagttccaaaattacaaaaactcttcacaactagaaaaagaataaacagattcaaggctgaaaggttatcaccaattacaaatattcaccttggctaggtgtggtggctcatgcttgtaatcccagcactcagcactttgggaggctgaggtgggtggattatgaggtcaagagattgagaccatcctggccaacaaggtgaaacccctctctactaaaaatacaaaaattagccgggcgtggtggtgtgcacctgtagtcccagctactcgagaggctgaggcaggagaatcacttgaacctgggaggtggaggttgcagtgagccaagatcgtgtcactgcactccagcctgggtgacagagtgagactctgtctcaaaaaaataaaaataaaaaagaatattcacctattttcttccactttctaaacacagtttgtacaagagcaagcatgttgtctggaattatagaaagaaagccagtaaggagtaaccgtacgaaccagctctccatgctggtcatcttatcattattaggcatagcaataaaaatagctctctctgcttttagaaaagcatgacatgatgcaatgtggcaaaaacaaatattcaagatggtcgaccagttactggcctggcatggtgactcacacctgtaatcccagaactctgggaggccaaagcaggaagaccacttgagcccaggaattcaagactagcctgggcaagatggcaagacaccatctctacaaaaaaaaatgtttttaattagctgggcatggtggtgtgtgcctgtagtgccagcctctcaggaggctgaggcagtaggattccttgagcccaggagcttgaggatgcagtgagctatgattacaacactgtactccagtctgggcgagaaagtgagaccacatctctgagggacagagagagaaagagagaaagatatcagccactaccatcatgttaatatgatcatataaatattaaaactttataattattaaaatattaaatctctatagttatcagctcatatatctgtcagaaagtaataagcatatcatgtaactttaggatgacttagtgctgaggagattggaagaaaggaagaatattcatacttgatcagctcttagcttttgagaactattttattaaagaaaaaactctcttttggctgggcatggtggttcatgcctataatcccaacattctggaaggctgaggcaggaaaactgcttgagcccaagagtacaagaccagcctgggcaacacagttgagactgcgtctccacagaaaacattttaaaattagcctgcacacctgtggtcccagctcttgggaggctgaggtggacggatcacttcagcagaggaagttcaaggctgcagtgagccgtgatagcaccactgcactccagcctgggctacagagtgaggccctgtcttgaaaataatagataacaaaagaaaaacttctcccattaagcaaagtgaagtttcactctattttatatcagtgaaaataaagaaaagtggaaggtagaagaggacataggaatttgtgctgccaattctataatttttgttttgttttgttttttgtggggtttttgagacggagatttttgtatttttagtagagacagggtttcaccatgttagtcaggctggtcttgaactcctgacctcaagtgattcgcctgcctcagcctcccaaagtgttgggattacaggtgtgagccaccatgcccacccttgtaattgtttatttacaatgtgtgtcccacccagagttccccttaacgcttgagttcctcgatggctaggatagcatctttctcaccttttatcctggacatctaaatataataaacttgaaacctcacaggctctcattaaatgcacatttgtcctgctaggtgcgctctgctccataccataccagccttctcttgctggggttgatgtttgcacagctggaagcaccctcatagttcttctaagtattggttctaggcacgactaagggtagagtagctcagcttttctgagcaagaaggagaagatacaaactctatgggagtacttaacaagcattttgtagtcgtggcaaaggccttactttgacctaatatcttacagatgctttcaaaaaggagggggggaatatcattattaaatgaaaattgaacagcaaaagttgaagagatctttcaagttattagtaacataacttttaatattttacctgaaatacaagtaaaaatctgaattaaaagtattaaaaaaacaaaaaaaacacgctggatcagaattgttcagggacagggttaagcaatatgagtattatttgttgttgttgttttgttttttttagagacaagtcacactatgttgcccaggctggagtgcattggctagtcacaggtgtgctcattgtacactacagcttcaagctcctgggctcaagcgatcctccagcctcaacctcccaggtagctgagactagaagcatgtgctactgcaccaaaaatctcagtgttgttggttttcttgcagtaagggtaatcatgacacagagaaatctcattaaagttgagtccgagaggcacccacaattgagggtcactgaattaatcaacaatctacctaatccattcaagataaaattcactgaaatgaaatgcaacacaggattaatacaacttaacaatagaaagacatcacactcccccttgttaggaaggtgttttagaatcagtttactagatgtagaatctgaggcacggatttttgtacaagtgatttactaagggagtgcttttaggaaaaacctataaggttttattttattttaaggttttatgatattttaaaggtatcaactatccccaaactaatctatagtttttgtttgtttttgtttttttttttagacagagtctcactctgttgcccaggctggagtgcagtggcacatgatcttggctcactgcaacctccgcctcccaggttcaagcaattctcctgcctcagcctcctgaatagctgggaccacaggcgtgcgccaccacatccggctaatttttgtatttttagtagagacagggtttcaccatgttggccaggctgttctcaaactcctgaccttgtgatccacctgtcttggcctcctaaagtgttgggattacaggcgtgagacaccacgcccggcctaatctatagatttaacataaccccaagcaaagtccagtaggttttttcttttcaaatcaaactgaaaagttgatcctaagttttacatagtaatttaaaaagtcaagaacagctaagataatctttgagaacaaacttagaggaacttaaactactggatatcaaaacttactgatggattgaaccatgtgaaaatgctgaaaactgatgagtttctaacctatggcaatgtcatatgtttgaaactaaaaatacataaatatagtaatgaaaacattgtggtacctgcacaatcaccaagaaagaggccaatgtacttggtgtgctgaacatatggaaaaacaaaacaaaacaaaacaagaggccaatgcaaaaaaatggttttgaaacggaaccacatgcatatggatacttaatatctgacaaatgtgacactgcaaaatagtgggggaattaactgtcttttcaataagtggtgctgggtcaactggatattttgagctctacctcacagtatatacaaaaagtaattccaggtggatggcagccctaaatgtgaacggtaaacaataacatggcgaatattttcatgatcacagaggcagatgaagaaaacgaacagacaatggagagagtagagagacagggacaaaagaaggaaaaaagaaaagcaaaaagaagatgatgaggtgggaggatcatttgagcccaggaatttgaatacagcctcggcaaggtggcaagaagggagggagggaaattcccctcagcagtacttaccaacttacaagaaacagatgggcttatttctaattgtaacactaaatgattttttttaaaaaatgaagtgatgcctttaaaactgagaaaaactattttgaagctagatttttacagccaactcatccattaagtgaaggctaaaatgggaaattcaaacacacaatttaaaaaaaattattggctgggcgtggtggctcatgcctgtaatcccagcactttgcgaggctgaggcgagcggatcacaaggtcaagagatggagaccatcctagccaacatggtgaaaccccgtctctacgaaaaacacaacaaaattagctgtgcgtggtggcatgcgcctatagtcccagctactcagggggctgaggcagaagaatcacttgaacccgggaggcagaggttgcagtgagccaagattgcgccacggcactccagcctgggcaacagagtgacactccatctcaggggggaaaaaaaaaaatttattttccaggcattctttctgaaaatgaacttcagcacagactccaggaaatgaaaaatgaacacagcatcctattaaagctgcaatatccaaaaaatagtaccattagcctacaagagaaatgaaatgcaatcctaggatgacgataatgcactaggatctagaaacaactctgtccaaaattaacctttccatagtgtaatttaaaaagaccaatgacttagacatgtggtgcaaatggtatatgaaaaaaggtgcaattaaaaacaggggaggggagcagtttactgaaagagaactacacaagaaagtactaatccaaacataaggcaaactgaactatggcattattctgagataattatatattttaaggagacaaggcttagaattagaacactctcatcaaacttaccaacataagatggatccataaagaaggatattttgtatttacatacaaatgaacatgtacaatataatgtatcaagaaagaacaaaaaaggagaaaagagaaggaggcttcggaaagatggagatgactccaaaacagcagctgaaatcaactgaaagacttttgctgactctctgagtttactcttaagtgggcagaagtcaaagagaactttgcctgctcactggaatgtgtttctctattggtctctaagtctgcatgtgctgacctttaaaagacagtataaggtttgtctgttttcccttctgctagcaggctgctagactgaacatggtagacaatgactttccctctgaagttggctgtgttcaatattctattgtttttcttatacaagcactgggagatttttgcaattgatgtatttttaatcatttaaaactaagcaagccatgacaatataaaagacaaacttacaccacaaatgaaactactaacaaaaataacaaatatactcatctggggatggcaggggttggggggagaccctctcctaaacatagcaagcaccaaagggctgctttgacttgcaatactaaactccttccaagaaatttggaagtaaattcagagtaaccaaagatacaaaaagcaatatgcaacaggagaaagtatttgggtgtgaataaagaatcaaaaaatgggccaggtgcagtggctcacgccagtaatcccagcacttggggaggccgaggcaggtggatcatgaggtcaagagatcgagaccatccaggccaacatggtgaaatcctgtctctactaaaaatacaaaaattagctgggcgtggtggagcgtgcctgtagtcccagctactcgggaggctgaggcaggagaatcgcttgaacctgggaggcagaggttgcagtgagctgagatcacaccactgcactccagcctgggcaacagagtttgactctgtctttaaaaaaaataataaataaaaaaattttaaaaatgtacaaaatgaaagggaccgtggcaaagatggggattctgtttcttctccctgggtgctcagaaagacatttcctatttcccttggagttagaagttgagaccatgtgagtgggttctagacagtgcaatgtgagctgaagaattatgcttcactacaaagcacttgatgaaattctgcttgctggtgctctttgctatcaaccaactaaatacaaagaatccagcaggagactccaagacaccagatggaaggagttgaaattcctcaattacatgacagccacaggctaaacactcacactatgacgtgagcaagaaataaaccattattgtgttaagtcactgaaatgctagttatgttaaagagttagcatcaactatcctaattaatacagagatcttacatatctaacatcctcattttacaaataaggaaactgatgaacaatgagctttccaaaaattatactagttggtaggagaaacaggtctcctgactttctattcagggacttttacaaagtaaaagatttctgtgctacatttataagtaaaagttattatcacaatatttgttccaaaaccaaaaaaaggcagtgcaatcatttctttttctttttttttttgaagcagggtctcactctggtgtccaggctcgagtgcagtggcatgaccatgacttactgcagcctcgacctcccagtcacctctgtttgcaaaaagaaaagaattctccacgaagttctttttcagtctaccattttatgatttgactctcttcatgtcgacaaaatttcttgagtatctattagaactgtataagattgtggatatctgaacatttatttactgacaaaatgtgatttcatatggcttgacttaatagtaaatgacaagcactgcatttttagaaagcgctaattttattaggtatacatacctacacacttttttttttttttttttgagacagagtctctgtcatgcaggctagagtgcaatggtgcgatctcggctcactgccacctctgcctcctgggttcaagtaattctcatgcctcagcctcccaagtagcgggcagtacaggcgtgcatcaccatgcccagctaatttttgtattattagtagagacgggttttcaccacaccgggcaggctgatctccaactcctgacctcaggtgatctgcacacctcagcctcccaaagtgctgagattacaggcatgagccaccatgacatctttttacaagaagaaataatatgctgacttggccaggtgtggtggctcacacctataatcccagcactttgggcggtcaaggcgggcagctcacctgaggtcaggagttcaagaccagcctggccgacgtggtaaaaaccctgtctctactaaaaatacaaaaattagccaggcgtggtggtgcacacccataatcccagctactcaggaggctgaggcaggagaattacttgaacctggaaggcggaggttgcagtgagccgagatcgtaccactgcactccagcctgggctacaagtgcgaaactctgcctcaaaaataataataataataataataataataataataacaataataataatatgctgacttagaggctcctggactattgtcattagaactataaagcaaagtctatacatctgaagagaaatttcttttaaatatactcttctcctgtgtccttactgctttgtattaccttacaaagaaactactacatatacaatttcagctaatgaacataaaggatcaaaattagtgactattaggccaaatgttttggccaaaattgttgcaattaccatgtaaacataaatcctgcttgcctattattccatcagtttatacttccacttaatcaaggatttaagattgagtttgccttgtcaggctcacagaggcttaaattacttgtaaataaacattcccacaagagactacatcataaacgctcatatttattacatcccactcaaatacaacagtttctcttttaaaaattggcaatctatacaaaacagcaatttagattggccttcaggacagagaggtatgattcttagtaaatcacattacatcaagatgctttattctgaagatgtaagaaacgaatatatttttacaaaaacactatatgtcaagtgaatatatggttagagtgtaagaaaaacttatttcccttgtctttaagatttttctagaagaatcttaatcttcctataaaaccacctgtctgataaaaggaagtctgaaatcttatctccaaataaatcttatctcaaattaataaaagactaaatttcagaagtttctcagatttcatttttgctgttacagtaattaagttatgccattatcttatgcagttgattttaagtgatgaacacccacctacatcattatttccatatagaaccaccaacaattaattagttcaaactaaaaataatgaaataaagtattaaaatgttctccataactaagaaaatactgtcactgtcagctttactatttctacccatcaccacgactaccccccaaaaaccctacatatcaatacagctttcatcaaattagaatcaatttgcttgaaaaaacagaaacatatgcatcacccattactatgtacacatctgccagataatgattagaggcggcaagtatgccaagagtccaaaaagcaggtgagaatcttctgtagcctagaaaaaagtgtatctagagaaaacataatagtctcctctattcccaaagcacttaagactagtaagacttcctgaagtctccaactcataaatggtcattgtttcacagctcaagtaaatacatgtatgaacatgtaaaataaaaaagagtaagggagaaccttaaattctccagtttactctcaaattttaaaactcagaaaagagagatccaaagtggtttccctttgccaaaagccatctagaaaactagagacaaagctacaattaggacaaacatctcccaactcccaccaagcccagagttccctccccaaaatgaatactcactgaacccacaagagaagcaccagttcagagtgcaaacctaggtcaaacaggccccttggtgcagtggcccatatagtgttttgaaaaatggccaatatctccaaaatcagtaatctttgaatgaaaatacagttttacagcttttttaaaaaacagggccaggcgcgttggctcagtcctgtaatcccagaactttaggaggctgaaatgggaggatcccttaagcccaggggctcgagaccagcctgggcagcacagtgaaactccgtgtctacaaaaaataaaaaaaattagccgagcatgcacctgtggttccagctactcaggagactaaaatgggaggatcgtttgagcccgggaggtcaaggctgcagtgagccatgattgcggaactgcacctcagccttgggtgatagtgtaagaccctgtctcaaaaaaataaaaaatccgaagatcaggccatgactatgtatttccacttagcaacaatatactggagctgagaaataactgcctctgtagatacccattcacacaatatctgcagcataagttcttaatcaagaccaacttcactcactttaacttcaagaacgttgcaggggccaggcactgtggctcacgcctgtaatcccagtactttgggaggccaaggtgggcagatcacctgaggccaggagtttgagatcagcctggccaacatagtgaaacctcatctctactaaaaacacaaaaattagccaggtgtggtagcacacgcctatagtcccaactacttgggaggctgacgcaggagaatcactcaaacccaggaggcggaggttgtagcgagccaaaatcgcaccactgtactctagcatgggcaacaaagcaagacaccatctctggggggggagggaaatttgcaggagtttaagtacgacacagctgcactaaagctatttaaatcaacatcaactctaaacatttcttattggtagtagaattttggctgggttttagtggcttggtttaactaaatcacaaagtcagtagacaggaaaggtgtgagagggagagaaatggaaaacaaaagtaccacaaaatggctgggcacggtggctcacacctgtaatcccagcactttgggagggtgaggcaggtggatcacaaggtcaggagttccagaccagcctggccaagatggtgaaaccccgtctctactaaaaatacgaaaattagctgggcatggtggccggcgcctgtagtcccaattactcaggaggctgaggcagagaactgcttgaacccaggaggcggaggtggcagtgagccaagattgcgccactgcactccagcctaggcaacagagtgagactccttctcaaaaaaaaaaaaaggtaccacaaaactagtggtaattcctttagaacataatcagaacttcattcacacatccaaaatgtcttacttctggtcaggcaccgtggcaaaggtctgtaatcccagcatactgggaggccgaggcgggcagatcgcttgagcccaggagttcaagaccagcctgggcaacatggtgaacccctgcctcgataaaaaatacaaaaaaggttagctggttgtggtggcacacacctgtagtcccagctacttgggaggctgaggtgtgaggatcactggagtctgggaagttgaggatgagtgagtcgaaattgtgccactgcactccagcctgggcaacagagtgagactctgtctcaaaattaaataagccaggtggggtggctcacacctgtaatcccagcactttgtgaggccaaagcgggcagatcacttgaggtcaggagttcaagaccagcctggccgacatggtaaaaccctgtctctactaaaaatacaaaaattagccaggcgtggtggtgcacacccataatcccagctactcgggaggctggcatgagaatgcttaaaacccaggaggcggaggctgcagtgagccgagatggcgccactgaactccagcatgggtgacagagcgagactctgtctctaaataaataaataagtaaatgcatatttttttaagtcttacttccctaggaagcaataatcactaactcctttttcagttttgtcaatgacctgaaaagcttggtcctgacacctctgctttatggaaaaggcaagaatgcatactgattcctaaggtagtaatctgaacggtttaaaattccatacatgtagctacagacaactagtataatggcagagatcttacatgatattttaagatctagttccagtagtaataaaatcgtagtaaaaagaggtaggtcgggcacggtggcttacgcctgtaatcccagcactttgggaggccgaggtgggaggatcacgaggtcaggggatcaaggccattctggctaacacggtgaaaccccgtctctattaaaatacaaaaaattagctgggcgtggtggcatgcacctgtagtcccagctactcaggaggctgaggtagggaaatcgcttgaacccaggaggcagaggttgcagtgagccgagatccctactgcacagagcaactgagcaagattccatctcaaaaaaaaaaatatatatatataatatatgtattatatattcatatgtaatattatgtattatatattacatattcacatgtaatatatattatatattttatatatatggcatttctggccaggtgtggtggctcacgtctgtaatcccaccactttgaaaggctgaggtgggaggatcatctaaggctaagaatttgatttcagtcttggcaacacagtgagaccctgtctcaattagaaaataaaaaaaaatttaaacacagcatttccagtcctttcaaactcagatgaagtttaattaaaatcttcaggggacaccccagtaaagcaacagcatacctcacacccagatgctggtttctaataccattctctgataaagaaaccaagactctttggagaaatgactaattctaggactgagaacaaaatattcaagatgagcctgaagtaccttgtatttccagaaagttaggaagtgctaaaaataaaaataaaaaaaaaaaaacaacgataggggtaagttggccggacgaggtggctcaggcctgtaatgccagcactttgggaggccaaggcaggcagatcacctgaagtcaggagttcaagaccagcctgaccaacatgattaaaacccgtctctataaaaaacccaaatattaaccaggcatgatggtgggtgcctgtaatcccagctactcgggaggctgagacaggagaattgcttgaacccaggaagtgtaggtagcactgagccgagattgtaccactgcactccagcctgggcgacagagtaagactccatctcaaaaaaaaaaaaaaaaaaaaaaaaaagataggggtaactcaattacacaggagtcaactaaaaaagttcccaatgaccaaagctggaacaatataaacaatagactgaataaataaatgagagagaataagcaagtcttcagtgaagaattccaaacaagatactccacttccaagaggtagaacataacccttcatcctttacatgtgcatagcacatagtgacctccttctaaagagtacaatatgaaaatgggaggggggggtaagagaaatatgacaaatactacctaagccaagtgatcaagactaatatcaatagtgataaatcagctgggtgcaatggcttacatctgtaatcccagcactttggcaggccaaggcaggaggttcacttgaggccaggagttctgacaccaacttaggcaagcaacatggcgaaaccccatctctatgaaaaatacaaaaattaggctgggtgcggtggctcacacctgtaatcccagcactttgggaagccaaagtagggggatctcaaggtcaggagattgagatcatcctggctaacatggtgaaaccctgtctctactaaaaatacaaaaagttagctgggtgtggtggcacatgcctgtagtcccacctacttgggaggccgaggcaggagaatcacttgaacccaggagacggaagttacagtgagccaaggtcgcgccactgcactccagcctgggcgacagagcaagactccatctcaaaaaaaaacaaaaaaacaaaaaaattagccaggcatggtggtacgtgcctgtagtcccaactacccgggaggctgaggtgggaggatcacttgggccctggaggccagggttgcggtaagccacgatcgtgccactgcaacccagcctgggcaacagagcaagactctttctcaaaaaaaaattagctgggcttggtggcatgtgcctatggtcccagctatttgggaagctgagttgagaggaagcttgagtcgagtccaggaggttccagtgaactgtgatcacagcactgtactccagcttgagtgataaagcaaaacacacacatacacacacacatacacacacacacacacacagacataaatcatgctgacatgatttgatagtatgcacccttgatataatgtgataagagtggcactttacctctgtgatcttccttctaaaaagcataacctctgtctaatcatgagaaaaagatcagacaactcccaactgaaggacactctacaaaatatcagaccagtactcctcaaaactgtcaaagtcatcaaaaacaagggaggtgtaagaaactgtcatagccaagagaaagctaagtatgataactaaacataatgtggtatcctagatgagatcctagaacagaaaaaggtatttaggtaaaaattaaggaaatctaaataaactatgaactttagttaataataatgtatgaaaattgaggtcaggagttcgcgagcggcctggccaacatggtgaaactgcatttctactaaaaaaaaataataaaaaaattagatgggcatggtggtgtgcgcctgtaatcccagctactagggagactcaggcaggagaattacttgaatctcggaggcggaggttgcagttagcccaagatcgcaccactacactccagcctgggcaagagagcaagactccgtctcaaaaaaaaaaaaattagccaggtgtggtggcaggcacctgtaatcccagctactcaggaggctgaggcaggagaatcgcttgaacccaggagacagaggttgcagtgagctgagattgtggcactgcactccagcctgggtgacagagaaagactccttctcaaaaacaaacaaaaacaaaaaattctagtaataaccattatttacttccaacttaaatctgatccacgacctaaaactgcactctgaaataatctacaattcccctgagaaacttaataaatatagacaaaagtgtgtatatcaattaacttacaagtctctaatcactgcaaactagctgactctcgttaaagcttcaaatcttaaagttctaccactggtactcttagaagctaacttacccttgttgatcacagagagacaacagtgaccaagtctaataaaagcttattcatgtacacagaaacaaaacaaagtaacttggtgatgtgcacatctaatatttccaaccaaatcacaaaactttagaaagggcatttgaatccaacctccttattttaaaagtgagaaaagtccaaggagattaacaaatatatttgttcaaagtcatccctgagttctcaactaaaagtagaatttcttttctgtcctatatcccaaatcaggaagcaaggggaaaaggtaggaggtattatcattctgatcatcatttcctctgctaacttagaatgctttcgtttctcagggataaagaaggtaagtccagctatatctatgtattggaaatagcatcacatagctctcctttttaaaatggcatgccctcctcatgtggatttttatcttctatttaactatcagttatcgcactatgcttctacagttagtatctatgatgtgaaagttgaagccctggttaaagcttcttaaatctaccattttattttgtacaaacagaaaagtatattagttttctttccagctgtccttaatttttttaattgaagtgaagtttacataacatacaattaaccattttaaagtacattatgatttctctccagtttcaaactgtccttaagaatttttttatttttatttttaatttttttgaaacgggagtctcgctctgtcacccaggcttgagtgcagtggtaggatctcagctcactgcaacctccgcctccgaggttcaagtgattctcctgcctcagcctccagagtagctgggattataggtgcacgccaccacagccagctagtttttgtatttttagtaaagacggattttttcactatgttggccaggctggtttcgaactcctgatcctaggtgatctgcccgcctcaacctcccaaagtgctgggattacaggtgtaagccaccgtgtccagccaagaatttttaattaaagatgcactaatccaaatgtagatgagctactcaattttcagttaattaatcacatctgaagataatgatggcctatgccctcatatcaagtgtatcctgagcccttttatcattctaatctctttctacacgtggccaaccagagtgcatacatattgtgccaagtacctttcacctttttctacatatcagtagtattctatttcacagaaaactcacactcctgccctaaacataaccacagagttaggcttattgtgtggttagcctatctggcatgcctttgtctcacaaatgcttagaggacatttcacactacttagaaaggaatgatctcatcccactgacccaacagctaattttatcaaaaagctttttgttaaaagctgtgataacccaggaaaccagatctatttttacttttatggcaaggaaaaggaacagagaaaaccataaggaaaaaacagctcacacattgaccatttaaaaaaatcacttaggggcccagcacagtggctcatacctgtaatcccagcactttgggagcccaagacaggtgaattacttgaggtcaggagttcgagaccagcctggccaacatagtgaaaccccgtctctactaaaaatacaaaaaaagagctaagcattgtggcacacacctgtaatcccagctacttgggagtatgaggcatgagaatcgcttgaacctggagggggaggttgcagtgagctgagatcatgccaccacactccaccctgggcgacagagagagactctgtatccaaaaaataaaaaattttttttcacttaggccaggtgcagtggctcacacctgtaatcccagcactttgtgaggctgaggtgggaggattgcttgagtccaggagttcaagaccagcctaggcaacatactgagaccttgtctctacaaaatatacaaaaattagccaggcatggtggcacatgcctgtaatcccagctccttgggaggctgaggtgaaagatttgcttgagaccaggaggttgagtctacagtgagctgtgactgcaccactgcactccagcctgggagacagagagtgagacactgtcaaaaaaaataacttattctacagttttccccctttctttggtgtctgactacaagtgaacaaaaagaaaaactttcagaattgtttaatgcaagaaaaaaatcattattttaacaattaaaaagcaaacttcatattacagtccaaacactaaacctaccttgggtctgatttgtatgaaaaaaaaaaaaaaaaaaggatttctctccaataagaccccaagaaatatacaagtcttcagtgggagatgcaatataataaaatgacaaaatattaaaattgaagaagaaaaaggaaaaaaaaaaaagaaactccaacccatataaaaaaataagaactagaccagatgcagtggctgacacctgcaatcccagcactttgggaggccgatgagggaggactgcttcagcacaggtgttccagatcagcctgggaaacatagggagatcccgtctcaacaaaaaatttaaaaattagccaggcatggtggtatgtgcctgtggtcccagctactcaggaggctgaggtgggaggattgctggaacccaggaggttgaggctgcagtgagtcgtgatggcaccactgcactcactcaacagagtgagatcctgtctcaatagactaaaaataaaaataagaagagccagctgggcattgtggctcacacttgtaatcccagcactttgggaggccaaggcaggaggagcacatgaggtcaggagttcgagatcagcctggccaacatgatgaaaccccgcctctactaaaattacaaaaattagccaggtgtggtggcacacacctgtaatcccagctactcgggaggctgaggcatgagaattgcttgaacctgggtggtggaggttgcagtgagccgagatcccaccactgcattccagcctgggcgacagagcgagactccatccccccctctcaaaaaaaaacagcagttattgcagacttatattccagagaccattctaatcactttacataaattactttgcttaatatgttgaacaactctaggacatagataaccccatttaaaatgaggacaccagggcacttagaggttaaataacttgcctaagattgctcagctagtaaagtggcacaactcttaatttactaccaaatattgtctctcacagcaatctttatagcaagctctatgcaaagcaaaatgatcattcaacagactgaaaagtcaaaggctatgataatagcctttaacaattgaacactagtttaattgtttataacgctacctcccaccttttccacccacagccacccaatcccatccaggctgggtaaccagttagctcccttcaccaacaccactaccgacctgaccctcaaatgtaacacgtgaaactgccacacattaagcattcatctcctattaactttatgcctcctgttttttaattcttaaaaacagttgttattcatcatttatcatatttctgtgtactcaaagtacatgaatgtgccttctgtcttcgtaggtccaagggggcgccttcttgatatcgtcatgtatagagctatggccaaatgctgtgacatagggtatgcccctccagactcttgacgaggctgttctttctatgtaaacagtaccagtctctgagctaaaacacttaagaaacacaaaatagatcaagagcactgtttagagtgaatctccctaagtttatatgtatcaatcagtatgcatatgaaaaccaaatgagtgaaggcggctgatgtaaacaaaagagcctgcaacaggcaaacataagcaatgaaagctaatatagtatcttctggtgtgtagaccagctgtctgactttctaatggtgaatgttagcctacagtaagataaaacaaaagatgactataaggctgagagataaagactaaaatgaggttactggcttacagcctgaaaagtattctgaagccaaaaatcagatacagaatttggacccctatgaaatgcataaggctctccccaaatctcaactacacctccctaccctgtcattgattcttagtgggtcagaatacattcagtaagaatactagcatcaacatgaaataaaatctaaaaaggaaataaactctagtaaataaagttctgaggaaagtaaaaaagggtccctccaagaataggaaaagctgtcacaagaggtacagaacctccctttagctcttcatgtgctggattgatcctatatactcaaaagctgcatcagaatgagtaacatatgaataagagtggataagaatactaaatcaaaaatgatttatatcaattattgtccatcttcaatactaaaataattctttcacgcttaataattaaaatgctattcttcttctccaccttttcactttatttatttatgagacagggtctcattctgttactcaggctggcgtgcagtgacacaatcttggcttactgcagcctcgatctcctgaggctcaggtgatcctcccacctcagcctcccaagtagctggaactccaagcacatgccaccatgcctggctaatttttgtattttttgtagagacagggcttctccatgttgcccaggctggtctcaaactcctgggcccaagcgatcctgtcaccttggcctcccaaagtgctaggattacaggtgtgaaccacagcacccagcttcaatattttcagtacctacccctcaacctacctccatccctatgaaagtcgccatgacttcaggagcactctatatgatatgtacttctagtacacagttaatgtatgacatgtgcttctactataccactttattatttatgtgcctattaccctctataaactgtgagctcaagagtgaggattttcggccaggcacagtggctcacgcctgtaatcccagcactttgggaggccaaggtgggtggatcacctgaggtcaggagtttgaaaccagcctggccaacatggcaaaatgccatctctactaaatatacaaaaattagccaagcattggtggcaggcgtctataatcccagctactcaggaggctgaggcaagagaatcgcttcaacccagcaggtggagtttgcagtgagccgagatcacgccattgcattccagcctgggcatcagagcaagactccatctccaaaaaaagaaaaaaaaaaaaaaaaaagagtgaggattttcggaatatttggatgctcacccagcacctatcccagttccaggagcatggcagatgcaaaagaacgtatgaaagagtgaaggaaagaaaaatatgtgtttttctaattctcaagtcttcatttttttctttttatcaccatccatggcaaaaaaaaatttatattatgatccatattcacatacacatatataaatgaaacagaagttttataaatcaatactcatccatactatgtacaatgcactgaaactttttttttttttttttttgagatggagtcccactctgttgcccaggctggagtgcagtggcacgatcttggctcactgcaagctctgccttccaggttcatgccattctcccgcctcagcctcccaagcagcggggactacaggcgcctgccaccacgcccagctaattttttgtatttttagcagggacggggtttcaccgtgttagccaggatggtcttgagctcctgacctcgtgatccgcccgcctcggcctcccagagtgctgggattacaggcgtgagccactgtgcccggcctactgaaatcttctattccattatcttctagtgttgttttgcttttaagagttggctgtaggccaagggcgatggctcatgcctgtaatcccagcattttgggaggctgaggtaggcagatcacacgagcccaggagttcaagatcagcctgggcaacatggtgagatccagtctctacaaaaaatacaaaaattagccaggcatggtgatgcacgcctatagtcccacctatttgggagggctaagataggagaattacctaagcctggggaggtaaaggctgcagtgagccgagatcataccactgcactccagcctgggagacagagggaaactctgtctcaaaaaaaacaaacaaacaaaaacagcaacagaaaaaatagttggcagtgagtcataatttgaaaaatttcagtcctggtaaaaaccaatctcttaacagaaagaggtactattaaaactggttttcagttttccagtgctgacgatcccctcacgagaacaggcctctcacaaagaatctccctccctctccagaaaaaaagagcaagcacaagaagtgcctggtgcagagccccaattcttacttcctgaacgtgaaatgcccaggatgctataaaatcaccatggtcgtcagtcatgcacaatagtagttgtgtgtctggctgctctgctgtcctctgccagcctacaggaaggctctccttcagatagagacagcactgaaagaaccctgaatcaagatgagtgggaaactatatcaataaacacatatggatgccaaaaataaataaaagtagttttcaaactttaacgtggacatcccatggaaaggtggtttaaaagagattatgaagttctattcccagaatttgatttagtaaatctgggtaggagtccagaaatctgtattttaaagcagtccaaatggttctgatgcagatgataaaacaatccttatcagaaacatgcttacataatttaagatttaatctcaaaagtcatagcttgaactcttcttgcactaagttaaaggttaaacaaagtatctgcaagaggattctgtcctgctaacagactggtttttaatctgaacattgtttggctcaacagtcctttcatagacttcctctaaagcaacttggtaagccactaaaatctaactgttcctcttaactacagccctttgcaccaagaaaacagaagaatgatataaatgaaaggcatttctgttgcccagtcattggctctataactgaaagggcttttgaaaaccagtcacattgactatacaagtgacatatgcagtcatcagtttggaatctctaaggactacagctcaaaaacaatcactaacagctcaaagtctgaccccaaagtgcttaaaagccattgatgaaataaagccttcataagaacattctacaatccacgcttctactccttgctattacaagccaataggatcttaaggttttaaatttgacaaaatcatattatttatttttatttttttatttttttttgagacggcatcttgctctgtcccccaggctagagttcagtggcgtgatctcggctcactgcaagctccgcctcctgggttcaggccattctcctgcctcagcctcccgagtagctgagactacaggcgcctgcagccatgcccaactaatttttttttattgttagtagagatggggtttcaccatgttagccaggacggtctcgatctcctgaccttgtgatccgcccgcctcggcctcccaaagtgctgggattacaggcgtgagccaccgcgcccagcctatttatttattttgtaagacagagtctcactgtcacccagctggagtgcagtgccgcaacctcggctcactgcagcctctgcctcccaggttcaagcaattctcctgcctcagcctcctgagtagctgggactataggcatgcgccaccacacccagctaatttttgtatttttagtagagacggggtttcaccaattggtcaggctggtcttgaactgctgaccttatgatctgcccgcctcagcctcccaaagtgctgggattaaaggcgtgcgtgcgccaccacatccagccaatttttgtatttttgatagagacggggttttgccgttgttagccaggctggtcttgaacccctgacctcaggtatctgcaagccttggcctcccaaagtgctgggattacaggtataagccaccatgcccagccaataaaattgtattttaaatgcaccaagtacctgcgtcaacaatccaaaaatgatattaagaaaacaattctgcttaaaatagcataaaaaaatacttaaaagaagtgaacaatttatttatttattttgagatggagttttgctcctgctgcccaggctggagtgcagtggcacaatcttggctcactgcaacctccgcctcccgggttcaagcgattctcctgcctcagcctcctgagtaacagagattacaggcacatgccaccatgcccggctaatttttgtatttttagtagaaatggggtttcataatgttggtcaggctagtctcaaactcctgacctcaggtaatccacctgccttggcctcccaaagtgctgagataacaggcataagccaccgtgcccggctgaagtgaacaatttatactctgaaaaattaaaaaaaaaaaattcctgaaagaaattaaggaagatttaaataaatggaaagacatttaagttcatggatcagaagatttaacattgctaagatggcaatgcttcccaaactgatctacagattcaggcacagtggctcactcctgtaatcccaacactttggtaggccaaactgggcattattacttgagcccaggagttcaagaccagcctgggcaacatggcaaaaccccatctcagtctgggtgatgcggtgcgaccctgtgtccaaaaaaatacatgaaaatcacaccaagcttctttgtagaaattgacaatcaatcctaaaattcatatggaaattcaagggacccagaatagctaaaacaaccctgaaataaaaacaaggttgacggacacatactttccactttcataacatactacagaaagctataatagtcaagacaatgtggtactagtataagcacagacaaagtcctgggagggtagcacacccgaattccaccaggagagatgctcctgctctcaggacctttccagaccttgtcttatatatctcttcagctggctatttatgtgtatcctttaaaatatcctttgtaataaactggtaaacatgtgttttcgagttgtgcgagctgctctagcaagttaagcccatggctataaatgggaacaccaatttatagccagtcagtcagaagcacaggtaaaataagcgggagcttacaactggcatgtgaagtgtggggagaggcagtcttggaaactgagccctcaacctgtggaatcttgatgctatctccaggttgattatgtcagaattgagtggctgtcagctgcagaaatgactgcttgcttgcctgctggtggggagaaatccccacacatctgctttcagtagggtgctataagaatatcagcagtaggagaaacggagtttgttttttccacacacacctgtatctaaaataccaaaaactctggcaacttaataataaaaaggcaaattaatttaaaaatgaacaaagaatctgtacatttctccaaagataatatacaaatggccaataaacacattagtcaccagaaaaatgaaagtcaaaaccacaatgagatcctacacccagtagcatgactaaaataaaaaaaaacaggtaatgaatggcaagtgttttagatgtggcaagaactggaaccctcatatactgctaatgagaacataaaatggtgcagccaccttgaaaaagtctgggagctcctcaaaagattaaacagagttaccatatgaaagcagaaataacccaaatgttcctcaacaaataaatgataaataaaatgaggtacatacatacaatggaatattattcagccataaaagggaataaagtcctaatacatgctacaagatgggtgaaccctgaaaacatcacaaaagaccacctactatattaatctgtgtatataaaatatccagagtaggtaaatttatacagaaagtagattcatggttgcctggggcttggggtttattgtattagggagtgataaagaacatgggatttcttttgggggtcatgaaaatgttctagactttactgcactaatggtgcacatgtctgtgaatataccaaaaaacaatgaattgtacattttatttatttatttattttttgtgatggagtcttgctctgtcacccaggctggagtacaatggcatgatcttggctcactgcaacctccgcctcctgagttcaagcgattcttgtgcctcagcctcccaagtagccgggattacaggcacgtgtcgccatgcccggctaatttttgtatgtttagtagagacggggttttgccatgttggtcaggctggtctcgaactcctggcctcaagtgatctacctgcctcggccttccaaagtgctgtgattacaggcatgagccactgtgcctggcctgaattctacactttaagtgggtgaatggtatggtatataaaatatatctcaacaaaactgttaccaaaaagagagataacaccaaacacatgaaacttccttcctatgagattattcttaatactagctttaaggatatttcctttttgcattacttttagaatattttctacaaatattattttcagtcagtccaagttttttaaaagcaaaacttgtcaaaggaaacatactttgttagagatgcatatacaaactctgcaaagaaaaggctagttagggggtacccctaaaaactaagaagaaaaattaaactttccacagtttacaaacaggcagctttcattttacacaatagtgcaaaaccgtaaaagtaagaatgcacgctgaaaccatgcaaagtgatcataataattaatgagaaaaactgcaattgctctgtaatctttttttttttaaaattgagacggagtctcgctctgtgtccagtctagggtgcagtggcgcgaccttggctcactgcaatctccacttcctggggtcaagcgattctcctgcctcagcctcctgagtagctgggactacaggcacgtgccaccacacccagctaatgtttgtatttttagtagagatggggtttcaccatgttggccaggatggtctcgatctcctgacctcgtgatctgcccacctaagcctcccaaagtgctgggagtacaggcgtgagccactgcacccagccgctctgtaatttttttttgtttttgttttttgagacagtctcactctgttgcccaggctggagtgcagtggcgcaatctcggttcactgtaagctccacctcccaggttcatgccattctcctgcctcagcctcccgagtagctgggactacaggcacccgccaccacgcccggctaatttttttgtatttttagtagagacggggtttcaccatgttagccaggatggtctcgatctcctgacctcgtgatccacccgcatcagcctcccaaagtgctgggattacaggcgtaagccacagtgcccggccgccactctgtaatttttaaaaaattttgggccaggcacagtggctcatgcctgtaatcccagcactgggaggccgaggtgggcagatcacttgaggtcaggagttcgagaccaccctggccaacatggcgaaacctcatgtctactaaaaatacaaaaattagccaggggtagtggcacacgcctgtaatcccagctacttgggaggctgaggcaggagaattgtttgaacctaggacgggttcactacagaggttgcgtgagctgagactgcaccactgtactccagcctaagtgacacagtgagactccatctcaaaaaataatttaaaaaataaaataaatattacccaggggtggtggtgagcacctgtaatcccagctactcgggaggctgaggcaggagaattgcttgaatccaggaggtagaggttgcagtgagccgagatcacactactgcactccagcctgggcaacagagcaagatcctatctcaaaaaaaagaattttttttttgttgaggccaggcacagtgtctcacacctgagatcccagcactttgggaagctgaggcaggcaaatcacctgaggtcaggagttcaagaccagcctggacaacatggtgaaaacccatctctactaaaaatacaaaaaattagtcaggcatggtggtgcatgcctataatcccagctgctagggagcctgaggcaggagaatcgcttgaacccaggaggcggaggttgcagtgagccgagatcgcaccactgtgttccagcctgggtgacaagagtgagactcagtctcaaaaaaaaaaaaaaaaaaaatttcattgaaacattaaaaactctgtcagttataattataggaaaattgaaagaacaggaaaactaatcattaatgcactaaagcaggaggtgagcgaagggcaggcgagcatctctgcctcctgtcacatcagtcgtggcattagattctcataagagcacaaaccctactgtgaactgtgcatgcgagggctctagactgtgcactctttatgagaatccaatgcctgatgatcttctgaggtggaagagttttatcccgaaaacatcccctcccccagcgtccccttccatggaaaaactgtcttccactaaatcagtgctaaaaaggttgaggaccactgcactagagaacatagaaatattgaaaattataatgtttaagttctttgaaaaaatttattaggggtagtttaaatagtgcttacattcttctcatcatacaatagagacggggtttcaccctgttagccaggatggtctcgatctcctgaccttgtgatccgcctgcctcggcctcccaaagtgctgggattacaggcgtaagccaccgcgcccggctgcaatagacatcttttctatgccttagccaattgtcacactcctgtctgagtctggaatagcatcaaatactttatgtttcatatttcaatatcacagaataccttcgagagttctttcactacaaaatttcttgcatcacttcttttttttttttttttttttaccaaaccactttcttcacttatgtagataagctcaccttcactaagttatttcggctacatatccagagtgttttgaatgagagcatcagcattccctcagtgatctatttcttctataactccatttgagttcaatttgaatttcacttccactgttgttactttttggttttttcctgaactttcatctttttcggccaattctctctatcggttatcgatttttcttaactatcacatagatttatcactgggagacaaggaggtaacacaaacccatgctttgcacagttgttacttatgtagtgacagaagagctggcagcgaattttgtactttatacgattattcacagttaatatgctgtgtaaaatttaaaccatgttattagggaattggtattatttaaccaaaccatggtaagtgaaagtgtatatgagaaccacataaagcaacaactccctgtatatcacatcacaaaatcacagaacttaaaagccttcttcacagtaatctagccacagtgtgtatgtggacccttgatgtagtattaatgacccgtctacttcctgcctgaccatttcaagtgatgcccacattacttcacagggtggctctttcattgttgaacacttctaacagttagaaaaataaagcccccagctagtataatggtcaaaagcacaggttctaaaatcagaccacctgaattcctatcctttcttttcctctgttgagctaggtaaatttgggcaaggtatgtaatctctccatgactgtttactcatctataaaataaaaatgttagccgggcgcggtggctcacgcctgtaatcccagcactttgggaggctgaggcgggtggatcacgaggtcaggagatcgagaccatcctggttaacacggttaaaccccgtctctactaaaaatacaaaaaatgagccgggcgtggtggcaggcgcctgtagtcccagctactcgggaggctgaggcaggagaatggcgtgaacccaggaggcggagcttgcagtaagccgagaccacaccactgcactccagcctgggcaacagagtgagactccgtctcaaaaataaataaataaataaataaataaataaataaataaaaatgttaaggccttcaatcatgaagttgttatgagggatggcaagtgttcagtaaattataacctatataatttatcatattatcatcatcgtctgtagagtgcttagtcttccttatccatccccatgtactttggttcaaacccctcacctagattctgcactagactcaactgaacactgacagtctctcacccagttctccatatggtcaccagaattatctctctaaaaataaaatctgactccggtcagcataaacaatttagcctaaagccatcaggtagggtagagcaagcagagcaaaatcagagtcttcgtttaggggtggggaggaagccatggtggctgaaagcagggtatcaaataccaagcaaagtggggagggaattcatgtggtaaggtggcctggcccaacataacttataaggagtcaaaagacggctactattttaaaaagatgacatgaaacctacaaattgaggaaacacaatagtccaagagggaaagaaaacccaacatctgtcaagtagacacaattacttactttaactccatgttttcttgtttccttgtaaacacatgggtgttttggtgttcgttcattttgttattttcttagcactggttttcacaaaattcactttcggaataaaatttcatttggaatgatgtctctcttgaatttgtcaacaaaaggaaactcctagtgatgcctcatcatcagctacacaaatatttggtatttgaaaaaatgctggttctttaaaaaacacatttgtggttctctatcacttaaaaaataaagagacagagagagatgtttggcacagtgacacacagcctatagttccatctacttggaaggctgagacagaaaggattgcttgagtccaggagttcaaggctgcaatgagctatgattatgcctgtgaacagccactgtactgggcaatgtatctagactcccatcttttaaaaagagagagagaaagagaaagtacaaaagagaaaagaaaatgacaagaacaaagaaaaaagcagacaatattaactgtgaatctaaaataggttgtagagctcctcctgatgctgtaacctgatcatggtgcacactgataagctcccattacaacataagaaagccacagacaatggagcaagtcatcaccttccttgtattacaatctcatgtccttgctttggatgctgtgcctcctaaccacacctagtaaaagtagcatcacttatttggcaacatctagtatttaagaaccaagtaaaggcctgaaaggaattaccaggcaagactggatggtactgtgcaaggaacacacactttatcatcaggtagatccagatctcaattatcttttttttttttttttttttttttttttgagacaaagtcttcactctgtcactcaggctagagtgcagtggcagcgccaaggctcactgcatcctcaacctccaggactcaagtgatctcccacctcagcctccagagtagctgagaccacaggtgcatgccgccacactgggctaattttttaaatttttttgtagagacaggatctcactatgttgcccaggctggtctcaaacattatgacactgatacataactgttaactagactacagaccttattcagttttcactattttttttaacctgcatttgtgtgtgtatttctaagcagttttgtctcatgtatagatttttataaccacaactgcaatcaagatacagaactgttctgctacctctctgtatttatagcccctccacctactacccccctgtcccctggcaatcactaatctattcttcatctttacagttttgtcactttgagaatgtcatataaatggaactatataatatgtgacctcttgagataagcttttccactaagcacattacccttgtagtctattcaaggtgttgcaggttatctatagcttgcttgttccttttgattactcagtagtattccatgctatggatgtcatatgttttgctttacacttgttgacacaacatttggattggttcacattttgctgttttgaataagtctgctatgaacagttacgtacaagtttttaagtgaacataaattttattttatttggagtaaataaccaaaggagtgatttctgggtagtatggtaagtacatgtttaatttttaaagaaactgccagctggatccagcacctgtaatcctagcactttgggaggccaaggcaggaggatcgtttgagcctaggagtctgagaccagtctgagtaacataaccgtaccctgtctctacaaaaaatgcaaaaatcagccgggcatgatagtgcatacctatagacccagctacttgggaggatgaagtgggaagatcacttgagcccaggagttcaggttgcagtgagcaatgatggcaccactgcactccagccagggtaacagagtgagaccaggtctactaaaaaaattgactagtaaaaattaaattaaggccaggtgtggtggctcatgcctgtaatcccagcactttgggaggccaaggcaggcggatcgcgacgtcaggagtttgagaccagcctggccaacatagtgaaaccctgtctctactaaaaacacacacacaaaaaaatagctgggcatggtggcgcgtgcctgtagtcccagctactcgggaggctgaggtagtagaattgcttgaacccaggaggtggaggttgcagtgagccgagatcgcaccactgcactccagcttgggcaacagagtgagacttcgtctgggaaaaaaaataaattaattaaattaaattaaaaatttttggccgggtgcagtggcccatacctgtaatcccagcaatttgggaggccaaggcgggtggatcaccggaggtcaagagtttgagaccagcctggccaacatggtgaaaccccgtctctactaaaaatacaaaaagtagctgggcgtggtggcacacacctgtaatcccagctactcgggaggttgaggcaggagaatcgcttgaacccgggagccagagattgaagtgagccgagatgacactactgcactccagcctggcaaaagagcgagactccatctcaaaaaaaaaaaaaaaatagtaaagtcaaaaggcaaataacggagtagaagaaaatatttgtgttacatgtactacacaatggattaatttttataatatactaagtgctctcacaaacaaacagaacaactatcaacaacccaacagaaaaatgagtccaggacacaaactcttcatagaaatccaaataataaatgtgaaaaaaaaattcagcctctttcatctaaaaagaaatacaaattaaacaatgagatactatttttcatttctcagaaagattcggttttcatttaatattcctgtattatctgattttcttagtgttgtttcaatttatcataaacttaaaaaaaaaaaaaaactatagaggacgtgcgcggtggcccacaactgtaatcccaacactttgggaggctgaggcaggcggatcacaggtcaagagatcgagaccatcctggccaacatggtgaaatccatctctactgaaactacaaaacttagctgggcatggtggcgcatgcctgtaatcccagctactcgggaggctgaggcaagagaatcgcttgaacccaggaggcagaggttgcggtgagctgagatcgcgccattgcactccagcctgggcaacaagagtgaaactccatctcaaaaaaaaaaaaaaggcagaaagccaaaactattctaaaagatttttctttaatccctcatatatcgcggtacaaaaattgacaaacagagaaaagaatggaagaatgagggaagggaacacaaacatcttggattcacagtctatgcaaatgctaatcaaatcacctttgaaaaccattcaatttccacacacacacacacacacacacacacacacacacttaggctggctgtggtggctcatgcctgtaatcccagcactttgggaggccaaggtggatggatcatctgaggtcaggagttcaagaccagcctgggcaacatggcaaaaccccgtctctactaaaaatacaaaaattagctgggtgtggtggtgtgcacctgtaatcccagctaccaggaggctgaggcaggagaactgcttgaacccgggaggcagaggctgcagtgagacagagcaagactctctctgaaaacaaaaacaaaagaaaatttaaaaaattaaacacacacactcagacccacatatccttttcaagtcaaccaaaccacagccagtctttaatttctttatagcaccattgagactcttaaatttctttgaaataaactataaaaatcagactcttctacacattcttttttatggttattgattttggcaagataggaggattaaaagagggaatagtctatacagctatgtgaagtctaccaatctagatatccatcaattatgaaataactaagaatcattttagttcaaactaccaccacataatcatgttcattcaacaactacatcccaggctctagactagggttcatggctcccagcgaggacatcatactattccagactagactaaactgagtcccttaggtccctaagactcttttttctatcatctgtataaccccaatacatttaacaattttacataaattataaatcgaccatgtaagataatatcctactgccaatgtgagggctaaaaatttgatcttgcaatttgtttagtctaactctcttccagagtttcttaacaccttcactactgaaattttggacaagaaaattgttatgagaggttgtcctctaaactggaagatgtttaatagcatgccaatagcaccttcccagttgtgacccatgagaatgtttccagacactgtcaaatgtcccctaaagggcaaaatcacaactctacccctacgccaactgagagccatacaccataaaaatctaggagttgtgagtgcagggaaatggaaggattaggtggaagagtagctaaggagaacagggtgggtttttttgtttttgttttttgagacagagtctcgctctgtcgcccaggctggagtgcggtggcgcgatcttggctcactgcaacctccacgtcctggttcaagctattctcgtgcctcagcctcccgagtagctgggattataggcgtgcactatcacacccagctaactttttgtattcttaggaaagacagggtttcgctatatcggtcgggctggtcttgaactcctggcctcaagtgatctacccgcctcagcatcccaaagtgctgggattactggtgtgagccaccgcgtcctgcctgagtaatgaaaatgttctaaaactgattgtggtaatggatgcacaactgtgaaaatactgaaaaccactgaactgtacattttaagtggctgaactgtatgttttataaattgtatctcaatagagctattctttttaaaattcagattctggactccactccagatctcataaattagaatcaaaagcagaaagccaaaactattctaaaataccttccaggatcactaggaggacatttggggttcacagccagacagtgatgaacatctcaaaccacaagatgcacagaacggctaagaggaaaatgagcttgctgtgcactacccaatggttaactgcttggaaaaatatggaaactgataacgtgttaaatatgttcaataacacatctcaaatttatgtctaagaacacatttcaatttcaactccatgttaagttgaaaggatagcttcccaaattatgacatatgtaccttcacctttaaagaaacagaaactaaaacaactccaaatattatatgcttttacatctacattcattcattaagtggttttataattactggttttgagttatactgcagctactcacatcataagaaaaagacaacataaagtacaagaataaacttgagtataatttttaattagacctgatgcatcaatctgaatagctaataccaaaaatcctaagctatgaaatctaaatttcccaataaatctgaacatctgcaagtataccacatagcaattagaaaaaactgtactatggaaaagatttaagtcgttctggtttctgttttgcaagttccagcagaaaactaatgctagggttcattgaaacaacactgctagtatctcctatttcctccaagaacaaacaagaaagccattattatctcaaatgttcttctgaaaagtataatgacccttcttataatattatggaaaatatgaacaagaattttaatcaaaatagcattcgtaaagccacatgaacacttttattttttttatttttaaactttaaaatctaaatacctacccaaatacccagtgtttctaaaactaatgactaaatctgatttacttctaactctctctagtatataagtgatgtctgaactatgagattcatgtgaaaatgtacgtcgtttatttgtacatgatctgtctctcaggcactcgacctaggggagtaacacatattgatgatctccagaatgtgcacattacaacctgattgataccaaattggtgctatattcatgcatttattaacaaggaatgatgcttatatcgagcaaaaagttcatgagtagtatatatagttcttattttcacaagaaaaatatgtatatatattcacaggaaatgtctagaagaatatatatgaaaatgttattctcttttataatttttgtgtttctaaattatctacattaaataaaacttttgcaaaaagaaaaaataaatgtcattttaaaaacatacccagccaggcatggtggctcacacctgtgatcccaaaactttggaaggccgaggcaggcagatcatgaggttaagagaccaagaccatcctggccaacatggtgaaaccccatctctactaaaaatacaaaaattaggtgtggtggcacgcacctgtagtctcagcaagtcaggaggctgaggaaggagaatcacttgaacccaggaggcggagatcgcagtgagccgagatcgcgccattgcactccagcctggcgagagagcaagactctacctcaaaaaacaaaaaaaacaaaaaacaaaaacaaaaaatcagctggagcaggccaggcacggtggctcacgcctgtaatcccactttgggaggccaaggtgggtggatcatgaggtcagaagttcaagaccagcctggccaacatagtgaaaccccgtctctaccaaaaatacaataaagtagctaggattacaggtgtggtggcgggcgcctgtaatcctagctactcaggaggctgaggcaggagaatcacttgaactcgagaggcagaggttgcagtgagccgagatcatgccactgcacgccaacctgggcgacagtgtaagactccatctcaaaaaaaaaaaaaaaaaaaaaaaaaaaaattagctggccatggtggcgggctcctgtaatcccagctactcaggaggctgagacacgagaatcacttgaaacctgaaagcagaggttgcagtgagccaagatcataccactgcactccagcctgggcgacaaagcaagactctgtctccaaaaaaaaaaaagaaaagaaaagccccaacaaaagtcagtcttctttagctaaaagaccaagaaagtagcagtctagcaagacagaaaagttttagacaataaccaatctaccccagccaaacaccaagaaaatactgtggtttaaaacctacccgttctagcaaaggccaagtggggagcctagatttccaacctctcaaagctgtaattaagcactcaataccccttccaaggtggagacagaaagccaagtagggtatccaggaatttcatccctgcagaccagtaacaagatcagcggggaccacgtggggaacctgggcctccaccatattatatcaatacaaatggcagtttctttaaaaagtctccctctccctctccctctccgtctccgtctccgtctccgtctccgtctccgtctccgtctccccatggtctccctctcatgcggagccgaagctggactgtactgctgccatctcggctcactgcaacctccctgcctgattctcctgcctcagtctgccgaatgcctgcgattgcaggcccgcgccgccacgcctgattggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatagtctgagacgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccagcagccaccccatctgggaagtgaggagcgtctccgcccggcagccaccccgtccgggagggaggtgggggggggtcagccccccgcccggccagccgccccatccgggagggaggtggggggtcagcccccccgccccgccagccatgccgtccgggagggaggtgggggggtcagccccccgcctggccagccgtgccgtccgggagggaggtgggggggtcagccccccgcccggccagccgccccgtccgggaggtgaggggcgcctctgcccggccgcccctactgggaagtgaggagcccctcagcccggccagccaccccgtccgggagggagatgggggggtcagcccccccacccggccagccgccccgtccgggagggaggtgggggggtcagccccccgcctggccagccgccccgtccgggagggaggtggggggggtcagccctccccccggccagccgccccgtctgggaggtgaggggcgcctctgcccggccgcccctactgggaagtgaggagcccctcagccccgccagccgccccatccgggagggaggtgggggggtcagccccccgcccggccagccgccctgtctgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcagccccccgcccggccagccgacccgtccgggagggaggtggggggggggtcagcccccctgcccggccagccaccccgtccgggaggtgaggggcgcctctgcccggccagccgccccgtccgggagggaggtggggggttcagccccccgcccggccagccgccccgtccgggagggaggtggggggggtcagcccccctgcccggccagccgccccgtccgggaggtgaggggcgcctctgcccggccgcccctactgggaagtgaggagcccctctgcccggccaccaccccgtctgggaggtgtgcccactagctcattgagaacgggccaggatgacaatggcggctttgtggaatagaaaggcgggaaaggtggggaaaagattgagagatcggatggttgccgtgtctgtgtggaaggaagtagacatgggagacttttcattttgttctgcactaagaaaaattcctctgccttgggatcctgttgatctgtgaccttacccccaaccctgtgctctctgaaacatgtgctgtgtccactcagagttaaatggattaagggcggtgcaagatgtgctttgttaaacagatgcttgaaggcagcatgctcgttaagagtcatcaccaatccctaatctcaagtaaccagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaataaataaataaataaaaaagaaaaaaaagaaaaaaaaaaaaaagtaagcatgcgactaccatatggcctagcaactgtactcctaggcaaactgccgaactatttttcagagtggctgtaccactttactgttaactgtttcaatgtcaataccctggttgtgatattgtaccatgattctgcaagaaatttccaccaggggaaactgggtaaagtgtacaagggatatctctgtattattgtttcttacaattgaatgtaaatctataattatctcaaaattattttaaaaaactgtgtttaaaaactaaattaaaaaacacaaatatactaaatatttagacttaaggctgaactatgagttacatatccttatatcccaagcacctacaccaaagcctagaacatattagacaataaatatttattgaattagattgaacatacaatcagcacttcaaaaatataagatgcttacaaacctaacagttccatttcgttggctgtaaataaagtaacaataccttaaaacaagtgcaaaaaagttaccttcaagaaaatataaagtattctggaattttttcaaagagaaaaatgactcagtcctagactacaatgacttagatattacctcattattttggctaatttattgtacggagagagggagggaggccagtaggccggctggccagcctgcgaggcttaaaaagtaccatgtacataatttaaaaattagcatatagtagggagtctttagaaaccaagtagcacacataaatactacacatacccacccacttgcaaaggtgttttaagccaaaaatcttactctacgtgtccaagtttcatcggtatttctgattttcactaggtctggctgaacaggattatgtcttatcttttagagtaactatcagaactggtgattatctccatcatctatgaacacagtccttttcatctgataaaactggcattcggtaacaagaaagcatcttattttaccagaatgacccaagtaattcattaattaaagaaaaaaatgtatacaggaatctttattgttgctttggtttgttggttttctaaaaccaataaaacaattgtcttttcctgcataaacacctgatttgaaaatctagatacaatattattttattttattttatttatttttgagatgaggtcttgctctgtcgcccaggctggagtgcaatggcactatctcggctcactgcaacctccacctcctgggttcaagtgattctccctgcctcagcctccgagtagctgagattacaggcgtgcaccaccacgcccggctaatttttgtatttttagtagagatgggtttcatcatgtgggccaggctgctcttgaactcctgacctcaggtgatctgccctccttggcctcccaaagtgctgagattacaggtgtgagccaccgtgcccggcattacaacattattttaaacagccttcatcattaagtaatgaaagtgaaagtagagtcagcagtcagtaaaaacactttgtgattgaataattcaagtacagaattaacagccaaaactacatgaactgaacagataatgataaaaacccaatcagggccaggcacagtggctcacaccttaatcccaacactttgggaggccaaggtggggagattgcctgagctcagtggttcgagaccaccctgggcaacatggtgaaaccccgtttctactaaaatacaaaaaattagccaggcatggtggcgtgcgcctgtagtcccagctacctgggaggctgaggcatgagaatcacttgagcctgggaggtggaggttacagtgagccgagatcgtgccactgcactccagcttgggcaacagagcaagactccatctcaaaaaaaaaaaaaaaaaaaaaaaaaagacctactcaggatagcaacattacaataatggcaagccatacttattttgatcctttatggtccatatgaacacatgaaatcttaattatttgagaattcaacaacttttgggctgggtgcagtggctcacacctgtaatcctagcattttgggaggctgaagcgggtggctcacgcctgtaatcctagcactttgggatgctgaggcaggcggattgcctgagctcgggagttcgagaccaccctgggggcaacatggtgaaaccccatctctactaaaatacaaaaaattagccggcttggtggtacacacctgtaatcccagcaactcaggaggctgaggcaggagaattgcttgaacctggaggatgcagtgggctgagattgtgccactgcactctggcctgggccacagagtgagactctgtctcaaaaaaaaaaaaaaacttttgaacatctctctcttaaacctctggcctttaaaatcccaatcatatcacatttaatatacatgggttattaaatgggttcaggaattgttagtctgcagtagaactctgcaacaaacaataaacagtttcatcaccaaaaggtacctggatgtaatctcaattagtaaaaactcagtcactcatatgtcactgacatatttcctttggacaaggcaactcattctgttgatctttctcagccactatgaagtttatcactcatgcctgtaaatggtacatggtcatgaactgctacagaataaagtccaagagaacccaccaaaactgtggaagattaaaagattgatggatcattaaaaaaaaatggattatagacctaaatgtaagatacgaaactataaaactcctagaggataacatagaagaaaatctaggtgacctagggtttggcaatgacttcttagatacaaccccaaaaacatgatgtaggaaagaaaaaactgataagctggactttactgaagttaaaaattctgatctgcaaaatacactgctaagagaatagaaactcaacagattgggagaaaatatttgcaaaacacatctctgacaaagaactggtatccaaaatatacagaggccaggcgcagtggctcacgcctataatcccagcactttgggaggccgagggagatggatcacaggagcccaggagttcaagaccagcctgggcaacgtgtcgaaaccctgtctctacaaaaaaaaaaataataataatacaaaaaaaatgtagccagtcttacaacccaatctcaaaataaataaaaaattaaaaacgaaacaaaatatacaaataactttttttatttttgagacggagtctcactgtcgcccaggctggaggacagtggtgcgatctcggctcactgcaagctccgtctcccaagtacacgccattctcctgcctcagcctcccaagtagctgggactacaggtacccgccaccacgcccggctaatttttttgtatttttagtagagatggggttttaccacattagccaggatggtttcaatctcctgacctcgtaatccacccacctcggccttccaaagtgctgggattacaggcgtgagccaccgcgcctggacccaaagagctcttaaaatttaatatgaaaatgaacacctccccctccccctccccctctccctctccctctctttccacggtctccctctgatgccgagccgaagctggactgtactgctgccatctctgctcactgcaacctccctgcctgattctcctccctcagcctgccgagtgcctgcgattgcaggcacgcgccgccacgcctgaccggttttcgtatttttttggtggagacggggtttcgcctgttggccgggctggtctccagctcctaactgcgagtgatctgccagcctaggcctcctgaggtgccgggattgcagatggagtctcgttcactcagtgctcaatgttgcccaggctggagtgcagtggcgtgatctcagctagctacaacctccacctcccagccgcctgccttggcctcccaaagtgccaagattgcagcctctgcccggccgccaccccgtctgggaagtgaggagcgtctctgcctggccgcccatcgtctgggatgtgaggagcccctctgcccggcagccgccccgtctgggaagtgaggagcgtctccacccggcagccgcccagtccgggaggtggggggcagcccccgcccggccagccgccccgtccgggagggaggtggggggcagcccccacccggccagccgccccatccgggagggaggtggggggcagcccccgcccggccagccaccccgtccgggaggtggggggcgcctccgcccggccgccaccccgtccgggaggtggggggcacctctgcccagccgccccttctgggaagtgaggagcccctctgcctgaccgccaccccgtctgggaggtgtacccaacagctcactgggaacgggccatgatgaggatggcggttttgtcgagtagaaaggggggaaatgtggggagaagatggagaaatcagattgttgctgtgtctgtgtggagagaagtgggcataggagactccattttgttctgtactaagaaaaattcttctgccttgggatgctgttgatctatgaccttacccccaacccggtgctctctgaaacatgtgctgtgtccactcagggttaaatggattaagggcggagcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccttctgcgagaaacacccaagaatgatcaataaaaaaaaaaaaaaaaaaaaaaacatcactatgtaccccatgactatgtacaattgttatctgtcaattaaaaataaaataatgtttaaaaaataaaaaaatttaaaaaattaaaaataaattaaaaaaaagaaaatgaacaatgtggctgggcgtggtggttcacgcctgtaatcccagcactttgggaggctgaggcgggcagatcacctgaggttgggagttcgagaccagcctgaccaacatgaagaaaccccatctctactaaaaatacaaaaaattagccaggcgtggtggcacatgcctgtaatcccagctactcgggaggctgaggaaggagaatcacttgaacctgggaggcgggaggttgttgtgagccaagatcgtgccattgcactccagcctaggcaacaagagtgaaactctgtctcaaaaaaaaaaaaaagaaagaaaatgaacaaccccattttaaaaataggcaaaagatctgaacagacacttcaccaacgatatacgaatggcaaataagcatatgaacgaaaagatgttcaataacatatgtcatcagagaattgccaattaagacaacaataattctgacaaccgtggttaaaagaaattattaataagaaaaaaagacttcaaattcattaaaaaaaaaaaagacaacaatgagatgccaccgtgtccgtatcagaatggccaaaatccaaagcacaacaccaagtgctgacaaggatgtcaaacaataggaaatctcattcattgctagtggaaatgcaaaatggtacagccagcaaggtgagctggaatcacctatagtcccagctactcaggacgctaagccaagaggattgcttgagcccaggagatgagtctagcctgaacaacatagcgagacctgtgtcttaaaaaaaaaaaaaaaaagttatacccagtttgggaggttcttacaatactaaacatactctctcaccacacaatccagcaattgcactccttgatatttacccaaagatgaaaactcatgtcaacacaaaaacctacatgtggacatttatagtagctttattcacaattgccaaaacttggaaccaactaggatgcctttaataggtgaatggataagcaaattgtagtgtacccagacaatggaatactattcagcaataaaaagaaatgagccatcaagccacaaaaagacattgagaaacctcaaatgcatattgctaggtgaaaaaaaagccaatctgaaaggctatatactgtataattctaactatacgacattgtgaaaaaggcaaaactatgaagacagaaagatattagtggttacagtagttaaggggaagaagtagggataaataggtggagtacaggggatttttagggcagtgaaactattccatatacatattattatgaaaccatctttgcaaaaattataactgagacaattattacagtgaaagagatctgatctaaccaactccatcctgcttctaacctcccagctgtccttgttcattcctagacttagcccaaactaactttgtttgggaggaacttagtttacagtttaggttagttttcccagaacaaacccccttcctggctggggactagactgcctttgcaggactaacaaattctaacaagattagaaatcatggtttaggagtcatgcagctagaggctgcaagattctaaacctccctaaattactcctggggataacatcattattgtaaaacccaagatcgtgtttgagatattttgcagaccctatattcaatggattagctggcaccacccagactgatataaactggcctatcttgtcttgtggcccccacccaggaactgactcagcacaagaggacagcttcaactacctatgatttcatctccaacccaatcaatcagaactcctgactcactggtcccctacccacaaaattatcctttaaaactccaattcacaaattctcggacagactgatttaagtaataataaaactctggtctcccacacagtcagttctgcttgaattactctttctctactgtaattcccatcttgataaataggttctgttgagccagcgggcaaggtgaccccgttgggtggttacaattagacagtcatgcatcacttaacaatgggaatacattctaagaaatgtgttaggtgacttcatcattgtgcaactgtcatagagtgtactaaacaaacctagatggtacagcctgctacacatctaggctatatggtataatctgttgctcctaggctacaaacctgtacagcatgtaactactgaatactgcaggcagttgtaacacaatggtaagcatctgtgtatctaaacatatctaaaaacagaaaaactaaggtgttatgccaagcattacatcactaggcaatgaaaaattttcagctccactatatagaaagtacccatctctacaaaaaaagaaaaaaaattgccagccttggtagtgtgcacgtgtagtcccatctactgtggaggctgaggcaggaggactgcttgaacccagaagttccaggctgcagtgagttatgatcgtgccactgcactccaacttgggtaacaaagcaagacactgtctcttaaaaaaaagaaaagtctattaattttaaaaaagaacctctgcacaatggaatgatcttcattctttatatactactgtaccacctcataaccatgactaacattactaataccactcacatctcaaacatagcaatctaactccttacaacttaaagtgtcatctgtagaccaacaggattagcatcaccttatagatcagaaatgcaaaatcttgggtcccacactaaaccttcagaatcagaatctgccttataaaaagatcatgtgatttgtatgcacactaaaatctatgaaggcctaatccaaagctttcaattcaaaggccacacaaggcaagggggacagaaatcaaggccctgggccctcccaaagttaagccttataagacaccccaccatatacctctccaatctaaaccaagccccaaatttttcactatccctagcggactatatagaagcctgccttggtgttgagcaaatcaaaagaataaaaaattcctgagaaatcatagccacgaggaatccctgtatgcactggcatcttagtttcttataatctggataagccaatgactgtcaagtcatgcagtttgaggaaataaaaaactagtgatgccacagagtacctgacagatattaacaccaaggctaacttctcaagcaacaatgtaagccagaagataatggaatgataagttcaaggctggacagggtggctcacacctgtaattccagcactttggaaggctgaggtgggaggattgcttgagtccaggagtttgagacaagcatgggcaacatagtaagaccccatctctacaaaaacaacaaaaaaagaaacgataaattcaataaactgaaagaaaataaaatgcaatactaataaacatacaaacaaacatacaatactatgccccccaaaaaagtagttttcaaggatgaaagaaaatatatacctatatagtatatccgtagaagttttctggggacagggtctttgctgttggttagattctcaaggggatatatactcatgaaattaagaaccatttatttacaaaaacattaaaggtcattcaacttaacttcctccccagtatctctaaataccctggctctgttttaacataagttaaactcagtatcttactttaacatgaggaaactcactatcttataagaaagttacattccatttttctctttaacttctacttgatggtccttgttcttttgtcaaagcaacaaaatactaaatctaatgcctattccacttgccagatctttgatatatagttagccctccaaagccacaggttccacatccttggattcagccatcacatatatatattttttattttattttattttttgagacacagtttcactctgcctcccaggctggagtgcagaggcgcaatctccgctcactgcaacctctgctacccgggttcaagtgattctcgtgcctgaacctcctaagtagctgggattacaggcgtgcgccaagtatatcgcaggacatgcagaggtacatcattttatatatgggaccttatcatcctcagattttcttatctgcaggaggtctgagaaccaatctcccatgaataccgagggacaactgtatttgaaaatagctgtccccacctctttattctctaaatgaaacatctctaattccttttttttttttttttttttttttttttttttttttgagacggagtctcgctctgtcgcccaggctggagagcagtggtacgatctcggctcactgcaagctccgcctcccaggttcacaccattctcctgcctcagcctcctgagcagctgggaccacaagcgcccatcaccacgcccggctaattttttgtattttcagtagagatggggtttcaccatgctagccaggatggtctcgatcttctgacctggtaatccgcccaccttagcctcccaaagtgctgagatcacaagcgtgagccaccgcgcccagcctctaattccttaaataatgtctcaaatcattttaattactccatcaccagacagactgttttctcctggaaagactctatccatgctccgaaaatgtgcctcttaaaactgaacactctcattttacagtagaggggaaaaaaaaacctcaacacaatactaaaggtctggaatattatgttcccctgtattttcatttatatttttaaattttttttggcgtgattgcgccaagctggattgcagtggtgcaatcatggcttactgcagcctctatctgctgggctcatgtaattctaccacctgagcctcccagagtagctaggactacaggcacaagccacagtgcacagctaatttttacatgttttgtagagacaggggtttcactttcttaggtttaaaaatatagaggcggtctgggcatttatgcttctgactacctgaataataccacctccccgttactgtctcaaagttaacaagagaaaccttttttttttttttttttaaatccccagacagagtctcactctgccacccaggctggagtgcggtggcacaatctcggctcactgcaacctctgcttcctgggttcaagcgattctcctgccttagcctcccgagtagctgggattataggcatgcaccaccatggccggctgatttctgtatttttagtagagatggggttttgccctgttggcaaggctggttttgaactcctggcctcaagcaatccacctgccttggcctcccaaagtgctgggattacaggcgtgagccactgcaactggcccagagaagcatttttttaaaaactattttaaataatatttaaggaccaggtgtgatggctcatacctgtaatcccagcactttgggaggctgaggtaggcagatcacttgagctcaggagttcaagactagcctggacaacatggtgaaaccccatctatacaaaaaatacaaaaattagccaggcatggtgccacacacctgtaatcccagctactcaggaggctgaggtgggaagatcatttgagcccaggaggcagaggctgcaatgagccaagatcgtgccactgcactccaacctgggtaacagagcaagattctgtctcaaaaaaaaaaaaaaaaaaaggaatatttaagtaataaacatccagctctactaattaaaaactaatgaaaattaactgaatccttggctgtgagtcaattcaacaaagcaccatgatctccttaaggcatttattttatttatttatattttagaggtaggatctcactatgttgtccaggttgtacttgaactccaaggctcaagtgattctcccgcctctgcttctcaagaagctgggactggccaggtgtggtggctcacgcctgtaatcccagcccttagggaggccaaggcgggcggatcacgaggagttccagaccagcccggccaacacggtgaaatcccatctctactaaaaatacaaaaaattagccaggtgtggtggcaggcgcctgtaatcccagctactcggaaggcagaggcaggagaatcgcttgaacccaggaagtggaggttgcagtgagccaagatcgcaccactgcactccagcctgggcaacagagcgtccgtctcaaagaagctgggactatgggtacagttcaccatgccaggctcctaagacattcatttaaatccacttagtcattcatacctatgcacaatatgtatagcatttacagtgtgtatcatgacacttttaataataaagtcagtgttttaaagtcagtgtgtattgtttcttctattttactttttaaaaaatcacctacagcacttaccacagtgtatgcacctagaaggtatataaatatccgtggtattaaattgaacacagtagaaagaatgctagagattaaagttcaaattctgactcagctacaacttagtaaatgaccttaggagaaggcagaattattctgggactcaaagtggttccagtaagtccatgagtttcatatttcacagccaatttgccatctatataacccaatgaaacttacagggaatgtaatttccattgaaaacatcaatgcttcaccaattccatatacacaaaaattattttctgatttgtatcactagacagtgtcttactagcattctgaaggtcacccatcccagtcacgaagcccttaattctcacaaccttgattttataaataaggaaacagatagactgatctgccccagacctcacagttattatgtggtacagatgaaacctgaaccttggtcttttgacactcagtccagtgctattactgccatactatagttgcctgtcactgataattgcaaagtttgttaatttgggcaagtctaccttagacttttagacaacacactgttgaaaggcaccccacctctggctgatgaaataggctgactggtttgcctctgaagcatctcagcaagtctcagctatactgagcacacaaagttattcagaatatctttcaaacatttttttgtccctattattgttatcttattttagcttgataaagaacaactgtctgggtagccactgacactcttaaaatatactcagcccaagagaacttgctaaaatggaacatactaaattggttgagtactaaagcaactggctatatcagagaacctcattatcggtgacccaaacttacctttaattatcagatatatgaccatgcaatactgatgttattgttttaagaaaatcagatgtgattaaaagtgtgagattatccctttttttaacctattaaactagcaatattagtgaaaaaaaattttttttctgagacagggtctcactccattacccaggctagaatgtagtggcacgatcatagctcactgtaacctcaaactcctgggctcaagtaagcctcctgccttagcctgctgagtagctgggactacagacaccaccatggctagataattttttttaactttttttttttcagagatggggtcttgctatgttggccaggatagtctcttttttctttttttttctccctcctcaggtgctacttaaccaggcttgttttgaactcctggcctcaagtgatcctcccacctcagcctcccaaagtgctgggattacaagtgtgagccaccatgcccaaccacggtttctttttatccttcttcttcttcacagagacctcttcttctaccactactacttttccttcttctccatcttcttcaattttaattttactcttggccttttttgctttctttgtggtaatttcatcttctttatctgttctgagttttttttaattttttactttttgtacaaatggggtctcactatgctgcttaggctggtcttgaactcctggcctcaagcaatcctcccatccttggtatccgaagtgctgggattccaggtgtaaaccactgtacctggccctattttgtgtttttgtagaacaggttggaagtgtggacccaccaatacattcttttaaaaaaatttttagtattttcttattaaaagggaactgtgggccaggtgtggtggctcacacctgtaatcccagcactttgggaggcagagacaggaggatcacttgaggccaggagttaagagaccagcctgggcaacatagtgagatctcgtctctacaggaaaaaaaaaaaaaaaagcaaaaacttagccaggtccaggtccatatggtggtgagcgcctgtagtcctatcaacttggtaggctaaggcaggaggatcactggagcctgggaggtcaaggctacagggagcagtgatcacaccactgcactccagcctgggtgacagagtgggaccttgtctcaaaaaaataaataaaatgaagtaaaaaggaactacccctttttgaagtacagtgtgcttttaaaaagcatttctccatgtctcgtaataaagggcagacaaaaatataacaaacaaatgggtcagatactgccctttaactgcaaatggtttgttacccccatgtctctgtaacttagtgaataagagggaaaggaaaataagtaagcttgagtttactcaagaagaaatctgagggccaggcacggtggctcacagctgtaatcccagaactctgggaggccaagatgggcagatcgctcgagctcaggagttcgagaccagcctgggcaacatagtgaaaccctgtctctacaaaaaaaataccaaaaaaaatcagccaggtgtggtggcacacgcctgcagtcccagatacccataaggctgaagttgggaggatcacctgaaaccagaaggtcaaggctgcaatgagccatgatgccaaaccacactccagagcctgggcaatggactgagacccatctcaagaaaaaaagaaaagagaaaaaatctgaacacagaattaacaatgaacatagccaatcattacgataaatacttctaaattcatgaaaaaagtagccgggtgcagtcgctcacacctgtaactccagcactttgggaggccaaggcaggtagatcactagaggtcaggagctcgagactggctgggctaatgtggtgaaaccccattagcagggtgtggtggtgcgtacctgtagtcccagatactcgggaggctaaagcaggagaattgcttgaacccaggaggcagaggttgcagcgagccaagatcgcgccacttcactccagcctaggcaacagagttagacttggtctcaaaaaaataaaaaataaaaataaataaattaatgaggccaggagcagtggctcacgtctgtaaccctagcattttgggaggcccaggcaggtggatcgcttgaggtcaggagttcgagaccagcctggctactaaaaacataaacattagccaggcatggtgacatgcgcctataatcccagctactcgggaggctgatgcaggagaatcacttgaacccaggaggcggaagttgcagtgagccaagatcatgtcacttcactccagcctgggatggaaactccatctcaaaaatactactactactactaataataaatttggccaggcacgctggctcatgcctgtaatcccagcactttgggaggccgaggtgggcggatcacttgaggtcaggcattcacaagaccagcctggccaacatggcaaaactgcgtctctacaaaaattacctgggtgtggcagcgtgtgcctgtagtcccagctacttgggagggtgagacaggagaatcacttgaacccaggaagcagaggctgcagtgagccaagaaggcgccactgcactccagcctgggcaacagagtgagactctgtcccaaaaaaataaattataaattcatgaaaaaactatttttttaatgaggccagaacacatttccctagggaaataatatataaaatcaaattaatgttcctattcttaaatgcctaactttatgatccttagtattctgagttccagaaacaaaggataattaggggcaaaaggtatagaagagcagagacaaacgtgagaattgcctttcctggacctcaggaagcattttataataggtaaaaatagttttacaatatcccacttcccttctgtgccattttccaagtcattagtggcattatgctccgctaagtcccactactgtagcacctgactgcagcatcaattgaacatacatttgccagtagagaaagagaaacaagaaatgaagtatggtctctgacttcaagggactctcaggccagtgacaagatatatttaattttaggccaagtgcagtggctcacgcctgtaatcccagcactttgggaggctgaagctggtggatcacttgaggtcaggagttggagacgagcctggccaacatggtgaaaccctgtctactaaaaatggtggcacatgcccgtaatcccacctactcaggaggctgaggcaggagaatcatttgaacctgggaagcagaggttacagtgagcagagattgtgccactgcactccagcctgggcaacagagaggctccatctcaaaaaataatcataattttaaaacaatatggaaatccaaaggaatacacacacacacacacacacacacacacacacacacacacacacacacacacaaattagcattagtaaacaagttcagccgggtgcggtggctcacacctgtaatcccagcacttagggaagctgaggcgggtgggatcacctgaggtcgggagtatgagatcagcctgaccaagatggagaaaccccgactctactaaaaatacaaaattagccaggcatggtggcacatgcctgtaatcacagctacttgggaggctgaggcaggagaatcgcttgaacccaggaggcggaggttgcggagagccgagatcgctccattgcactccagtttgggtgataaaagcaaaactccatttcaaaaaaaaaaaagaagaaaaaaaaagttcagcaaggccacagaataccagatctataaaaatcttttatttctctataccagcaatcaacaacacaaaatgaaataagaaaataattccattttcaatagcatcaaaaggaataaaatactaaggaataaatttaaagtaaaagacttgtacactaaaaactacaaaatagctggagaggatgtggagaaataggaactcttttacactgttggtgggactgtaaaactagttcaaccattgtggactacagtgtggcgattcctcaaggatctagaactagaaataccatttgacccagcgatcccattactgggcatatacccaaaagattataaatcatgtgtcttttaaagacacatgcacatgtatgtttactgcggcactattcacaatagcaaagacttggaaccaacccaaatgtccatcaatgatagactggactaagaaaatgtggcacatatacaccatggaacactatgcagccataaaaaaggatgagttcatgtcctttgtagggacatggatgaagctggaaaccatcattctgagcaaactatcacaaggacagaaaaccaaacaccgcatgttctcactcataggtgggaattgaacaatgagaacacctggacacagggtggggaacgtcacacactagggcctgtcatggggtggggggaggggggagggaaagcattaggagttatacctaatgtaaatgatgagttaatgggtgcagcacaccaacatggcacatgtatacatatgtaacaaacctgcacattgtgcccatgtaccctagaacttgtaagtataataataaaagaaaaaaaaactacaaaatacattatatatatatatacacacacttttttttttttttttttttttgagacagaggctcactctgttgcccatgctggattgcaatggcaggatcacagatcgacgtcctgggctgaagggatcctcccaccttatcctcaccctgatgagtagctaggattacaggggcaagccaccacatccagctaattgtgtgtgtgtgtgtgtgtgtgtgtgtgtgtgtgtgtgtgtgtgtgtgtgatatgtcggccagactggtctcgaactcctgggctcaagcaatcttctcacctcagcctcccaaagtgctgggattacaggtgtcagccaccaccacactcagcttaaaaaatattcttgaaagaaattaaagacataaacaaatggaaaggcatcccacgttcatgaagtggaagatctgacattgttaagatggcagcactctctaaattgatctacagatttaaggcattccctatcaaaattccaactgccttttctgcaaaagttgccaagttaatcctaaagctcaaatggaaatgccaaggatccagaatagccaaaacaatcttcaaaaaaacaaaattagaaaactcacacttcctaatttcaaaacatattacaaaagtacattaatcaagacagcatatttatgcagatagtagcagatagtagtaccacagggtgaaaatacaagaaagcaagcatgatggtactggcatagacgtacaccaatgcaatagaattgaaagtccaggccgggcacggtggctcacacctgtaatcccagaactttgggaggccgagtcaggcggatcacttgaggtcaggagttcaagacccgtctgaccaaaatggtgaaaccccgtctctaccaaaaatataaaaattagctgggtgtggtggtgcatgcctgtaatcccagctactcaagacgcagaggcaggagaattgcttgaacctggaaggcagagaggttacagtgagctgcgatcacgccactgcactccagcctgggcaacggagcaagactgtctcaaaaaaaaagaaagtccagaaataagcccacacctctgtggtcaattgactcaaaacatggatgctaagatgatacacaattcaatggaaaaagaagtcttttcaacaactggttcaaggacaactagatatccacacaccaaaaaaaacaaatgaaaaagattttgggccgggcgcagtggttcacgcctgtaatcccagcactttgggaggctaaagcaggtgaatcacccgaggtcaggagttcgagaccagcctggccaacatggtgaaaccccagtctctactaaaaatacaaaaattagctgggtgtggtagcgggcacctgtaatcccagctacttgggaggctgaggcaggagaatcgcttgaacccgggaggtggaggctgcagtgagccgagatcacgtcattgcacttcagcctgggcgacagagtgaaactccatctcaaaaaaaaaaaaaaaaaagaaacaaagaaaaagattttggattcctacctcacacatcatgtataaaaattaatttgaaattgataaaaaaaaaactaaatacaacagctaaaactataaaattatttaaagaaacataaattacacctataatcccagcattttgggaggcaaggaaagcggatcacttgagcccaggagttcgagatcagcctggacaacatagtaagaccacatctcagccgggcgcagtggctcacgcctgtaatcctagcactttgggagcccgaggtgggcagatcatgaggtcaggagatcaagaccattctggctaacatggtgaaacttcatctctactaaaaatacaaaaaaaaaaaattagccgggcatggtggtgggcacctgtagtcccagctacttgggaggctgaggcaggagaatggcatgaacccgggaggtggagcttacagtgagcagagatcgcaccactgcactccagcctgggtgacagaacgagactacatcttaaaaaaaaaaaaaaaaaggttaccaaaattagccaagcatcatggtgcacacctgtagtcctacctactcaggagactgaggtggaaggatagcttgagcctgagaggtggaggctgcagtgggcagatatcatgccactgcactccagcctggacaaaagacagagaccctgtctcggaaagaagaaagaacgaacgaacgaaagaacaaacgaatgaaaaaaacaaacaaaagagaaatctttatcaccttaaattaggcaatcgtttcttagatgtgacacctatagcacaagcaaccaagaaaaaactagataaactggacttcatcaaaatttaaaacttttgtgtttcaaaagatactatcagtcaggcatggtggctcacacctgtaatcccagcactttgggtggccaagcaagaggattgcttcagcccaggagttcactgggcaatataaggagaccccatctctaattaaaattgttttttttaattatccaggtgtggtggcacacacctacaatgccagctatccagaaggctgaggtggaagaatcacctgagccctggaggtcaaggctgcagtgaatcatgatcgcatcactgcactctagcctgagtgacagagcaagatcttgtctcaaaaaagaaaagaaagccaggcacggtggctcacgcctgtaatcccagcactttgggaggcggaggtgggcagatcacctgaggttgggagttcgagcccagcctcaccaacatggagaaaccccactctactaaaaatacaaaattagccgggcatggtggcacatgcctgtaatcccagctactcaggaggctgaggcaggagaatcgaatcacttgaacccgggaggcggaggttgccatgagctgagatcgtgccattgcactccagcctgggcaacaagaacgaaactcagtctcaaaaaaaaaaaaaagaaagaaagaaagagaagaaaaaaataattttctggttttaatttttttttttttatagagacagggtctcaccatattgcctgccccaggctggtcttgaattgctgggctcaagcagtccaccctcctcagcctcccaaaatgctaggattacaggcatgtgccaccacgcctggcgataaataattttttaaaaggttaaacataattaacacataaccaagcaattctccttctaggtatttagacaaaaataaatgtccatataaaagcatatcaatcttcacagagcattattcataatagctaaaaaatgcaacccaaatgttcatcaatggatgaatgcataaacaaaatgcattatatccatgtaatgtaatattattcagccataaaaatgaatgaaatgatacatgctacaacatggatgaacctaaaagcattatgctaaatgaaagaagccaaacacagaaaggccatttattgtatgattccattaatatggaatgtccagaacagacaggaagatgattagtggttgccagaggctgggtgaatgaagggaatggaagagactgctaacgggtatgaggtttcttttgggggtaatgaaaatgttctggacttagataatggtggtagttgcacaacattgtgaatacaccaaaaaccactgaattctatgattttgttttgttttgttttgacagggtcttgctctgtggcccaggctagagtgcacgatcatggctcactgcaatctcaaattctttggctcaagtgaatgatcctcccacctcagcctcccaagagtctgggactacaggtgtgcaccaccatgcctggctaattttttttttttttttttttttggtagagacagggttgccatgctatgttgcccatgctggtctcaaactcctgggctcaagcaatcctcccacctcagcctcccaaactgctgggattacaggcatgagctaccatgcctaccccaaattgtatgctttaaaatggtgagttttacgatatgtgaattatgtatcaacttttttaaatgtggaatgacatatgcccaaagatatacattggggaaaacatcaaagagtagggtagaaaggggccgtgaatgaccttctaaaggtgaaacttgagctgatatgtagagaactaagcctgtaaatctgccttatcccccactttctctgctcccaatccttcctaaactgagaaatcacttgtcacccaaagcaacacactcactacccaaattcaaattatttcaataaaaatatgttcttcccataagaaaatgactgagagctctccagagtcctactagtggatttctattcctaaaagagaaagtgggctaacccaagtgaattatatgctgagcatcccaaatccaaaaatctcaatcctgggctgggtgtagtggctcatgcatgaaatcctcagcatgttaggaggctgaggtgaaaagatcacttgagcctaggagtttgagaccagcctgggcaacatggtgaaacgctgtctctacaaacaatacaaaaattggctgggcatggtggcacgtgcctataattccagctactcaagaggctgaggcaggaggatcacctgagcccagaagttcaaggctgaagtgagctgtgattatgccactaaactctggcaacagagcgagaccctgtctcaaaaaacacacaaaaatccgaaatctgaaatgctccaaaatctaatactttttgatgtcaaaggaaatgctcactagagagcattttggaatatctgtatactacagatattccaaaatccaaaaaatccaaaatatgaacaattctggtctcatatttcaaataatggatactcaacctatatctgattaagaatttcaaggctggagctgggtgcagtggctcacgtctgtaatcccagcactttggcaggccaaggtgggcgcatcacttgaggtcaggagttcaagaccagcctggtcaatatggcaaaaccccatctctactaaaaatacaaaaattagctggggcctggtggtgtgcacctgtactcccaactacttgggaggctgaggcaggaggatcgcctgaacccaggaggcagaggttgcagtgagccgagatcacaccactgcattccagcctgggtgacacagcaagactccatcttaaaaagaaaaaaaaagccgggtgcggtggctcacacctgtaatcccagcactttgggaggccaaggcgggcggatcaagaggtcaggagatcgagagcatcctggctaacaaagtgaaacaccgtctctactaataatacaaaaaattagctgggcacggtggcaggtacttgtagtcccagctactcgggaggctgaggcaggagcatggcgtgaacccgggaggcggagcttgcagtgagccgagatagtgccactacactccggcctgggcaaaagagtgagactccgtctcaaaaaaaaaaaaaaatctataaataaatttgttgtaactttgtcttctgacaataataaaaggcttagaaagcacatttcacgagaggtagctgggggaaaagccactagtgtggaaaagaaaaaggtgggacaaaataactgtcattgaataggtgcaaagttgagattagagctacagggaataactgtagacagaaaaattaggaccactgaagagaaactgcagggaggcagatctacaatcattatccggaaaatctttctaaaatgacaaatctgcaaacctggaattggtagcaaccagctgtgaagtacttatcttgggaaatacctgcatagagaactggaggaatcacctattatgtgaaacatttgtctagattatctctaaatctcttctatgattctacgaggaggaagaagtccagaaaaagaattgtttttgctctcaatactgctgaaagtattttttttaaaaaagctaaataccaggaacttctttaattaaaaggaacaatcccatcaagaagacaaaggttgatttgttagtcaagataatgagactgctttccttaggatcaagtatagcactgggagtgagaataggtcatttggccaggaacagtggctcacacctataatcccagaactttgggaggctgaggtaggaggattgcttgaggccaggaattcaagaccggcctgagcaacatagcaagactctgtctcttaaaaaataaataaataggccgggtgcagtggctcaagcctgtaatcccagcactttgggaggctgaggcaggcggatcacgaggtcaggagatcgagaccatcctggctaacatggggaaactctgtctctactaaaaaaatacaaaaaattagccagttggccgggcgccctggctcacgcctgtaatccgagcactttgggaggccaaggtgggcagatcacgaagtcaggagatagagaccatcctggctaacacggtgaaaccccgtctctactaaaaatacaaaaaattagccaggcgtggtggcgggctcctgtattcccagctactaaagaggctgaggcaggagaatggcgtgaacccgggaggcagagctttcagtgagccgagatcatgccactgcactccagcccaggcgacagagcgagactccatctcaaaaaacagaaaaaacattagccgggagtggtggcaggcgcctgtagtcccagctactcaggaggctgaggcaggagaatggtgtgaaccccggaggcgcagcttgcagtgagccgagattgcgccactgaactccagcctgggaaacagcgagactccatctcaaaaaaaataaataaataaaataaataaataaataaataaataataaatcttcaattctagatacaatcactcacttcctgtttggccaagggtaaatgatttcatctctctacctgagctgaaaaacagtaatttaaaataccaatattataggagtataatttaaattagttaacaactgcaaaatgctttggaaatttactttatatgacaattaagactattttttacttcatatatatattagagttgaaaaaattagcatgtattattcattaaatcagccaaatttctcactttcagagaaagaagcaaggaagagaatgctagaatgaactctgtggtgctggatcagcatcagagatatcagtataaactcatgtttatatttatatacagacagatacggaagtaaacgaagatatgtgtgggtcagtatatatatatattacttcctaactatcccctgagagggcctagaagcagtgataccctagcagtaatgagtgcatcaagctcatttagaaaccagatagtggtttccaaatactcttctccaacagaaggaaccaggacaccttggagaaatggctgattttagggttggggcaggtaaagtacaagatgagactggggcatcttacagtgccaggaagtacaaaagtgctaaaagacaaagaaaggtagggaaaggtatttcaaaagaacataggtgccaatgttagaatggccaaagctggaacaacttgagcaacaaaatacagtactggattataagcaaagaaaaaaatattcatgggtccatgttgacataaatgatttaataaataaatgggggaggcataaatcttccttacaaaaggattccaaatcataaaagtagaaagaattagaaaaatagaaaaccaacagaataatataatcaacgctgccgcaggcaagattcactaatgaatgctaaaataagtagaggaaatttttaaggagaaatcagattctgtataacctcacagttatcttccccaaaatattaactaattactttaggaattttaacatgcccacaaattctttgatactcctcccttcaggggttggagcttaattcccttcccccagaatatggatatgacttggtgactcatttctaggttctatcaagtaaaattaaaaagcagaacaacagtcactttacagtgcagaacatcactttaatcaagttatcaaagttaacaaggcacaatggctcatgcctgctatcctagcattttcggaggatgaggccggtggactgcatgaggccaggagttcaagaccagcctgggcaacatggcaaaaccctgcctttactaaaaatacaaaaattaggtgtggtggcacgtgcctgtggtcccagctacttgggaggctaaggcacaaaaatcacttgaattgggtaggcagaggttgccgtgagccaagatcatgctactgcactccagcctgggcaacagagcaagactttgtctcaaaaaaaaaaaaaaaaaaaaaagttaatcagtaacgagtcatgttgatatcaggtattcccagatatgatgtgacaagaagggtaaaccatctctatggtatttttccccaaaatgcataacctcgggctaatcatgagaaagcaccagaaaacccaaaatgagaaccattctacaaatgcatgaccactcatctttaaaggtgtcaaggaaagatagggaaggagagactaagaaactgtcacctattggaagaaactaaagaattgtgacatctaaatgcaatgtggtatcctggattggatcctgtaacaggaaaaggacatcagtggaaaacacaggaaaatcagaggaaagtctgtagtttgctcaataatattccactaatgctaatttcttaattttgataagggtatcaggttatataaaatgttaacgctaagagaaatggaatgaatacagaatgtatatagaaagtctgtactacctttacaactcttctgtaaacctgaaattatttaaaaggagttttaaactattttccatataaaaagaagtgaggaaagttataaataaaaaaatttattttttgagacagtctcgctgtagcccaggctggagtgcaatggtgcagtctcggctcactgcaacctctgcctcccgggttcaagtgattctcctgcctcagcttcccgagtagctgggattacaggcgcccgccaccaggcccagctaatttttgtatttttagtagagacggggtttttaccatgttggccaggctggtctcgaactcctgacctcttgatctgcccacctcagcctcccaaagtgctgggattacaggcatgagccaccgcacccagcataaataaatttttaaacatatttaaatatatgcaaactaataaaatattagtttacagtaagattaactttttttttttgagatggagttccactcttgttgcccaggctggagtgcagtggcgtgatcttggctccctgcaacctgtgcctcccagattcaagtgattctcctgtctcagcctcgcgagtagctgggattacaggcgcttgccaccatgccagctaatttttgtattttagtagagacagggtttcaccatgttggccaggctggtctcgaactcctgacctcaagtgatccccctgcctcggcctcccaaagtgctgggattacaggcatgagccatcatgcccaagccaagaagattaacttttttaacctataaataatcacaatagctggtcgcagcgggagtgcctgtaatcccagctactcaggaggctgaggcaggagaattgcttgaacccgggaggtggaggttgtggtgagctgagatcgcgccactgtactccagcctgggaatacagcgagactcagtctcaaaaaaaaaaaaaaaagaataagaacaagaatcacaaaagttagccaggtgtgatggtgcacatacacagtctgaactactggggaggctgaggcaggaggatcacttgaggccagaagttcaaggctgcagtgagctatgatctcccccactgctgacagaacatgatctcatctctaaaaaaaaaaaaaaaaaaggaaaaagaatcacgaaagtaattgtgttgactttcaaccttaaaatgttaatgacatccaaaatagttcaccataaggtctgcatttaaagactggcctaggagctctaaaatggtagatgagtatgatgaatatgatcccctatatgtatcagtgtgctttattaccccttttttttttttttgcaggggtgagcaggtctggctctttcagcaaggctgaagtgcagtggcacaatcatatcactggagccttgaactcctgggctccagtgatcctcccaccccagcctccagagtagctgggactatagacacatgccaccacacctagctaagtttgttgttgttgtttttgttgttttgctgtacactaaaattatctggggaccgactaagttgtttttgttttttttttaatggagacagggtctcactatgttatccaggctggtatcaaacttctggcctcaagcaatcctccgcctcaggctcccaaagtgctggaattacaggcatgagccacccagccctacaatcccccttcttaaccttaattgttctcaacccactcactcctagcaataagtctacaataacctggttctaaaagtgctgtttagaaagacaaagtgaaatcactgatacttacttggtttccttttcaaattgactatatacatgaactgccaagatgccttccactgggtcaaaatgttcctctcagattttctcacatcttaaggaaatctaaaagctacatagcaactactcacgcttaatctttaaaaaaaaaaaaaaaaaaaagcaaagtgattccaaaaactgtcaagagcaaaagtttacagagccaaaggattgatcaccaaattcagaaacaagattaggaaagaacaagacactatgagattaggaagaacaagacactatgagattaggaagaatctactctctgactaaagctaagccgcctatatataagaaaatccaggtgcttccttcactgtcagcaaacaatggaaaatgactttttaataggtaatataaatgtatttgtaaatttgaaaattttaacaaagggatgctggaatgacaaatatttgaagagactacttaaaaaacaagtgagacagagtaggaaaatgtgttaagacatcctccagcactgtatgtgtttttacactggggaaagggagactcactagacttttgttccttgattaaaatacccgtaaggccaggcgtgatggctcatgcctgtaatcccaacactctgggaggccgaggtaggtggatcatctgaggtcaggagttcaagaccagcctggccaacatggtgaaaccccatctttactaaaaattcaaaaattagccaggcgcggtggctcacgcctgtaatcccaggactttgggaggccgaggcaggcggaacacgaggtcaggagatagagaccaccctaacacagtgaaaccctgtctctactaaaaatacaaaaaattagccaggcgtggtggcacgtgcctgtagttccagccactagggaggctgaggcaggagaatcacttgaacccaggaggcgaaggttgcagtgagctgagatcgtgccactgcactccagcctgggcaacagagtaagactccatctcaaaaaaatatatatatatgtgtgtgtatatgtatgtatgtgtgtatatatatgtatatgtgtatgtatatatgtatgtgtgtgcacgtatatacacacactcacacacacacacacacacaaattagccaggtgtggtggtgggtgcctataatcccagctatcaggaagctgaggcaggagaatcacttgaacctgggaggcagaggttgcagtgagccaagatcatgccactgcactccagcctggatgacacagcgagactccatcttaaaaaataaaatagaataaaataaaaataaatggccgggcatggtggcttgcacctgtaatcccagggcactttgggaggccaaagcaggcggatcacttgaggtcaggagtttgagaccagtctgtccaacgtggcgaaaccccgtctctactaaaaatacaaaaatcagccgagtgtggtggcacatgcctataatcccagctactccggaggctgtggcaggagaactgcttgaactccggaggtagagtctgcagtgagccgagatcctgccactgtccagcctgggcgacagagcaagaccctgtctcaaaaataaataaataaataaaatttaaatttaaaaaatacccactaagaatatctagtgcctttccaattccataatcaactacctttttattactgattaggcagcccagaacaatggaggtgtcctggtcagtggacaattaaatccaattgtgcacatggcacttaatacttccaacatgcattaactggtatctggtttatcagtctctggtgagtttgtttactttgcatgaataaattctcaagcacttgaatcatcccaatgtaaaccaaaattctgaagtttctgaactactatgtgggggttggagagaccttggtttggttggataccatttttgccacttaactatctgtgtgacctcttcttcccatcagtctcaatttcctcatctgttaacaaacatagctagtgcctgggagatggcaagtgctcaaaaagtgacagctttattattttgaagctaaatttgaaaggaagtgtgtaactgaggtgaaaacatttcatttgaaaagtagtagtacggatcagcaaactacgttaatttaaaagacacagcctgaagagagatgtcccaatctttggagttgagaaaagcaaagtttaaaagttgcaagtaaagtacacactgcacagtacagatgggagtctcctgcttagcaactttaatgttgtctaccaaacacccagcttgtaatagagcatgacaactgttcactctaaatccatgtgctcagcttggattcaggattgatttataaaaatagctgctggtggtgctctttgaatctctttgggctgatgactgggcagtgttaccccaaaggcctagagcagctgtattccctcaccacacccatttctctgtctacccagccaagctgacggcaccctgcccccgccccccatctctacagcatactattcaccctcctcctgggctgagtgagcaaattacaagcacaaatatcccctgatgcaatgccacaaccatccctgggaaagagcagaggcagttgccaaaagcacagcagcagggaaatgggcgggagacgcgcgcgcgcgcacacacacatacacacgcacgcgcacacacacgcacgcgcacacacacacacacacacacacacacacacactgcaagaaacactgcaatgctatgcaaccagggagagagaatcgagaggccctggggagcaatactgtaacaggaccagagaaggcaaaggagaaaagggggtttccagtagaaagctgggtaacactaaccttcgcgaggaacacgtatttcatccgagcttgggtcctaaagcacaaacctaaaggtaatcaatcactgcctcttccccaaagcagcaaatgcatttaatttacccgttcctggaagtgagcaaaaccctcacaactcctccacaggacaatttcaccaaagggatctaactcacaccggcggagaacttgttccatgtgctaaatcacaatctctgttctgggtaatgtttccaactgcctctcctagtccctgtaccctccccacccccaccctaatgtgaccctttcgcactcccactgccagacacacgctttagtccccacacagtgtcggggcctttgcaagggggaagagccccgcctagggcccggttctccagaccacccctcagccccacccataatccctgactggacatactaaggctcacctcagcctcacatcaactgacccccacaaagcctcagaaaacgacccctgagttctcctacacctccgaaccccacccagggccccagactgcggccgaccctcgctccgcggctcagccccatccagagcccaaggcatgtcgctcggccccaccgccccgaccctcaaaagctggacctctcagcccccctcactccaaagacccccctagatcgcgcctcaaagactccgaaggtcaaagccgccagccccccgcctggccccctccctcggacgcccccgcgtctcgcaggccggcggccaccgcccttccacgcctcgggcgggccccgtggggtacccagctgccgcagggcaaggctcgggcagccccgggacagtgaggaggccgcccctccaatcggaccccgcctgcggctgcacctacccgccgccgccgagacggagctggggcagaagggagccaggagagcgccgggaagagccgtgaggaggtaggagacgtcgggaggagccgggagccagcgagctagccggaggggcggggcgcagggaggcggccgcttcctcgtcgcctcttgagggccggcgcaagggagggacgccgccaccgcctacccggcgagcgccgccgctccggccaataagcgtggcgagggggagggcggagggctgtggcggaccaatgggtgctggccctgccgccacgacgtctctgcagagctgcccgagccgcgggcggttggggcgaggtgcgcctgggggctctagcctcccgcctgcggcctgcgaatgccgaagcggaccgcaggccgatcgactgccttcgctgttctatgatggccgtcgctctctctcagagtctgggcgcccggagcgaggagagtgcgagagtcggcgcacacgcggaccgggccaccagcgggtggggcct

SEQ ID NO: 1454 - DNA, 238590 bp, Homo sapiens; identical to SEQ ID NO: 1453

SEQ ID NO: 1455 - DNA, 116201 bp, Homo sapiens
taaggtgttaatgtaagatgtttattagtggaatttatttagtacagtaatcacattagaagtcccaatatacaaactgttgaagtccaaagtcacaaaaaatacaaacttaggtatacgaatgaaattataaaaacattatttaaaaacaaagttctacatcttcaacattgggccaaaaaaggaaaaaaaaagagagagagaaagagaaagaaggcatatgaaaatcatcacatttcaacaaagcagccctgaccagtctggctgcctcaccattgagatactggaccacttgggtgtgaccactatggcaatacagcatttcattatgggactggctactttgtataaaactatatgtgaaacataaaatttctttctttcaaaatgaaacgtccaagtgaaacagatagagctaacatataccaaattttagctggctgttagtagaaaatttcaacaattctgtaagttcaaaaaggaaacatatttgaaaaaaacaaatttcaaacaaaaataagcataaccaaatggaaataaaagaataaataaatgtcaatcatgaagtgtgagtgtacacaacggaaagtcatacccaggcttctccacccataacttagacagctacagggactggttacgagcaatagaaagatgtcaaacatgatttttaaaaataactactaccagttttgaaaagatccctggcgaaagaaaccccaaaatcaacttaataaataactgtacaccaaagggaaagggttgtgttttctttgatggtgtattctctatggcaagagagttttaatattttatcaactgctaagaagataagcataacctctttcctttaaaacatatcaccctcaagtgtcttctgtccagaatccatagaagaaatttttgtcagagaatccagcccttgtgaccagacccctgtagaagagggaatgcttcctaaattccggaagtcgctgcaaggattcagtttaaactttcatgatattctaatcttaccatctcaaaagtagttctgtatcaggggatctaaaacaatgtatatctggccaggcacagtgtctcacacctgtaatcccagcactttgggtggccaaggcgggtggatcacttgagatcaggagttcgagaccagcctggccaacaaagtaaaaccccgtctctactaaaaatacaaaaattagctggtgtggtggcgcacacctataatcccagctacttgggaggctgaggcaggagaaccacttgaacctgggaggcagagggtgcagtaagccaagatcgcgccaccgcactccagcctaggcaagagtgagaccctgtctcaaaaacaaaaaacaatgtatatctcaaaatctttctcagaacatggtgccaattatttcttttaagctgaaataatctgtaccttgggggttataagaagctgcataatcagtaaaaggatagaaaactttaaagtatttcagattttaaaccagaattcctctaagatttcaaaacatggtccatgttttatgttatatttctataaatacaatcaaagcataccattgtacagtactaatctcaactggttctagatttaagcaattagtttgaaaaaattaggaatgggaataagaaagtcctgttgaaacaatcttagattgttaagagtccgtctccaaaaaaaaaaaaatttggcccaacttgcaaataataaaggattatttaatttggaaaaatattctaggattactcagaactactcaatttaaaaacttaaaatatctatcattatttagattttagtaaggtggagagaaacataggtagcctgtaagattaaccttccctaaaagcaagctcagagaaggaaggaggagggagaagaaaaggaaattcgctgcagtactggtggcctcaacccctttatgaaaacacatgttctcatttggtgttacactattctgattcatgttgaacatttgaaaaccaaaggaaaaaggtcaactaaaaatatttaaaggaaaaaaatgtgagaatgaatcaaatgataaaatcataaagaaaacaagaaataaaagacattagataacctttgtaaaaattactaaaattaaaaagaattcattttgcactttgtgttcacaaagggaaatgaggctccatcaaaccctgcagagcacaagaggaagcaggttgtttgctcaggcatcagcagaaataggccccgaagaactaccctcagtttcttctacatcatgtccaggaatgaaaagcaaagctctgcaaaatgctgaaggttttagaagtataacgatgcttaggaaagatcactggtctggtgttgcagcagccccagtgttgagagacacgctaggcttctaggaggagaaaaatagagagggaggaagaagtaggaaggggaagaaaagggtggaaaagcacaggtcattagtaaacagcaagttcaatatcacaagatgctcataaaccaaagctattaatgaagctggtttgctctcgggactatagataacattctgaaggaaacagaaatgggaattttcaaaatggcattgagttagatgctccaggtagtgatggccaaattagaatgaagtcaccacatgctccaaaaacatgcactgccatcccctccctccaccttccctccccaaataaaacatgcatattttcagtaaagtatctttttttttttttttgagacggagtcttgctctgttgaccaggctggagtgcagtggtgcgatctcggctcactgaaacctccgcctcctgggttcaagcgattcttctgcctcagcctcccaagtagctgggactacaggcacgtgccaccacgtccagctaatttttgtatttttagcagagatggggtttcaccatattggctaggctggtctcaaactcccaacctcaggtgatccgcccgcctcggtctcccaaagtgctgggattacaggcgtgagccaccgcgcccggcctagtatctattttaatacagttaagtggttcaattcaaaactcaatccaggtgtgcaaactatatgctacctaagggcagagaggtatccaagaacagaacgacctactctcataatgccactgggtagttcataaagagccaggttcttttttgtcacaagggaatcctgaaacagtgagggccaggatacagtttttacccttctattctgtactactaaggcctggcagcggtaagcacctgctacacagagtttgagtctcttctggtcaggcatgacttcctactggagaagaaatctactcgtttttgtagttgtttccttcctggatgaaaatggcatccactctttcaactgcctaatcaagtcaatcccctccagcctttccttaccctggttaactggttcctgcttaaagaaagctgaatttactcattttttaaaagttcatgttcaaacttctcctttaatcacagggatatttgcataaatgttttcttaaaaaccacatcacatagatgactgctttcaaagcagacacagaaagtcaatactacatttgactgagattatcaaagaaatacaaaaacatcaattcacaaaactggaagataaagtggcatttctggttgtttctagcttctaaagtaaagagttcctaatttattaagttgctaataaggatgtatatgtcacttggtaaacattcacaacaaaaagaacttggtcatcaaaaaatctgatgtataaagatatatacaactttcctatggtcatagaataaagaataaatcctagaatagctgctattgctaacagaaggctttctggaagccttagaaaaagagaaatactgtggtgcctcacagaagggcttctcatagctgaggtatgcatataagagaaatacagaaatatgacaaatctagtaactacctccactgcaataatatgaatcaaatgtatggcccagttaagagcacacttgcaggaaacaatgggattgatcattagaagtcaactcatttgggttagcagtgttggcctgatcacaactgcaaagtaaatgcaggtatttatgaaaataaaacacgcaactctcacatcagctacttaagaaaatatttatatagtatatccctgggactcctgctactgctttgagaattttgctcactacaaagacattggggcagggggttggtgctggttatgagacaggaacccacagaaactcaatgctaactgaaagaatatcaaaaccctagtaaagagctaagagtttaattagaagtaaatttcaaaagcaacagttaagggaaagataaaggaaacacactgggggcaaaataaataactcctaatttgttgttcactggcttcctaacattgaactgtagaaagctaaacgcaatgtgattcagggaacagacctgctgttttaagagttgtagtggccaaattcctcccatgtaacatattttggtgatcattattctgcatctacaaaagtattttaaggttgatccagttcttgtgtggtacagctccaataaatattcaaaaaatatcaaagcaaactcattattctccttccattgttggagattttacatggcaatgtcctgggtttaaatacctccaacaagaacactaccaccctcagaaataattcatatgcttccattaataatgctcttcaaaggagattatcaaggtgttcattgtaagtgcatcacctacacatttggggaatcctgggaatcacttacctgtagtatcgctcccttctactccatgaccaccattggctaggagtgttggtttagaagatggagtatctgcaacaatgacaaataattacccattgtgacagacagaaaaatgaaaaacagatccaaccactgtcttattaatggagtttttctcactctttgtagcattaggttaaagcaattaaaaactgttcaaaatttaaacatttaacaaaaggaaacccagaaacagaactgaacagaatcattaattcctagggcacccaagctctgtaaagtaccagttccataggagagcccctcataatagcaagtctaaatctttttcattctgtaaattatcaaagattaccattaaattcagtaaaaccatcatggagcaacacaggtttggtatcagcaattcaaatccaaatcaaacgctccaagaacacgagggcatttgttttattattattattatttttgagatggggttttgctcttgtcacccagactggagtgccatggtgcaacctcggctcactgcaacctccgccttctgggttcgagtgattctcctgcctcagcctcccgagtagttgggattgcaggcacccgcccccatgaccagctaatttttgtatttttagtagaaatgggatttcaccatgttggccaggcgggctcaaactcctgacctcaggtgattcaccgccttggcctcccaaagtgctgagattacagatgtgagccaccatgcccagcggaggccatttattaattacttattaattcccacacaggaaatccagggtaccatcattgcttctggatgaagattgcatggaggtaaccagctgtatttctggaagcagaggactcctttttttttttccctcttttttttttttttaaggaaattagttgtatcttattccctaatgactaaggatgttgagcatcttttcatgtgtttctctgccatccctttgtcttctttggtgacttgaatggtcaaattttttgactattttaaaactgaactgtttattttcttattattgagttttgaaaattctttatgtattccaaatatcactcctttatcagataaattttgtaaaaatttcttccctgtttctaacttatactgtattttcatttacttaactgtgcctttcaaatagtttttaatttttatgaagtaggtcacaggatttttttccccatgttttcttctagaagtcttatagttttcatatttacatttcatattgaggcctacggtacattttgagttaaattttgtatatggtgtaatgatgtgggtctaagtttctattcctgtacattcctaagtttctattcctgtacctaataattaggtgattaggtagttacctaatcacctaataattaggtaattaggtaattattacagagtcatttgtggaaaaagtcatctgcattctattgaattgcctttgcacctttgtaaaaaaatcaactgaccatattacattgggtttatttctgggctgttatgttccatcaatttgtaaggctatccattttgccaataccatcctgtcttgattactgtatttgtacagtaagtcttcttgacagggagtctctctctgtcgcccaggctggagtgcagtggcgcaatcttgacgctctgcaacctccacctcctgggttcaagagattctccaggctcagcctccccaagtagctgggactacaggcacgtgccaccacgtccagctaatttttttttgtatttttagtagagacgaggtttcactatgttggccaagctggtctcaaactcttgacctcaggtgatccgcctgcttcggcctcccaaagtgctgggattacaggcatgagccactgtgcccagccataagtcttaaataaggtaatatgagccctccaacttgagtcttttccaaaaatgtttttgtttgttttgttttgttttttcgagacagggtctcattctgtcactcaggctggagtgcagtagtgcaatcgtggctcactggagcctcgactgctcaggctcaagcaatcctcccgcctcagcctcccaagtagctgggaccacaggtgcatgctaccacgcctgcctaatttttcattattattattttttggaaaaacggggtctccctatgtttcccagactgctctcaaactcctgacctcaagcaatcctcccaccttggcctcccaaagtgttggtattacaggtgtgagtcactgcgcctggccttgttttgtttctttgcttttccatataaattttagaatcagtttttgatttatactaaaattcttgatgggatcttatatgcaattgcatataagactatatagatcaatttggggattgactatatagatcaatttggggatgtacaactttttctgaaagtctctgactatatctaacattttagcaaccagcctagctctgcagtcaccttgctgaccgaagaattcagagatattattcctaagacaataagtgaatatctacaatatatgctactaaaataaaaaatgcaagattttactttggaagaccacaaacatgctgtccaaccccttagtcctcataaatacaaggcagaaatctttcacacaagcttcttgttgaaaagatcattcattctgttacttaagaggaacagccaaagagaacaatctaaaagaacaaggcagtccaaaaccagaatataatttaaataaaagaaagaaataaggaaggaaagacaacagaattctattaaatagccgctatgtaacatataccctgctaagtcttcacaaactgcattttacttatccagagagatgccataaatatgctccatcccacatttggcataagtaaattccctttcacattcacacaataagcttataagatttattcttcctcgctcaagaaagaatgcatatttttaaaaacttgcttcattaaagaatgcatattataagaaaatggaaattacaaaaactgatatccagcgagtggtataagagcagctattacagtgataaaaccttttaaaatttgataaccagcattgacaagggtaatttcattacatcatttgggggaatgtaaataggaataacctttttatgagacaatttggcagcctatcaaattctgcaatactcaactcaacaatcagttttaggtatttagttcaaaaagagacataaaagtataaaaaagtgaatataaacagaatgtttatgatggcactgcttaaaaacaacaaatgtccaccaacagattataatattgtaaaatagtacacagtaataaaagaaatgagagcacttcgtgttaccgatacaggaagataacaggtatctaatagctaaatatagataaaggccaagacaccctagggtatgcctatagtcccagctattagggaggctaaggcagaggggtgtcttgagtccaggaatttgagaccagcctgggcaacatagtgtgaccccatctctaaaaataaataaataaataaataaattagctgggtgtggtggcacacgcctatagtccttatctcgtaataaaaaataataataataaaaaagaacctggccaggtgcagtggctcaagcctataatcccagcactttgggaggctgaggcaggtggatcacttgaggtcaggagttcgagacctgcctggccaatgcggtgaaaccccatatctactaaaatacaaaaaattagccaggcatagtggcgtgtgaatcacaactactctagaggctgaagcacaagaatagcttgaacctgggaggcagaggttgcagtgagctgagatcgtgccactgcactccagtctgggcgacagagcaagactccatctcccaaaaaaaaaaaaaagctttattcccatatatttacctatgtgattagggtttcttcactatgatagctacaaaaacaggaaaaattgccaatcctatttcatcagagaaagaaatattgatccacagacccatgatttaattgagaaaaataacagaccccatcatctcataagaaaagcatttccaataaaattcaacttgtatagtaataacatcaaaaattacaacctatgttggccgggcacagtggctcatgcctgtaatcccagcaatttgggaagccaaggtgagcagatcacttgaggccaggaattcgagaccagcctggtcaacacagtaaagcccatctctactcttcttgaggaaacaaataggattaagtgaaaatgaagggagatttaaaaaaaacataatacatgcaatagactgataaatttcctctggaccaagttaaaacacagaacctttgtcacaggaactttaaaaattaaaatttaagtttacatacatatttagtagcagaaacatattagcacaatcaagaaaaaacttttaagcataaaaatatattacattaggataaaagtctgagacatgttatggaaataaaagttcaaggactcaaaagaagaatttaaatttccaatgataaagaacagcttgttcgtatatttttaaactagatgatggaaaccaaaatgctatatatttagaagcatttggatacatttagcagaatgaggtaacttatttttatgtggcaaaagtaaaacattctcaaaattacatgttttacaactaaacttttgctacaaaattttagatgtaaacttaatgtacaaagagacagaatttatcagaattctgagtatgtgaccaaaagttaagaccactactttagaccaagttaaaaagaaagcttgatatatactgacagaaagttttctaagataataaactaaaaaaagcaagttaaaattcatacgatttgattccatttgtaaaatggaatcaaatgaaagtaaagccactaaattttttattgtatgtttgtaactgcaaagaataaagtcttaaaagatctacccttcttgaggaaataaataagattacatgaaaatgaagggagttttctttgttttttgtttgagacagagtctagctctatcgccaagactggagtgcagtggcgcaatcttggctcactgcaacctctgtctcccgggttcaagcaattctcctgtctcaacatcccaagtagctggtagctgggactacaggcgtgcgccaccactctcagctaatttttttatcttcattagagacaggttttcaccatattggccaggctgatgtcaaactcccgacctcaagtgatctgcctgcctcagcctcccaaagtgatagaattacaggcatgagccatggcacccggcaaagattttgacttaatttttaagagagagggttttgctctgttgcccaggctggaatgcagtggtataatcacacctcactgtaacctcaaaatgctgggttcaaatgatcctcctccctcagcctcccaagtatatggtgacaacaggtgtgcaccgccacagttggcttatttatttatttatttatttatttaatttgagactgagtctccctctgtcacccaggctggagtgcagtggcacaatctcagctcactgcaacctctgcctcccaggttcaagcgattctcatgcctcagcctcctgagtagctggggctacaggcatgtgccaccatgcccggctaattttttgtatttttagtagaaacaggatttcaccgtgttggccaggctggtctctaactcctgacctcaggtgatccacctgcttcggcctcccaaagtgctgggattacaggagtgagccaccacgcccagacaattctatttgtataaagacagggtctcactaagttgctcaggctggtctcaaactcctgggctcaagtggtactcctgcctcagtctcccaagtagctgggactacaggcgtgagccaccatgatcagcctcgtccactgagctttaattcaatgctactttatttattttgttgctcaaatttttccagtgttggctattgggaactctttcagttgactcctgtgtccctctgacacactatctctgtcattgtgggctttggagcataactccaacagtctttttataaatgatctgtgcaattaaaggtaatttttttttccagtgaagggcataaataatgagatttaattgcgaataatatgcataatggaagtctcatttgcacatatctgtttactttctccctgcctttcctcctgcctcagcctcctgagtagttaagactaccaccacacccagttaattttttattttttttttctttgtagagatgcagtcttgctgtgttgctggggctggtatcaaactcctggcttcaagtactcttcccgcctctgcctcccaaagagctaggattacaagtgtgagtcaccatgcccggcctccctggtatttttgacctaaaatgtgcaaaagggaatttctgattcataaaatgtgactttcatataagatgcagcagaacacatttcaactggcttggaaaccagaaaattattcaaaagctatttgcttagatactaaaatagtaggtgaaagttggattagatacaggatacatacatagcctcaaaatatctcctcacaaattacttattcattacaaggagaaaaatataaattttacagtaaagaggctgggcgtggtggctcatgcctgtaatcctagcactttgggagggtggggagagcagatggcttgagcccaggagttcaagaccagcctgggtaacatcacaaaaccctgtctctattaaaaaaaaaaaaatacacaaattaaccaggtggccaggggtggtggctcagcactttgggagaccgaggcaggcagatcacatgaggtcaggagttcgagactagcctggccaatatggtgaaaacctgtctctaataaagatacaaaaattagccaggtgtggtggcacgcacctgtaatcccagctactcaggaggctgaggcaggagaatcacttgaacccagaaggcggaggttgcagtgagccgagatcatgccactgccctccagactgggagacaaagtgagaccccgtcttaaaaaaaattaaaaaataaaaataaaaattaggctggggggtggctcatgcctgtaatcccagcactttgggaggcagaggtgggtgaatcacctgaggtcaggagtttgagaccagcctggccaacgtggtgaaaccccatctctaccaaaaatacaaaaattagccaggcatggtggtgcatgcctgtaatcccagctactcgggaggctgaggcaggaggatcacctgaacctgggaggcggaggttgcagtgagccaagatggtgccactgcactccagtctgggcaacagagcaagactttgtcaaaaaaaaaaattaaccaggcatggtggtgcatgcctgcagtcccagctacttgggaggctgaggctggaagactgcttgagcctggggaggtcaaggctgcagggagccaagattgtgccactgcactccagctagggtgacagagtaaggccctgtctctaaataaataaatgcttttttttaattggaaaaaaattacagtaaagaaaacaggcagacactaacaagtgatgaaagttattatcaccaataatgtgatttagtgacatcatgtgcttcctgatgtggtgcacttaggacacatcatatttacatagtactactgccaaaaatgtggaacttgaatctaattatgaggaaatgccaggcaaacccaaattaggggacttctaaaaaataacttgcccatactattcaaaatattaaggtcatgaaagacaaagaagagttgaggaactgttccaattaaagaagactgaagagacatgaaaactaacgtgattccagatttaattgcagacaagaagaaaaaaatgagaaaggaatgtgttgaatctgttgggacaactgatgacaatgaaataaggttcgtggattagacaggaatatctcatcagcatttaacttctgatctctatcatcgtattcttgtaatgtgctaatgcctagttcttcggggaaagaggtgtgagttctgcagtttgttctcaaataatccaaggggaaggaactatatgtaaatataacaagaatgataaagcaaatgtgcaaaacagtaatgataaatccaagtaaagggtacatggtaggttcttggctctgttcttgcagtgtgaagtttaacaaagtcatttgcttgcagaatattatttaagaggtggggtctttggggtcttgctatgttacccaggctggactcaaactcctaggcttaagcaatcctccttcctattaagtagctcgggcagggctacaggtacataccaccatcctggcttgcttgcagaatatttttagcaatgaagtggtttttttgttgctttgttttttgttttttggggggtttttttgtattttttttgagatggagtcactctgtcgcccaggctggagtgcagtggcacaatctcagctcactgcaacctccacctcctgggttcaagcaattctcgtttctcagcctcctgagcagccgggattacaggcgcatgccaccacacctggctaatttttgtatttttagtagaggcggggttttgccatgttggccaggctggtctcaaactcctgacctcaggtgatccatctgcctcggcctcccaagtgctgagattacaggcttgagcccccgggtcccggtcccctgctcttctttcagactagggtactattattatgaactatacattttggtacgatattttttttccccaaaaagaactattagttatgagataaaagtctgttttcaaatcaaagtcagaaaataactatttttgcaaaaatgtcacactaattttttatgcatatatataaacttccctaaatatgatcatgagactattaagagggtttaggattagaccaagtacacctaccctaaataaatatctaccattttggagacacaattgtttgttagtctgtacattaacacaacccaaacctgaataaactgacaaacaaaaaccatttcaattcagtgtaataagcaatgattacacatctatcatgtgccaagagcagtggtctctaatgcagatctggccaggtttctcagtacccctgcgccctcagtttctcacaaaccatgagattcttcataatttcacttgatctgcttctccatgattctctccggtcacttgtcactgtaacctttgatttcttaaccctgagaaacttgaggtcgctagtaaactttgattatgctgtgccatcctgctttcgctaaatgtgtcattctccatgaaatatggcagtaaacaaaatattattcctgtgctagagcatgttaataagtgtaagataacaaatagcttaattatgatcttacaagtaccacagaggaaagaggaaagttcagggaagaaaagcacttaccaagaggaagatgaaaagaaaggctggcagggtgtgggggtagtgggaggtctagaagggaaagggaacagaagtcagggaatgttctggaaagttacatctaaatccaatcttaaaggattttagaacaacaactctagcaaaagctttatataacatcaacctccagcccagaaccgtcctccaaactccggactccttatctgtgtatccatcttctccatttcgatgactagcaggtaactaaatgtgaacatatcccaagctaaatttcttctcttcccttcaaatcctactccttctgtagctttccccatctcagatgatggcaattctttcctttcagttgctcaggcaaaacccctggagtaatactggatttgtccttggcaacatcaaggccttatactttaggtaagagaagttttggggtcatgcatatgttaaagtctgatgagagtgaattcaagaggaaatggaaggaaaggaattggtgacaggtagtagaaacgtctctttaaaagaaggcaggccgggcacggtggctcacgcctgtaatcccagcactttgggaggctacggtgggcggatcacgaggtcaggagattgagaccatcctggctaacacggtgaaaccccgtctctactaaaaatacaaaaaattagccgggcgtggcggcacacgcctgtagtcccagctactcaggaggctgaggcaggagaatggcgtgaacccgggaggcggagcttgcagtgagccaagatcgcgccactgcactccagcctgggtgacatagcaagactccgtctcaaaaaaaaaaaaaaagaaagcaaagcaaaaagatagatgagatggatgtgagattcagacaggattttttttttaatgataaaaaaattatagtatgtttgatgctggtgaatgacccaattgaaagaaaagaactgatgatgcaggagacagaagaggtaactgtgacagcagtggcctgagtgacagcatgaacagttcacccataacagaaaaagagcagacaataagggcatagatgaacataggtgaggaggaaatatgtggtgggaccatgtggaagttctgttctgattaagccaattaatttatgaatatgacttatgaatatgaacaggagagcaagtgccagaagtttcagagagtagatgtgaaacagttgtctaggaaagtgaaatattttacaaactcatgtgaattagtggcagagtccctcagtttgtgctctgtattgaaatgaagcaagattcttttacatttcctgaacatacatctaataattctatttgaatttaaaaaatggatttttagtttttaaaaactatcagtgagatactagatcaagtagaaagtatgtgttcatgaaaaaggtatagtttcacagaaagaacaggggtttattttatttatttattttttgagacggagtctcgctgtcgcccaggcttgaatgcagtggcacgatcttggctcactgcaacctccaccttctgggttcaagactctcttgccccagccccctgagtagctgggattactggtgagcaccaccacgcctggctaattttttgtatttttagtagagatgagatttcaccatgttgatcaggctggtctcgaactcctgacttcgtgatctgcctgcttcagcctctcaaagtgctggggattacaggcatgagccaccatgcccagccagaacaggggtttaaaatgagaagatccagtagctcatgtctgtaatcccagcactttgggaggcctaggcggaagggctgcttgaggccaggagtttgagaccaacctgggcaatatagcaagaccacatctctatttaaaaaatattgttttaattgtttaataaaaataaaagtgagattagaagatctgggttcaggttgtgctgtcattattaactaaatgatcaaatgcaaccttctcatttctaatacttaagcttcacctgggaagtgggactaaatgcagtaatacaggatgtcaactgtacagtgctaaatagtaattgttattctcactgttattagctattgttattctcactgttattaactatatgttgaccaactgtaaatttatctatcaaccacctatagaataactgtaggctgatcaagaaactttactagaataaaataaaatgaaagcaagaagaggttagaaaggaagaagagaagctggattctactatacatacaacacctcacaatctaaaaatataagcccaggagagaataaaaacaacgtaacaacactaaaaacaataaggttgacaagtagaaaaaaggcttgtatatttccctgccagataagacatactggaccctaatcatactgcacattactggaaaagtcctaattcaaaagatgctataatgtgttttctcactgactgacttccccagagaacccccatttcatgaaatgaaaactttctcagtgaaatacacacagcatcgaaaatagcacactttttttttttagaaactaatcacattctctgagatataaagatattcaaatttactttattttgttgattccctctccccaggagatgtcagattcccacagcaggcaaatcagcttggcagagaagtagcaagaacctgagaaggcatgtgtgctgtgagtcagccttgggcaaaacagccaggtctcaatgcaagggaaccctctggtgctgtcagacccatgccaacactgccctctactggccaattaagctggttgcaattttctgcaaaagaaataccagtgtattaaggagaaattctgcagtatctattaatagttgtcacttaggcccttttccatggattagtgtttctcaatcatgcatgtgtatccgagtcacctattatggcttgttaaaacagactgctggtgtgtggcagggtacggtgtctcccacctgtaatcccagcactatgggaagtcaaggcaggaggatcacttgagcccagcagttcaaaaccagtccagtccaggcaacacagtgagaccttgtctttactaaaaatgcaaaaaacttagccaggccattgccctgtgttaacttcttattctatgggaataagcttttagcttcaaaggccttatggaatgttgaggagaaagcattttctcgacttcagaagaagaactatttaatcacacagagaacagaaaaattaagtgacttgttccataaatgtgctatttgtgtctgagggtcaatactgtgctagatgatcatctgaaagaacaagagtcacagatgtttgcttcgtcattcacatctaagagaaagggttctatcttttgtctccctcacctagaaaatagggccatataatgctgataatgaacaattaaggaaaacaccattttttaaggaaaaaagtcaggaagtacataattttctttttatttttttcttattacagccgtggtgcaaaacaagtagtacacatatcctgaaaaagtatttgagaattgtttcccaaggtgataggcattttagaagaagagtttgacaccaattttatttctaggtattggtatttagatggtttacacaggcaatgctaagataaaatacttgtagaagcaagaataagttgaagtgcaaaaggaaatgagtatagtagatccaaagaaaaggaataaaggtcggggggttcttgtgttgccaggcatgaaggcagaaatcatacttagagaaaaaagcaattttcctactttgtcataaatgccataaaagcaaccctgctttcttacttctcattttataagttgaagacaattagggtggacatgtaagaattaaaggaaataaaacaccattgttcaaagagttctattatgtgtaacctactcaaccgtcccttctatatctagaggcaagaaaatggttgataaacttccactggttggcctaactaagcctgttgtaagaacatatcgagagcactaggctgggtgtggtggctcacacctgtaatcccagtgctttgggaggctaaggcaggaggatcgcttgaggccatgagttccagaccagccagaggaacacagtctgactgtcgctataaaaataaaaggataagcaaggcacgcgcacctgtagtccaagctattcaggagcctgaggcaggaggaacgtttgagcccaggagttacgttagatgttgcagtaagctatgattgtgccactgcactccagcctaggtgacatggaaagaatctgtcttttcttttttttttttgagacggaatttcgctcttgttgcccaggctggagtgcaacaatggcacgatctcggctcacggcaacctctgcctcccgggttcaagtgattactcttgcctcagcctcctgagtagctgggattacaggtgcccaccaccacgcccagctaatttttttgtgtttttagtagagacagggtttcaccatgttagccaggctggtctcgaactcctgacctcaggtgatccacccgcctcagcctcccaaagtgctgggattataggcgtgaaccaccgcgcccagtaagaccctgtcttcaaaaaaaaaaaaagtgtcagcaatcagcagtagtttactgaacctcatctaagaacaaaatcaaacttaaagttagatgtataataaaacattaatgaagtctagggcccttccatcacttctaaagatgtattcagaagaacatcttgtttagaatgttctccaggaaaaacacaaatatgaaacctgtcattatggcaaaaaccatcagtccgataatgtataaaaatcagacccacagcagagaagtctccattcataaagaactcactaattgcaccagatttctacaagactaaataaggcggcttccttcgtttttcttatttgatgtctccaaacagccatcaccccttcctttaagttaagacttctacaacttttaggaagctggtatggaaaaaatgtagtaatttacaacctatcataattataaactttattattattattatttttagagacggggtctctctctgtcacccaggctgcagcacagtggtgcttttatggctcactgcagcctcgacctctggggctcaagtgattgcctcctacctcagcttcctgtgtagctcggactacaggcgcacactaccacgcccagctataattataaactttaaacatggtatcttcaacaagttcgtggaaaatgcattctatgaaaaaattattcatggatttcaagggagtttttttgtatcaaaataactcatactccagcctgaccaatatggcgaaaccccatctctactaaaaatacaaaaattagctgggcatggtagcatgtgcctataagcccagctactcaggaggctgaggcaggagaatctcttgaacacaggaggtagaggttgcagtgagccgagactgtgccaccgcactccagcctgggtgacagagagacactccatcttaaaaaaaaaaaaaaaaagctcatactaacttgttataacacgtctgaacaggatctagtttgaagcactaaaaaggataaaacatcagtttgaaaagagcccctaataaagcaacatgaattctgctaaaattgaagcaaaagcaaatggtaaatttatggtgaagcttggatgaaagaatggtgaaatcactgatgctttgtgtaaagtttatggggacaatgccccaaacaaatcagtagtttacacatgaataacttgttttaagacatcagccagatgcagtggtccgcacctatagtcccagctacttggaaggctgagacaggaggatcacttgagcccaggagttcaaggctgtagtgtgctatggttacacctgtaaatagtcactatactctaatttgggcaatgtagtaagactctgtctcaaaaaaagaaaaaaaataaaggaggagatgatgttgaagatgaagcccaccgtggcagaccaccaatatcaatttgagaggaaaaaagaatgatctaattgaagaggattgacaattagcagaaacaatagccaataccacagacatctcaattggttcagtttatacaattttggctgataaattaaaattgagcaaactttccactcaactggtgccaaaatggttgcatccagatgagctgcaaagagcagagctttcgatgtaaattttaaacaagtgggatcaagatcctgaagcatttctttgaagaattgtaacaggagatgaaatatggttttaccagtataatcctaaagacaaagcacaatcaaagcaatggctaccaagaggcgtaagtgctgtagtcaaagcaaaagtggatcagtcaagagcaaacacaagagttttttaggatgctcaaagcactttgtctgttgactttctggagagccaaagaatgacaacatcttattatgagggtgttttgagaaagtcagccaatgctttagcagaaaaacagccaggaaagcttcatcagagagtccttctccaccaggacaatgctcctgttcattcctttcatcaacaaagataatttgtgacagttttgatgagaaatcattaggcaaccaccttacaacagtcctgatttggttccttcttttttgtttcctaatctttaaaaaaatctttggtagcaacaaaaaattaaaaacttaaaccaaaaaaaactttaaagggcatccatttttcttcatttcttcatttttcttcatttaataatgtaaaaaagccaggcacagtggctcacacctataatcccagcacaaaagaaaaacaaatatttactccaaaaaatttggattccttaatggaaaacgggaaaatctattctctcttaatccataatgcacggtggagacatttgttctttgactgactaacataaacaaagaaaacctagtatgaagaaaggaatgataagatgtaaatatggtagcaactagtcatggttgagatgctcttcccatcctaatattaacttaccctcatcagtcataggtgaaagaagctagctgcttttcgttttctaatttcctttaactgtgcattgtttccatcatctgggaatgagcctaggtggataaggacagtgaggtggtagcagtagattttcttgtgcttcatcttgagttatttgatccatgtaacattaacttggcccaagaggaggaaagtttttaagacattattttatttataaaaaattaaatcctccctgctacttttgatatgtaaatggtggctcatgcctgtaatcccagcactttgggaggccaaggcaagtggatcacctgaggtcaggagtttgagaccagcctggccaacagggcgaaaccccatctctactaaaaatacaaaaattagccaggcatggtggtgcaggcctgtaatcccagctactggggtgttgaggcaggaggatcgcttgaacctgggaggcggaggatgcagtgagcagagatcgtgccactgcactccagcctgtgcaatagagcgggactccatctcaaaaaaaaaaaaaaaaagttcattaactcagaaagactactccagaaattggcgagtggttactccaggaaggagaactgtctggctagggtgtagggattgggagaatttgttttaccgtacatccctttggaccaattggattttgtacatgtgtattttttagcctgttcaaaaaatgtatgagtttctggaaaattgaattaaaggataaaaataaaatatgaactttacttctcaacataagcttttgcaacatcaagatacttttgtaagcaatgatagcaactttttttcttttcttttttttttttttttttgagacagagtctcgttctctcgcccaggctggagtgcagtggcacgctctccactcactgccacctccgcctcccaggttcaagtgattcttgtacctcagcctcctgagtacctgggattacaggtgcacaccattacccctggctaatttttgtatttttagtagaggtatggtttcaccatgttggccaggctggtctcaaactcctgacctcaggtgagccacctgccttggtctcccaaagtgctgggattacaggcgtgagccactgcacctggtctggagtaaatatttatatggatataattagaactctcggtacttttttaaatgagttgtggtctgccccccctccccaacacacaaattaaacatatattaaggaagcaggttttcttcttccacttggctgtagaaagccaaaagcaacgtcactcccaccctaacaacaagaaacagccatatcaactacaaaaaacttgaattaattggaaagccacctagtagtatgaaatccaaagaaaaacaagcccctccaggaaatatgggaggtgaacaccagctctcctgtatcagagcatgtgcagaagagacattgggtaccctacaagcaggtaagaaaaattcaagtaaaaattgtagtgatttgtcaaaggtaaatgaaggctagcatgagactatggggcccctcaaatccacagacacaaagggaattcacactcatttgcaggattgtcttcacagatgtctgccgcatgctcacaggaaagattggaagcagggtgagggaccagacagagcctccctccatggtacagacctggagaaggccaccaccattaagggaaaagcatgaacccctcccactgggatctttctctcctggggaaggagtacaaaccctgtcaaccccagagcacacaagaagaccggctgtagctagggaaagagtaatagaaacatactttataaacctgagagaggagcaagaaaaactcctcatccaggatcctacaccaataccatgagaagacgctactactgtgaaaaggataataacgttgagaaagacccaaaccgtgagattaagcacaggattaagcacaaaatgggacaataaaaaaacaaactctgcctgccacctggctagaactcttccgataagagagaaaagagcatggacaaggacccctctgaggcacgggtacacagggaaggctgaaagagtggagcaagcacattaaagaaataccttccagggcctcagtccccactctaagcatagaattaaagggattgaagacagtagtacactgaaggcaattacggtaatgacaaaacccaaaactagctcagctcctgttaaaatgactaaacccaagagacatgcctatttccaaccataacaccttttggcctcagcctactattttacatgtgagatccagcattcaatcaaaaactaagacacacacacacacacacacacacacacacacacagagcaatcagactgagagatgacccagattttcaaattatcacacagagatttaaaacaactatgattaatatgttaaagtctacagtagaaaaggtggaaaacataggtgaacagatgggaaattttgacagaaataaggaagcttataagagaggcaaacagaaatgctagaaattaaaaacataaaaaatgctaaagtagataatgccactgaaagctcatcattagattcaacacaactatgaaaagatcagggaattggaagataggtcaaaagaaagtacccaaagtaaaacacaaacagaaataaagagagaaaaaaaccaacaatgcatccaagagatacaggacactatccaacaatttaacaaaaatataattggaatcccaggagaaaagaaaaagaatggggcagaagaaatattttaaaagataatggccaaaaatttcccagctgacttaaccacttcaaaagcacagatcaagaagctcagaaaagcccaagaagaaaacttccaaaatatcatctaaacacaacatatttaaactgctaaaaaaaaaaaaaaaaaaagataaaatcttaaaggcagacacaaagaggaattcacaaaggaaatatttttaaatatttttaaatgaatgaaaataaaaatacaacatatcaaaatccatgggacacagctaaaatggtgattagagggtaatttataacattaagtaattacattagaaaagaaatgtctcagatcaaaacctgatttaagctgtcaccttaagaaaccagaaaaagaataaatcaacttaagtaaacagaagaaaggaaaaaacaaagatatgagaagaaattaaaaacagaaagacaatagaaaaaaattaatgaaaccaaaagctggatctttcaatacaattgataaacctctacctagacttatcaaagaaagaaagaaagaaagaaagaaagaaacatcacaaattactagtataagaaatgaaaaaggggacataatagatcctacagacattaaaagcatatctccattaatctgcaacatttatgccaggaaagggaccaaggaattccttgaaagatacaaactaccaaagctaacttaagaaacagataactggaatagttctatgatctctgaaagaaactaaattcctagtttaaaaatccgacagaaaattccaggcccagatagctttattgatgaattctatcaaacactgaaaagaagaaaaaatatcaattctatgcaaactattctagaaaagagaaagaagggaacacttcccaattcattttatgaagtcggcgtgacctcaattctaaaactggacagaagacattatgagaaaactacagaccaattccctcatgaacacagatacaaaaatactcagccaattattagcacatctgatccaggaaaatggcaaatttctcttaaaggctttaattatgctttaatcctgaggtgggatgactccaaagacaacaaatggcatctgattccagtctaaatgaagttctgatataaccgcagaattttatttaacttttcaaagctactttcagagaaaaggcacagtagacagtttaatttaggaaattaagaagaagattatatggttgttgaaacattagagaagaaacattagggttaaaagtcatccacagactcatgaacgctcactcaaagggtggtaagtctacctcctcggtatctaacaaagaaacataaagttactagcctacactaaaaaaactcagctcaattctcagtttccaagattataccaaaggcataatccctaacctgctttctgaacatatataagcagtctggtttaaatacttaccttcaatctggctagtttctgagcacggtttcttctttgactctgagttcccggttttctcatcaacatccaggagaggaatatagtctgtttttccaacagtttctcccacaacatcatcaaaggcctctgcctctagtgtggcaatgaagtcccgctttatctctccctcaatgtctggagatggttctgttaatgcatctgcaagactgaggtcagccattctgcaccactgcaactgcctggtgaagaggaaaaagatctttcatgtaacgagcactgcaaaaggaaaaacatttctagaaactcttgtcaattgtttgaaacaaacaaaagaatcaaaatctaagattttacagctagaagaggctccctcatttgaaagatgagaaaaataaagctaagaaatggacagtctgacccaaggtaactcaccgctagttactcttttctcacatttctgggggtggagggaggtggtggtggcaggacaaagcaattgcaattgtgtcctttctatttataagaaaagtgaggtgtaaaaaaaccccacaatcaacatatccaaagctatagccagtaagattcaaatcaggtctttacatagttacattactatcggacaaatgaaatcaactttcttgaccaaagactgtgagtatggatcttatcttggagtgagtacctgcttcttcatgaatcacttgtggatagtcctgtcaaccaaactacttagccctgccagcataaaaaaaaaaagacacgtttccctcaattagctaagggagatggtccctctctgtagtcacgtatattaccatttttacagactaccagcttcttaattacataatctgcagttaagtaaatctactggcagccataaaaaagaacgagatcatgtcctttgtgggaacatagatgggaagcaggaggatattatccgcagcaaactgacgcaggaacagaaaaccaaataccacatgttcttacttgtaagtggaagctaaatgataacttacgaatacaaagaaactgcagacactggggtctcctggagggtggagggtgggaggagggaaaggagcagaaaagataactattgggtactagacttaattgaaataatctgtacaacaaacccttgtgacatgtgtttacctatgcaacaaaccttcacatatacccttgaacctaaaataaagtttaaaaaaaaaaaaaaagtaaatctataagcaaaccataggtgaatagcctagaaaatacagaaataatgtagtaaaaagagccaaaggggccaggtgcagtggctcacacctgtaatcccagcactttgggaggccgaggcaggaggatcacttgagaccaggagttcaagaccagcctggccaacatggtgaaaccccatctctactaaaaatgcaaaaattagcaaggcatggtggtggacacctataatcccagctacttgtgaggctgaggtacgagaatcgcttgaacccgggagatggaggctacagtgaaccgaggttgcgccactgcactccagcatgggcgacagaggaagtctccgactcccccatcaaaaaaaaaaaaaaaaaaaaaaaaaagagccaaaggcctgcaataaattgggcaccattcaaatgcagggcataataggaaataaagtgtgcaaggtactacgcctgctttcaaaaagtctaacagaaactccaagagactccataggataagttgacatataagctatgttgttgacaaggtaaatacaagtcaaacagatccttagttgcacaatgtaatggccactacttgtgtttgtccagaaatctattcttcctatctcccctaatacaaaccaatccctacccctatagggtttgggacatgactagagttgggtcaatcagaagtcaagaagaagacagttggaaaggatcatttattgactacacgctggaagaaaagtccatgagtgacagctatttagttgccctggttgactacttcaagtctaagtgagcggccttcatctttcttttgcctaatttagccaatctatttctgttgtttacaatggaagaatctcaactaatacacagtctttctccaacccaaacttgaaaaagtaaaaatatactatgattcaagccacttaattttcaggctttcctttcaagctgttatccaccgtctacctctctccaacaaatgtacttaggaaaaagaaatagaattaaagcaaggaatatggtcctatcttccttccttcttattttatcttcatctttgttcccacacactcctctcctcccacttacatgctgtgaggctaccatgattacaaaacatgtacaaagcaaatacttccagaccctgaaaaatcagaagtcatcgtacccccaattcccaaatccaacaagcaaagggtgttgctatatattagagtggtggcacagaggcttaagaatcaagatccgatacccaaataagtacagacaggataattaaggccaggggcaagatctacatcttctaggcaagtgtctagaaaaaaaagatagtatgtgttcagtactgggaatgctggagatagtttgtctctacctatatggagcttagtgaaaacattcattacatattctttatattatctaagaaaaaaatacaataccaagatttggaaagatattaaataatcaattatatttatatagacttccaaataaaatctaaaaatttcaaataaatttaagccttcttccatgtgcctaattttatgagttttcctatttgaaataacaaccttaattcctcatcaataattttaaatgattatcttttcaaattctaggtagtaccattatacaaaaatgtagtagaaaagagctgtttctctgatttcttttctttttgaggcagagtcttgcctcactgcaacctccacctcccaggttcaagtgatcctcctgcctcagcctctctagtagctgggattacaggtacgcaccgccacacccagctaatttttgcatttttagtagagacagggtgccaccatgttggttaggctggtctcgaactcctgacctcaaagtgatccacccacctcggcctcccaaagtgccaggattacaggtgtgagcccctgcgcccagcctgcttacttttcttaaagcaaatgtgatatttaaatttcctgtgactatactaatgagttcctaaatcatatctttttattttttatttttttcagacagagtttcactcttgttgcccaggctggagtgcaacggcaccatctcagctcaccggaacctccacctcccaggttcatgcgactctgtcatcatactacttggaatttgatgaagttcatttaggtctcaaaaaatgtcaaaagatacgtgtgacccagatgtggtggcatgcacctgtagttctagcctttcaggaggctggggcagggagattgtaactaggagttccaagctatagtgtgcaatgatcacgtctgtgaatagccaccacaactccaggtgtggagccacgattgcatcactgcactctagcctgggtgacagagcaagactctagtctcaaaaagaaaaaaaaaagaaaaaaaaaatcacactctgagccaggcgtggtggttcacacctgtaatcccagcactttcagaggctgaagtgggaggattacttgagactaggaattcaagaccagctaggcaacatactgagaccctgcctctacaaaaactaaaaaaaaattagctgggtacggtggcatacacttatagtcctagctactcaggaagctgaagtgtcacaatcgcttgaacccgggagtttaagactgcagtgagccatgattgtgatggcaccactgtactccagcctgggtgacagagtgagaccctgtctcaaaaaatttttaaaaataaaaataaaaaataaatagggtacagaggctcatgcctgtaaccccaacaatttgagagcctgaggcagctggatcacttgaggccaggagttcgagaccagcctggccaacacggtgaaaccccatttctactaaaaacacaaaaattagctgggcgtggtatcacatacttgtggtcccagttaggaggctgaggcatgagaatcactggaacctgggaggtggaggttgcagtgagccgagattgcaccactgtactccagcctgggtgacagaaaatttgtctcaaaaaacaaaaattaaatttaaaaacttttaaataaataagtaaaaaataaatcacactctggctgttaacattaaggccaaaaataaataaataaataaataaataaataaataaataaatttaattccatttagaaatatctaataactataataaagttaaatccaatttaatcagtctgttagaagaaaaatagcgacaagagcaaattatgtcaaagaaagacacgcactgagagagtttaataatagatgtcataaagaagctgttgaatcttctccataaaaaagtaaatatgggccgggcgcaatggctcacacctgtaatcccagcactttgggaggctgacgtaggcagatcacaaagtcagaagatcgagaccatcctggttaacatggtgaaacctcctctctactaaaaatacaaaatattagccaagcatggtggtgggcacctgtaatcccagctgctcgggaggctgaggcaggagaatcgcttgaacccaggaggtggaggttgcagtgagcagagatcgcgccactgcactccagcctgggtgacagagtgagactccttctcaaaaaaaaaaaaaaaaaaaacatattaaattgtacaaaactgttatgatcagccattccaaagcactggacatcaacaaactgtagaacacaagttgagaagctttgcattctcgaaatctgcttgagctttggttaagaccaggaagagtctatggcccttttgtctagagctgtttccactcccatcttagcccacagctcagtttggtcagcaagaattacacttttattagtgtgatggttaacactgagcatcaacttgattggaataaaggatgcaacattgatcctgggtgtgtctgtgagggtgttgccaaaggagattaacatttgagtcagtgggctggggaaggcagacacacccttaattgggtgggcaccatctaatcagccaccagcgaacataaagcaggcagaaaaatatgaagaggcaagaggggcctagcctcccagtctacatctttctcctgtgctggatactttctgccctcgaacatcggactccacgttcttcagttttgggacttggactggctttcctcgctcctcagcttgcagacagccttttgtgggaccctgtgattgtgtaagtcaatacttactaaattcctctttttataaacatacatatatatcctattagttctgttcctctaagaaaactctgaccccagactaacacagactctggtaccaggagtggttccagaggaacagaatgttaaggatggagttcttttgttggtttgggggtttctggagttggctgcttaatatgattgatccaaaaatgctgaggactctacttctaatagcatggagaacattcatagtccttggcgtgaactatttagagagttatgcaaaataaatgcatttgacactcctgattcactgctcatgaaaggtaaggactttagtgactctatacataatacctttgaccatatgtggaaaaccaacgaacataatgaagctggttggttgctcctaagttcagtgaacaaagtgatgaaagaaaatgatgaactcagggattctgtttcctggcttcagaagcagatactgagtctcaaatctgctaagattgccctgagtgagagtcttagctcctgttgagaaagagctgaaattgtggaaaaacagacataagctcttatcatgcgagtggctgacctgcaacaaaagatgcatgcacagccacctgaggtgtctactgctaaagtgagggcattgattggaaaagaatgagacccagaaacttggaatggggatgtgtgggaggaccctgatgaagctgggaacactgagtttataaactctggtgaactttttttgccagaaggaacagcttccccatcccccatagtggcagcataaccccccatccccgccatcaacctttccatctttgtctacggacataaaccctgagctgcctgaggcaagagtcatggcctcctctcaggcagttgccaggcaagataatgttgattctccttagaaggtacctgcaacacccatttgcttctagacctataactcaagtcccacaggtccctagaggtgaggttgagagtgtgacccaggaggaggtgcgctacactcaaaaagaactgttctcggccaggcacggtggctcacgcctgtaatcccaatactttgtgaggccgaggtgggcggatcacgaggtcaggagttcaagaccagtctggccaacatagtgaaaccctgtctctactaaaaatacaaaaaattagccgggcgtggtggtgcacccctgtaatcccagctactcggcaggctgaggcaggagaattgcatgaacccgggaggcggaggttgcagtgagctgagattgtgccactgcactctaacctggcaacagaacgagactccctctaagaaaaaaaaaagaactgttctctaatttatataaacagcaatctggagaacaggcatgggaatgggtattaagggtatgggataatggtggaaggaacatagagttggatcaggctgaatttattgatttgggcccactaagtagggactctgcatttaatgttgcagctcggggagttaaaataaggttctaatagtttatttgcttggttagctgaaatatgcattaaaagatggcccactgtgagggagctggaaatgcctgatatctcttggtttaatgtagaggaaggcatccaaaagcttagggagattgaggtggtggagtggattactcactttagacctactcatcccagctgggagggtccagaagatatacccttgaccaatgccttgtgaaatagatttgtgagggcagcacttgaatctttgaagagccctgtaattgctcttctctgcatgtcagacctaatggtgagaaccgcagtcactcaattacaaaattgaaatacgaggggaataactggatcccaaggtggcaggggccaagtagcagcactcaaccatcaaaggcaaggtgggcgtagctaccgtaatggacagcagaggcaaagtgacaatcagaatagtctgactcatgtagagctctggcattggctaattaatcacggtattcctagaagtgaaacggacaggaagcctactgcattcccacttaatttatacaaacacaaaacttctaggtcgaatggacaaaagactaatttgaattataaaaagagaatcatggcccctcactcaatccatttccagacttcagccagtttacagacccagaaccccttgaatgaaggggaggccaggtacccttgagaaaggaccccactactttactgacaatttatgcagtgaatctttctcccatccttccccaaggagacctccatccaacctttcactttggggactactggacactggctctgggctgatgatgactccaggggacttaaaacatcactgtggtcttccagttaaactaggggctcatggaagtcaggtaattaatgaagttttagcttaggtctgacttacagtgggcccagtgggtccctggactcatcctgtggtcattaccccagtgccagaatgcataattggcatagacatacttagcagctggcaaaacccccacactggctccctgactgctaggttgagggctatcatggtgggaaaggccaaatagaagcccttagagttgcctctacctaaaaaaatagtaaatcaaaaacaatatcacatccctggaaggtatgcagagatcagtgccaccatcaaggacttgaaagatgcagaagtggtgattcccaccacatccccattaactctctcatttggcctgtgcagaagacagatggatcctggagaatgatagtggattatcataagcttaaccaagtggtgactccaattgctgctgctgttaccagatgtggtttcattgcttgagcaaattaacacatctcctggtacctgctatgcagccactgactctgcaaatgcctttttctctattcctgtccataaggcccatcagaagcaatctgccttcagctggcaaggccagcaatatacctttactgtcctacctcaggggtatatcaactctccggctttgtgtcataatcttatttggagagatcttgatcgcttttcgcttccgcaagatatcacactggtccattacattgatgacattatgctgactggatccagtgatcaagaaatagcaaacacactggacttattggtgtgacatttgcatgccagaggatgagaaataaatccgactaaaattcagggaccttctgtctcagtaaaatttctagggatctagtgttgtgggacctgttgagatattccctttaagttaaaggataagttgttgtgtttggtctctcccacaaccaagaaagaggcacaatgcctagtgggcatatttggattttggaagcaacacgttcctcatttgggtgtattactccggcccatttactgagtgacctgaaaggctgccagttttgagtggggtccagaacaggagaaggctctgcaacaggtccaggctgctgtgcaagctgctctgccacctgggccatatgacccagcagatccaatggtgcttaatgtgtcagtggcagatggggatgttgtttggagtctttggcaggctcccataggtgaatcgcaatggagacttctaggattttggagcaaggccctgccatcttctacagataactactctcctttttttttttttttgagacgcagtgtcactctgttgccaaactggagtgcagtggtgcgatctcggctcaatgcaacctccacctcccaggttcaagcgattctcctgcctcagcctcccaagtagctgggaatacaggtgcgtgccaccacatccagctaatttttgtatttttagtaaagatggggtttcaccatgttggccaggatggtctcgatctcttgaccttgtgatccgcccacctcagcctcccaaagtgctgattacagctaactactctccttttgagagtcagctcttggcctgttactgggctttagtggaaattgaatgtttgactatgggtcatcaagtcaccatgcgacctgaactgccctgcctatcatgagctgggtgctttcagacccatctagccatacagtggattgtgcacagcagcattccatcatcaaatggaagtggtatatacgtgatcgggctcaagcacgtcctgaaggcacaagtaaattacatgaggaagtggctcaaatgcccatggcctccactcctgccaccctgccttctctctcccagcctgcactgatggcctcatggggagttccctatgatcagctgacagaggaaaagaagattagggcctgcttcacagacggttctgcatcatatgcagacaacacccgaaagtggagagctgcagcactacaacccctttctaggacatccctgaaggacaacaatgaagggaaatcttcccagtgggcagaacttcgagcagtgcacctggttgtgcactttgaatggaaggagaaatggccagatgtgtgattatatactcattcatgggctgtagccaatggtttggctggtcagggacttggaaggagcatgattggaaacttggtgacaaatttggggaagaggtatgtggatggacctctctgagtggtcaaagacaagatatttgtatcccatgtgagtgctcaccaacaagtgacctcagcggaggaggggtttaataatctagtggataggatgacccattttgtggacaccactcagcctctttcccctgccatcgcccatggccaacaaagtggccatggtggcagggatggaagtaatgcttgggctcagcaacatggacttccactcaccaaggctgacctggctacggccactgctgagtgcctaatttgccagcagcagagaccgacaccaagccctcagtatgtcaccattccttgggtgatcagccagctacctggtggcggattgattatattggacctcttccatcatggaaagggcagaggattgtcctcactcaaatagacacttactctggatatgggttcgcctatcctgtatgcaatgcttctaccaagactaccatttgtggaatgtttttttggtttgttgttgttgttgttgttgttgttttgagaaggggtctcactctgttgcccaggctggagtgcagtggcacaatcttggctcattgcaacatccgcctcccgggttcaagtgattctcctgcctccgcctcccaagtagctaggattacaggcacccgccaccacacccagctaatttttgtattttcagtagagacagggtttcaccatgttggccaggctggtcttgaactcctgacttcaagtgatctgcctgcctcggcctcccaaagtgctgggattacaggcgtgagccaccgcacccagctgactcatggaatgccttatccaccatcatggtatgccacgcagcattgcctctgaccaaggcactcactttacagctaaagaagtgcggcagtaggctcatgctcatggaattcactggtcttaccatgctctccatcatcctaaagcagctggattgacagaacagtggaatggcctattgaagtcacaattacaacgccaactaggtgacaatactttgcagaactgtgggaaagtcctccagaaggccgtgtatcctctgaatcagcgtccaatataaggtactgtttctcccatagccaggattcacaggtccaggaatcgaggggtggaactggaagtggcaccactcaccatcacccctagtgatccactagcaaaatttttgcttcctctcctgcaacattatgttctgctggcctagaggtcttaattccagagggaagaatgctgccaccaggagacacaacaatgattccattaaactggaagttaagattgtcacctggacactttgggctcctcctccctttaagtcaacaggctcagagggggagttacagtgttggctaaggtgactgacccagactatcaagatgaaatcagtctacaacttcacaacggaagtaaggaagagtatgcatggaatacatgagacccattagggcatctcttcgtattaccatgccctgtgattactgtcaatgcaaaaccacaacagccaaatccaggcaggactacaaatgatccggaccattcaggaatgaaggtttggatcactccaccaggaaaaaaacccatgacctgctgaggtatttggggaaggcaaagttaatacagaatgggtagaagaaggtagtcatcaataccagctatgaccacgtgaccagctgcagaaatgaggactgtaactgccatgagtatttcctccttcatttgttaaaaacatgtttgtgtatgtatacacatgtactaatatcttcactttatatttccttttcctttatcatgtgacataagatttattgatttcataacagcatttaagtattattaactttatgtaatagtatttgggttggggattggtgtgtttctggttgtatgaaggatagttttattacattaggtgtaattatgaccttattattgtctttattttaagattacatacgatctcagatgtatatgggttcaagttgacaaggagtggacttgtaatgttaatactgtcaacttgattggactgaaggatgcaatattgatcctgggtgtatctgtgagggtgttgccaaaggagattaacatttgagtcagtgggctggggaaggcagacccacccttaactgggtgggcaccatctaatcagccaccagcgaatatagagcaggaagaaaaacatgaagagatgggcctagcctcccagcctatatctttctcccgtgctggatgcttcctgccctcgaacatcggactccaagttcttcattttggggactcggattggctctccttgcttctcagcttgcagacagcctactgtgggaccttgtgatcacgtaaatcaatacttaataaactctcctttggagatatatcctattagttctgtccctctaagagaatcctgactaaaacaagtagtgtggggctcgtgacaaaaactgatagctttgctgccaaaggggctcctgtggcatgacagagctgttgtccacagcaaatgccatctcacactactggaattataaattccactatttgaataaccactgccgaattcaggatttagcagcttttctgaaggaaccataaataggaattcaatggttcctatagtaggaactggacttggtaatcccagcctgtaatctcccagcactttgggaggccaaggcgggtggatcacttgaagccaggagattgagaccagcctggccaacacagtaaaaccctatctctactaaaaatacaaaaacagaataactagctgggcactgatttttattatttagatggtatgcacctgtaatcccagctactcaggaggctgaggcaggaaaattgcttgaacccaggaggtggaggctgcagtgagccaagatcacgccactgcactccagcctacgtaacagagcaagactccgtctcaaaaaaaaaaaaaaaagttcctatagtagtagtggcacacctgtgacccatttacaacagacgaatgtgggtgggaagccctattctatgctcgtccagcctactttacatataaagtattattgtaactccagatcatgacagggaaaatgctgagaaatgagttcattaaagagcttttaaaagcctaacagattataatgtcaaagggttccatgaaaagcaactattcagttgcttttactattcggttatgccatttccctattctatctctgacaactattattagtagttatcctttgggagctgttatgaaccaaaaactaaaaaggacgtctgtaactagttttgatagaggcaagaggcaaacaaatgtctaggcagacaggggcgggtcctcagtgaaacccgaactttaatccggaaactgtcctgggtaaatcctgagatcggattaagaacctgccttcccgtttggcatgattgatccccatccttcacctatttaacctgtacctaccctttcctaattggttttctacactgtcctgcccaccttggagtggtgtcttcgctttgaccttttttgcatactcacaaaccaatgaccacacactcccattctgaaccaataaagagccccaggctcagccatattacggaactttcctgtcttcaggtagtagaaccacctaccatgttctctctttttgctaagagctttcctttcgattaatagattctactccactcactctttgatgtccacgtgcctaattcttccgctcctgagataagaacctggacctagttgagctaaggagcaaaaatcctgcatcagtttcatggtcaaagagaacttaaaaggacatctgtgccatccttaacaacataccataaaaatccaaaatttaattttccccagaaatacataatgacataagatgcaatctactcaaatcttttcctcatttaaggcacagggtaaaaatacagtcaaaaacaccaatacattttaaatatcatttatcagaatgcagattatcaaagggcagcttttatccattgtaatctttcccctatccaaccctcagcacccccaccccgcccccagccacacactctcagatgacttcctgggctgcatgtggttcatggaatatgaacagtagctgaaattcagcctaagagggtaaaactgatagaaaattatacaattggaaagtgggaaggtcatgaagctatgagcacatctagctagccacttagcatctgtatttcatcaacagttaagctattctttacttgtcaccacataaatagaatatgattttaaaatacacacacacacccccttatggaaaatgatcctagaaaggtaatgctagtgtcatctttcaagttaaagtactgttgttttttttttcccagaaatccccagttttcaataaattaaagcgattatccaattttatagttattttattctgaaacatgtataagtacaatacactctttaaatgctctatagatgttaaactggttcaagtattccaaaattaattttaataaattcatgtatgaatttcatctcacacagaatcacttgaagttacttactattcggttatgccttaaatgcttagttacatattttatggataaaaggatatgacactattattttcaaatctggatgttcaggaggatcaaaaaatgaacccttgtgaatgagaagcatttactctaaaaaaaaaacctctcactgaccaattgaccatttatactattcctcttctatccatacagataataaagttaactttaaatagatttgtgagtaagagtcaagagaatttgaaagctgggtacagaagtctgtatgctttactgaagcaccagtttaatctgacactcactgtggccttgaatgagtcacctttcagggctgagttctctaatctgtaaaatgagagtgttatgttaaatgtttactgaggttgattattctatcagctacttgtaattcagctgcatcatttcagttagctataaataaaccccctaagaccctcagtgtgaatatgaacaactatcatttcatattatttcatatatcaagtattctcatttataattgggttgaggtttattaaaaaaaaaaaaaaaagctttttggcaaagggagggactgaaaacaaattcaccactgcatggtgccctgcttgagccaatctgactggagcttaagaaactccacccagttctggctaacatcaaaggagactcaacaccactctgccagaaaataagccctgtattatctaaccaggcactaagggaacacacagttttcaagcacagcactttgtatatctgatctttcattctgatgacatgcctgaagtgaaactattagtgagccgggttttttaaaataggtaaactaaggcaagaggcaactacatggcatgatgataaaatactctcttgactacaatctcactattaagagctaggtgctcataaacaggaaataaggatatatgatgaggccacagtactttgttgtatgctttactttggatagttcacaaactctggaattaattactgtactaaaaatattttacaggtctatacagattaaacagtgttaatatctaacttaattacacagaagttctgaagaaccttttaagctccatgaagtcctcctgaaaattttaggtcattcgcatctagagccactcactcggggtctgtgctcattctgtctgatgagaaattggcaatctggtttaccaatggcctgttgctgtctctgtcctcttctattcaccccttgaaaggtgctactatgggagctaaaatgcagggaaaaaactcatgaaaagctagaacagagcttgggcaaaatggcaaaaccccatctctacaaaaacatgtaaaaattagccaggcatggtggcacatgcctgtagtccctgctactcaggaggctgaggtgggaggactgattgagcccaggaggttgaggctgcagtgagccactattgcaccactgcactccggcgtgggcaacagagtgaaaccctgactcaaaaaaaaaaagcaagaacagaagcctgattcccaccatcatactcacttttcctaaccactgtgttaggaaaccttcattttactgtgtcacattagccaaatttctaccgacattcatttgcagtagccagcattctctttttaaaagtatagaatcctatttcttaatttaaaagtgggtaagaaaatgtacatccctggaaagaccattgttcatcccagagatggttctattgaagatgtctgagttcttggttctggtgtgaaaaaggaagaaaaatattatggcaacatgggaactttcagggaataaagcagatatagatatggtatcaaagtagggaaagggtatacaggcccaggagccctaggaggcaaaagaaagggagttaataccatgccaaagacaagcttgctatctttcaaaatatcgcctcctgtcagtttcagcagaaagaaataaactttcttctcagtgacctaggctactttgaggcaaatcattttgagttccaaacaacccatttaataaactttaaataattattactaaaggtaggatactgcttataatgctcacttatattttctctataactgatagcctgtcctttttgggtgggtgggggcgggggcggttatggacaagacaaggaaccataaagatatctgggttaatgttttcttttatacgtttgtttttgcatgacatttaaatgacagagaattctaaagccaacactaagctgctatcctaggacattagtgagaatgctgtggccaaaatatagtgctcattcctcaggcttgaaaggaaccccacgtcgccagtgtgggagatcatttataatcttgatggatacaggtatagcctgcttcataataatttaatattcaacatcagatttttttttagtatgcctagcaggtttttagttactaattaactttattacccagatttgtttcttactgaacttctttcagaggcctgttatacatcaagctgaactttgtctggcagctgtgctgtttttaatttatttaaccacaaaaccttgatttatactttcaagcaaaatgatattttacttaaaaataaatctttagcaaggatgtctacaggaatcaactaccaacttacacagttcacagacacatatgattcctcagacaaatctgaatttctcctgcttctcctccaaaccagacttgcagatagcaacagacaactgaggaagatcttgactatcctgagcaataaactacaacccccctgaagaatatattaactgtccacccctaggttcctccctacacagttcaaggacaacagctgtgctattacaaactgatggaatttccaggcttgacagggttctgttcgtaaccaccatttgtcctgttcatcataggattagcaacagcagagagcccttgattactagaatagctgaggccatcacacagctacattcctacatgaaagaacacactgatataggtttaaagaagttatattttactttcatgtagttaccagagtcccccccaccccccatttaagggagccctgttctctggatataaaaatactgtatacacttgcacacacatactcacatacataaaaccttgcatcacaaagttaaaaggctaccttgcttacttacaggaactatccaggcagcttgtgttcagtcctgactaaatgcattttggatcaggcacctgccttcaacatttctgtccaaatgaatttcaatctatttctccaggaagaacacaccagatacctcccactgttagccatgtgatacaggcagcatgatgtctgaagtctggttacggttatgtaggccaaaataagaaatgacaatgacacagcacttacatttctgatatcaccaaccttaagaatgaatcttccattttatctaaattttttaaatgagtaaaactttaaaagattcttaatacctaacccctcaaaattttgaaaaaggagcattttttttaaactttacatttatcccacttccttcctctaacacaggaaaacattcagagttaatctataccaatccaaaaattatttctaaccacattctaaaggcattttttttttttttgagacagggtcttggcctgttgcccaggctggagaatgcagtggcatgatctcagctcactacaacctccgcctcctgggttcaagtgattctcctaactcagcctcctgagtagctgcgattgcaggcatgcacaccaccatgcctggctaatttttgtatcttcagtagagacgaggtttcatcatgttggccagactggtctcaaactcctggcctcaagtgatccacccatcttggcctcccaaagtgctgggattacaggcatgagccaccatgcctggctctaaaggcttacaccagttgaactgatctaggatccaatcccctcactttaatagatggaaaaaaaaatgagaaatggaaaaaacaagtcacttacaaatgaggctgagacaaaggatcggcgaaaagagccacagaacaccaaaaacagaagcagagcgtgacaaaataagcaaaaccttacagttttgtagtttctgcttttatctaacacaatgacttcgctgtacttcatataccttttgaattatacctgcttatacatacctttacctacctactacttatacctacctatcttttcttctgcaaggagggaggcaggcaggaagaatcctgaacatcaggaaaacattccacctgatctttaaagggaccccaatgcctagatgtctttttcttttttctttttttttttttttgtaaatccaaactcttacgtgtaatatcaaggctgactgacaagactcagtcctatcacccaccataatcatcagcagctttccatgtagggtctccctacaatttagtcacatgggaccatctaccatcttacattatcactgtacaccctatgctcatttgctctccaaacttgaagttatcttctctccctcctcatttgtgaaagtcttgaaatcaaggtccacataaattgtcttaccaccttttctgtgactgctttttagaatctttctcccagtagtattcagaactaatacatcatctgtacttgtaacagtagagtctgatctatactgtagttcagtggtccccaaaccttttggcaccagggacaggtttcgtggaaaacaatttttccacagatagcaggaggggtgagagggaggagatggtttcgggatgaaactcttccacctccgatcatcagtcattagattctcacaggagcatgcaacctagatccatcgcatgtgcagttcacaatagggtttgcgctcctatgataatctaaaaccactgctgatctgacagaaggcagaactcaggcacacttatcgcaaagttaatgtaatgctgttcacctgctgctcacctcctgccgtgcagcccagttcctaactggccatggactggtaccaatctacagaccgagggttggggaccccccactgtagttagttgtatataccagctcctgtaaactgctgggtcccagaagagaggaccacatcaaagtgatgtgcacaccttctctgttcctagtagactacagaggagacaggccaaaatgataaaaaccaacaaaacaaggggctaaaaacacatttctaaaatgacacgatgaaagttattagaaattgaatctaatttgaaattaatcagaagttccaaaattacaaaaactcttcacaactagaaaaagaataaacagattcaaggctgaaaggttatcaccaattacaaatattcaccttggctaggtgtggtggctcatgcttgtaatcccagcactcagcactttgggaggctgaggtgggtggattatgaggtcaagagattgagaccatcctggccaacaaggtgaaacccctctctactaaaaatacaaaaattagccgggcgtggtggtgtgcacctgtagtcccagctactcgagaggctgaggcaggagaatcacttgaacctgggaggtggaggttgcagtgagccaagatcgtgtcactgcactccagcctgggtgacagagtgagactctgtctcaaaaaaataaaaataaaaaagaatattcacctattttcttccactttctaaacacagtttgtacaagagcaagcatgttgtctggaattatagaaagaaagccagtaaggagtaaccgtacgaaccagctctccatgctggtcatcttatcattattaggcatagcaataaaaatagctctctctgcttttagaaaagcatgacatgatgcaatgtggcaaaaacaaatattcaagatggtcgaccagttactggcctggcatggtgactcacacctgtaatcccagaactctgggaggccaaagcaggaagaccacttgagcccaggaattcaagactagcctgggcaagatggcaagacaccatctctacaaaaaaaaatgtttttaattagctgggcatggtggtgtgtgcctgtagtgccagcctctcaggaggctgaggcagtaggattccttgagcccaggagcttgaggatgcagtgagctatgattacaacactgtactccagtctgggcgagaaagtgagaccacatctctgagggacagagagagaaagagagaaagatatcagccactaccatcatgttaatatgatcatataaatattaaaactttataattattaaaatattaaatctctatagttatcagctcatatatctgtcagaaagtaataagcatatcatgtaactttaggatgacttagtgctgaggagattggaagaaaggaagaatattcatacttgatcagctcttagcttttgagaactattttattaaagaaaaaactctcttttggctgggcatggtggttcatgcctataatcccaacattctggaaggctgaggcaggaaaactgcttgagcccaagagtacaagaccagcctgggcaacacagttgagactgcgtctccacagaaaacattttaaaattagcctgcacacctgtggtcccagctcttgggaggctgaggtggacggatcacttcagcagaggaagttcaaggctgcagtgagccgtgatagcaccactgcactccagcctgggctacagagtgaggccctgtcttgaaaataatagataacaaaagaaaaacttctcccattaagcaaagtgaagtttcactctattttatatcagtgaaaataaagaaaagtggaaggtagaagaggacataggaatttgtgctgccaattctataatttttgttttgttttgttttttgtggggtttttgagacggagatttttgtatttttagtagagacagggtttcaccatgttagtcaggctggtcttgaactcctgacctcaagtgattcgcctgcctcagcctcccaaagtgttgggattacaggtgtgagccaccatgcccacccttgtaattgtttatttacaatgtgtgtcccacccagagttccccttaacgcttgagttcctcgatggctaggatagcatctttctcaccttttatcctggacatctaaatataataaacttgaaacctcacaggctctcattaaatgcacatttgtcctgctaggtgcgctctgctccataccataccagccttctcttgctggggttgatgtttgcacagctggaagcaccctcatagttcttctaagtattggttctaggcacgactaagggtagagtagctcagcttttctgagcaagaaggagaagatacaaactctatgggagtacttaacaagcattttgtagtcgtggcaaaggccttactttgacctaatatcttacagatgctttcaaaaaggagggggggaatatcattattaaatgaaaattgaacagcaaaagttgaagagatctttcaagttattagtaacataacttttaatattttacctgaaatacaagtaaaaatctgaattaaaagtattaaaaaaacaaaaaaaacacgctggatcagaattgttcagggacagggttaagcaatatgagtattatttgttgttgttgttttgttttttttagagacaagtcacactatgttgcccaggctggagtgcattggctagtcacaggtgtgctcattgtacactacagcttcaagctcctgggctcaagcgatcctccagcctcaacctcccaggtagctgagactagaagcatgtgctactgcaccaaaaatctcagtgttgttggttttcttgcagtaagggtaatcatgacacagagaaatctcattaaagttgagtccgagaggcacccacaattgagggtcactgaattaatcaacaatctacctaatccattcaagataaaattcactgaaatgaaatgcaacacaggattaatacaacttaacaatagaaagacatcacactcccccttgttaggaaggtgttttagaatcagtttactagatgtagaatctgaggcacggatttttgtacaagtgatttactaagggagtgcttttaggaaaaacctataaggttttattttattttaaggttttatgatattttaaaggtatcaactatccccaaactaatctatagtttttgtttgtttttgtttttttttttagacagagtctcactctgttgcccaggctggagtgcagtggcacatgatcttggctcactgcaacctccgcctcccaggttcaagcaattctcctgcctcagcctcctgaatagctgggaccacaggcgtgcgccaccacatccggctaatttttgtatttttagtagagacagggtttcaccatgttggccaggctgttctcaaactcctgaccttgtgatccacctgtcttggcctcctaaagtgttgggattacaggcgtgagacaccacgcccggcctaatctatagatttaacataaccccaagcaaagtccagtaggttttttcttttcaaatcaaactgaaaagttgatcctaagttttacatagtaatttaaaaagtcaagaacagctaagataatctttgagaacaaacttagaggaacttaaactactggatatcaaaacttactgatggattgaaccatgtgaaaatgctgaaaactgatgagtttctaacctatggcaatgtcatatgtttgaaactaaaaatacataaatatagtaatgaaaacattgtggtacctgcacaatcaccaagaaagaggccaatgtacttggtgtgctgaacatatggaaaaacaaaacaaaacaaaacaagaggccaatgcaaaaaaatggttttgaaacggaaccacatgcatatggatacttaatatctgacaaatgtgacactgcaaaatagtgggggaattaactgtcttttcaataagtggtgctgggtcaactggatattttgagctctacctcacagtatatacaaaaagtaattccaggtggatggcagccctaaatgtgaacggtaaacaataacatggcgaatattttcatgatcacagaggcagatgaagaaaacgaacagacaatggagagagtagagagacagggacaaaagaaggaaaaaagaaaagcaaaaagaagatgatgaggtgggaggatcatttgagcccaggaatttgaatacagcctcggcaaggtggcaagaagggagggagggaaattcccctcagcagtacttaccaacttacaagaaacagatgggcttatttctaattgtaacactaaatgattttttttaaaaaatgaagtgatgcctttaaaactgagaaaaactattttgaagctagatttttacagccaactcatccattaagtgaaggctaaaatgggaaattcaaacacacaatttaaaaaaaattattggctgggcgtggtggctcatgcctgtaatcccagcactttgcgaggctgaggcgagcggatcacaaggtcaagagatggagaccatcctagccaacatggtgaaaccccgtctctacgaaaaacacaacaaaattagctgtgcgtggtggcatgcgcctatagtcccagctactcagggggctgaggcagaagaatcacttgaacccgggaggcagaggttgcagtgagccaagattgcgccacggcactccagcctgggcaacagagtgacactccatctcaggggggaaaaaaaaaaatttattttccaggcattctttctgaaaatgaacttcagcacagactccaggaaatgaaaaatgaacacagcatcctattaaagctgcaatatccaaaaaatagtaccattagcctacaagagaaatgaaatgcaatcctaggatgacgataatgcactaggatctagaaacaactctgtccaaaattaacctttccatagtgtaatttaaaaagaccaatgacttagacatgtggtgcaaatggtatatgaaaaaaggtgcaattaaaaacaggggaggggagcagtttactgaaagagaactacacaagaaagtactaatccaaacataaggcaaactgaactatggcattattctgagataattatatattttaaggagacaaggcttagaattagaacactctcatcaaacttaccaacataagatggatccataaagaaggatattttgtatttacatacaaatgaacatgtacaatataatgtatcaagaaagaacaaaaaaggagaaaagagaaggaggcttcggaaagatggagatgactccaaaacagcagctgaaatcaactgaaagacttttgctgactctctgagtttactcttaagtgggcagaagtcaaagagaactttgcctgctcactggaatgtgtttctctattggtctctaagtctgcatgtgctgacctttaaaagacagtataaggtttgtctgttttcccttctgctagcaggctgctagactgaacatggtagacaatgactttccctctgaagttggctgtgttcaatattctattgtttttcttatacaagcactgggagatttttgcaattgatgtatttttaatcatttaaaactaagcaagccatgacaatataaaagacaaacttacaccacaaatgaaactactaacaaaaataacaaatatactcatctggggatggcaggggttggggggagaccctctcctaaacatagcaagcaccaaagggctgctttgacttgcaatactaaactccttccaagaaatttggaagtaaattcagagtaaccaaagatacaaaaagcaatatgcaacaggagaaagtatttgggtgtgaataaagaatcaaaaaatgggccaggtgcagtggctcacgccagtaatcccagcacttggggaggccgaggcaggtggatcatgaggtcaagagatcgagaccatccaggccaacatggtgaaatcctgtctctactaaaaatacaaaaattagctgggcgtggtggagcgtgcctgtagtcccagctactcgggaggctgaggcaggagaatcgcttgaacctgggaggcagaggttgcagtgagctgagatcacaccactgcactccagcctgggcaacagagtttgactctgtctttaaaaaaaataataaataaaaaaattttaaaaatgtacaaaatgaaagggaccgtggcaaagatggggattctgtttcttctccctgggtgctcagaaagacatttcctatttcccttggagttagaagttgagaccatgtgagtgggttctagacagtgcaatgtgagctgaagaattatgcttcactacaaagcacttgatgaaattctgcttgctggtgctctttgctatcaaccaactaaatacaaagaatccagcaggagactccaagacaccagatggaaggagttgaaattcctcaattacatgacagccacaggctaaacactcacactatgacgtgagcaagaaataaaccattattgtgttaagtcactgaaatgctagttatgttaaagagttagcatcaactatcctaattaatacagagatcttacatatctaacatcctcattttacaaataaggaaactgatgaacaatgagctttccaaaaattatactagttggtaggagaaacaggtctcctgactttctattcagggacttttacaaagtaaaagatttctgtgctacatttataagtaaaagttattatcacaatatttgttccaaaaccaaaaaaaggcagtgcaatcatttctttttctttttttttttgaagcagggtctcactctggtgtccaggctcgagtgcagtggcatgaccatgacttactgcagcctcgacctcccagtcacctctgtttgcaaaaagaaaagaattctccacgaagttctttttcagtctaccattttatgatttgactctcttcatgtcgacaaaatttcttgagtatctattagaactgtataagattgtggatatctgaacatttatttactgacaaaatgtgatttcatatggcttgacttaatagtaaatgacaagcactgcatttttagaaagcgctaattttattaggtatacatacctacacacttttttttttttttttttgagacagagtctctgtcatgcaggctagagtgcaatggtgcgatctcggctcactgccacctctgcctcctgggttcaagtaattctcatgcctcagcctcccaagtagcgggcagtacaggcgtgcatcaccatgcccagctaatttttgtattattagtagagacgggttttcaccacaccgggcaggctgatctccaactcctgacctcaggtgatctgcacacctcagcctcccaaagtgctgagattacaggcatgagccaccatgacatctttttacaagaagaaataatatgctgacttggccaggtgtggtggctcacacctataatcccagcactttgggcggtcaaggcgggcagctcacctgaggtcaggagttcaagaccagcctggccgacgtggtaaaaaccctgtctctactaaaaatacaaaaattagccaggcgtggtggtgcacacccataatcccagctactcaggaggctgaggcaggagaattacttgaacctggaaggcggaggttgcagtgagccgagatcgtaccactgcactccagcctgggctacaagtgcgaaactctgcctcaaaaataataataataataataataataataataataacaataataataatatgctgacttagaggctcctggactattgtcattagaactataaagcaaagtctatacatctgaagagaaatttcttttaaatatactcttctcctgtgtccttactgctttgtattaccttacaaagaaactactacatatacaatttcagctaatgaacataaaggatcaaaattagtgactattaggccaaatgttttggccaaaattgttgcaattaccatgtaaacataaatcctgcttgcctattattccatcagtttatacttccacttaatcaaggatttaagattgagtttgccttgtcaggctcacagaggcttaaattacttgtaaataaacattcccacaagagactacatcataaacgctcatatttattacatcccactcaaatacaacagtttctcttttaaaaattggcaatctatacaaaacagcaatttagattggccttcaggacagagaggtatgattcttagtaaatcacattacatcaagatgctttattctgaagatgtaagaaacgaatatatttttacaaaaacactatatgtcaagtgaatatatggttagagtgtaagaaaaacttatttcccttgtctttaagatttttctagaagaatcttaatcttcctataaaaccacctgtctgataaaaggaagtctgaaatcttatctccaaataaatcttatctcaaattaataaaagactaaatttcagaagtttctcagatttcatttttgctgttacagtaattaagttatgccattatcttatgcagttgattttaagtgatgaacacccacctacatcattatttccatatagaaccaccaacaattaattagttcaaactaaaaataatgaaataaagtattaaaatgttctccataactaagaaaatactgtcactgtcagctttactatttctacccatcaccacgactaccccccaaaaaccctacatatcaatacagctttcatcaaattagaatcaatttgcttgaaaaaacagaaacatatgcatcacccattactatgtacacatctgccagataatgattagaggcggcaagtatgccaagagtccaaaaagcaggtgagaatcttctgtagcctagaaaaaagtgtatctagagaaaacataatagtctcctctattcccaaagcacttaagactagtaagacttcctgaagtctccaactcataaatggtcattgtttcacagctcaagtaaatacatgtatgaacatgtaaaataaaaaagagtaagggagaaccttaaattctccagtttactctcaaattttaaaactcagaaaagagagatccaaagtggtttccctttgccaaaagccatctagaaaactagagacaaagctacaattaggacaaacatctcccaactcccaccaagcccagagttccctccccaaaatgaatactcactgaacccacaagagaagcaccagttcagagtgcaaacctaggtcaaacaggccccttggtgcagtggcccatatagtgttttgaaaaatggccaatatctccaaaatcagtaatctttgaatgaaaatacagttttacagcttttttaaaaaacagggccaggcgcgttggctcagtcctgtaatcccagaactttaggaggctgaaatgggaggatcccttaagcccaggggctcgagaccagcctgggcagcacagtgaaactccgtgtctacaaaaaataaaaaaaattagccgagcatgcacctgtggttccagctactcaggagactaaaatgggaggatcgtttgagcccgggaggtcaaggctgcagtgagccatgattgcggaactgcacctcagccttgggtgatagtgtaagaccctgtctcaaaaaaataaaaaatccgaagatcaggccatgactatgtatttccacttagcaacaatatactggagctgagaaataactgcctctgtagatacccattcacacaatatctgcagcataagttcttaatcaagaccaacttcactcactttaacttcaagaacgttgcaggggccaggcactgtggctcacgcctgtaatcccagtactttgggaggccaaggtgggcagatcacctgaggccaggagtttgagatcagcctggccaacatagtgaaacctcatctctactaaaaacacaaaaattagccaggtgtggtagcacacgcctatagtcccaactacttgggaggctgacgcaggagaatcactcaaacccaggaggcggaggttgtagcgagccaaaatcgcaccactgtactctagcatgggcaacaaagcaagacaccatctctggggggggagggaaatttgcaggagtttaagtacgacacagctgcactaaagctatttaaatcaacatcaactctaaacatttcttattggtagtagaattttggctgggttttagtggcttggtttaactaaatcacaaagtcagtagacaggaaaggtgtgagagggagagaaatggaaaacaaaagtaccacaaaatggctgggcacggtggctcacacctgtaatcccagcactttgggagggtgaggcaggtggatcacaaggtcaggagttccagaccagcctggccaagatggtgaaaccccgtctctactaaaaatacgaaaattagctgggcatggtggccggcgcctgtagtcccaattactcaggaggctgaggcagagaactgcttgaacccaggaggcggaggtggcagtgagccaagattgcgccactgcactccagcctaggcaacagagtgagactccttctcaaaaaaaaaaaaaggtaccacaaaactagtggtaattcctttagaacataatcagaacttcattcacacatccaaaatgtcttacttctggtcaggcaccgtggcaaaggtctgtaatcccagcatactgggaggccgaggcgggcagatcgcttgagcccaggagttcaagaccagcctgggcaacatggtgaacccctgcctcgataaaaaatacaaaaaaggttagctggttgtggtggcacacacctgtagtcccagctacttgggaggctgaggtgtgaggatcactggagtctgggaagttgaggatgagtgagtcgaaattgtgccactgcactccagcctgggcaacagagtgagactctgtctcaaaattaaataagccaggtggggtggctcacacctgtaatcccagcactttgtgaggccaaagcgggcagatcacttgaggtcaggagttcaagaccagcctggccgacatggtaaaaccctgtctctactaaaaatacaaaaattagccaggcgtggtggtgcacacccataatcccagctactcgggaggctggcatgagaatgcttaaaacccaggaggcggaggctgcagtgagccgagatggcgccactgaactccagcatgggtgacagagcgagactctgtctctaaataaataaataagtaaatgcatatttttttaagtcttacttccctaggaagcaataatcactaactcctttttcagttttgtcaatgacctgaaaagcttggtcctgacacctctgctttatggaaaaggcaagaatgcatactgattcctaaggtagtaatctgaacggtttaaaattccatacatgtagctacagacaactagtataatggcagagatcttacatgatattttaagatctagttccagtagtaataaaatcgtagtaaaaagaggtaggtcgggcacggtggcttacgcctgtaatcccagcactttgggaggccgaggtgggaggatcacgaggtcaggggatcaaggccattctggctaacacggtgaaaccccgtctctattaaaatacaaaaaattagctgggcgtggtggcatgcacctgtagtcccagctactcaggaggctgaggtagggaaatcgcttgaacccaggaggcagaggttgcagtgagccgagatccctactgcacagagcaactgagcaagattccatctcaaaaaaaaaaatatatatatataatatatgtattatatattcatatgtaatattatgtattatatattacatattcacatgtaatatatattatatattttatatatatggcatttctggccaggtgtggtggctcacgtctgtaatcccaccactttgaaaggctgaggtgggaggatcatctaaggctaagaatttgatttcagtcttggcaacacagtgagaccctgtctcaattagaaaataaaaaaaaatttaaacacagcatttccagtcctttcaaactcagatgaagtttaattaaaatcttcaggggacaccccagtaaagcaacagcatacctcacacccagatgctggtttctaataccattctctgataaagaaaccaagactctttggagaaatgactaattctaggactgagaacaaaatattcaagatgagcctgaagtaccttgtatttccagaaagttaggaagtgctaaaaataaaaataaaaaaaaaaaaacaacgataggggtaagttggccggacgaggtggctcaggcctgtaatgccagcactttgggaggccaaggcaggcagatcacctgaagtcaggagttcaagaccagcctgaccaacatgattaaaacccgtctctataaaaaacccaaatattaaccaggcatgatggtgggtgcctgtaatcccagctactcgggaggctgagacaggagaattgcttgaacccaggaagtgtaggtagcactgagccgagattgtaccactgcactccagcctgggcgacagagtaagactccatctcaaaaaaaaaaaaaaaaaaaaaaaaaagataggggtaactcaattacacaggagtcaactaaaaaagttcccaatgaccaaagctggaacaatataaacaatagactgaataaataaatgagagagaataagcaagtcttcagtgaagaattccaaacaagatactccacttccaagaggtagaacataacccttcatcctttacatgtgcatagcacatagtgacctccttctaaagagtacaatatgaaaatgggaggggggggtaagagaaatatgacaaatactacctaagccaagtgatcaagactaatatcaatagtgataaatcagctgggtgcaatggcttacatctgtaatcccagcactttggcaggccaaggcaggaggttcacttgaggccaggagttctgacaccaacttaggcaagcaacatggcgaaaccccatctctatgaaaaatacaaaaattaggctgggtgcggtggctcacacctgtaatcccagcactttgggaagccaaagtagggggatctcaaggtcaggagattgagatcatcctggctaacatggtgaaaccctgtctctactaaaaatacaaaaagttagctgggtgtggtggcacatgcctgtagtcccacctacttgggaggccgaggcaggagaatcacttgaacccaggagacggaagttacagtgagccaaggtcgcgccactgcactccagcctgggcgacagagcaagactccatctcaaaaaaaaacaaaaaaacaaaaaaattagccaggcatggtggtacgtgcctgtagtcccaactacccgggaggctgaggtgggaggatcacttgggccctggaggccagggttgcggtaagccacgatcgtgccactgcaacccagcctgggcaacagagcaagactctttctcaaaaaaaaattagctgggcttggtggcatgtgcctatggtcccagctatttgggaagctgagttgagaggaagcttgagtcgagtccaggaggttccagtgaactgtgatcacagcactgtactccagcttgagtgataaagcaaaacacacacatacacacacacatacacacacacacacacacagacataaatcatgctgacatgatttgatagtatgcacccttgatataatgtgataagagtggcactttacctctgtgatcttccttctaaaaagcataacctctgtctaatcatgagaaaaagatcagacaactcccaactgaaggacactctacaaaatatcagaccagtactcctcaaaactgtcaaagtcatcaaaaacaagggaggtgtaagaaactgtcatagccaagagaaagctaagtatgataactaaacataatgtggtatcctagatgagatcctagaacagaaaaaggtatttaggtaaaaattaaggaaatctaaataaactatgaactttagttaataataatgtatgaaaattgaggtcaggagttcgcgagcggcctggccaacatggtgaaactgcatttctactaaaaaaaaataataaaaaaattagatgggcatggtggtgtgcgcctgtaatcccagctactagggagactcaggcaggagaattacttgaatctcggaggcggaggttgcagttagcccaagatcgcaccactacactccagcctgggcaagagagcaagactccgtctcaaaaaaaaaaaaattagccaggtgtggtggcaggcacctgtaatcccagctactcaggaggctgaggcaggagaatcgcttgaacccaggagacagaggttgcagtgagctgagattgtggcactgcactccagcctgggtgacagagaaagactccttctcaaaaacaaacaaaaacaaaaaattctagtaataaccattatttacttccaacttaaatctgatccacgacctaaaactgcactctgaaataatctacaattcccctgagaaacttaataaatatagacaaaagtgtgtatatcaattaacttacaagtctctaatcactgcaaactagctgactctcgttaaagcttcaaatcttaaagttctaccactggtactcttagaagctaacttacccttgttgatcacagagagacaacagtgaccaagtctaataaaagcttattcatgtacacagaaacaaaacaaagtaacttggtgatgtgcacatctaatatttccaaccaaatcacaaaactttagaaagggcatttgaatccaacctccttattttaaaagtgagaaaagtccaaggagattaacaaatatatttgttcaaagtcatccctgagttctcaactaaaagtagaatttcttttctgtcctatatcccaaatcaggaagcaaggggaaaaggtaggaggtattatcattctgatcatcatttcctctgctaacttagaatgctttcgtttctcagggataaagaaggtaagtccagctatatctatgtattggaaatagcatcacatagctctcctttttaaaatggcatgccctcctcatgtggatttttatcttctatttaactatcagttatcgcactatgcttctacagttagtatctatgatgtgaaagttgaagccctggttaaagcttcttaaatctaccattttattttgtacaaacagaaaagtatattagttttctttccagctgtccttaatttttttaattgaagtgaagtttacataacatacaattaaccattttaaagtacattatgatttctctccagtttcaaactgtccttaagaatttttttatttttatttttaatttttttgaaacgggagtctcgctctgtcacccaggcttgagtgcagtggtaggatctcagctcactgcaacctccgcctccgaggttcaagtgattctcctgcctcagcctccagagtagctgggattataggtgcacgccaccacagccagctagtttttgtatttttagtaaagacggattttttcactatgttggccaggctggtttcgaactcctgatcctaggtgatctgcccgcctcaacctcccaaagtgctgggattacaggtgtaagccaccgtgtccagccaagaatttttaattaaagatgcactaatccaaatgtagatgagctactcaattttcagttaattaatcacatctgaagataatgatggcctatgccctcatatcaagtgtatcctgagcccttttatcattctaatctctttctacacgtggccaaccagagtgcatacatattgtgccaagtacctttcacctttttctacatatcagtagtattctatttcacagaaaactcacactcctgccctaaacataaccacagagttaggcttattgtgtggttagcctatctggcatgcctttgtctcacaaatgcttagaggacatttcacactacttagaaaggaatgatctcatcccactgacccaacagctaattttatcaaaaagctttttgttaaaagctgtgataacccaggaaaccagatctatttttacttttatggcaaggaaaaggaacagagaaaaccataaggaaaaaacagctcacacattgaccatttaaaaaaatcacttaggggcccagcacagtggctcatacctgtaatcccagcactttgggagcccaagacaggtgaattacttgaggtcaggagttcgagaccagcctggccaacatagtgaaaccccgtctctactaaaaatacaaaaaaagagctaagcattgtggcacacacctgtaatcccagctacttgggagtatgaggcatgagaatcgcttgaacctggagggggaggttgcagtgagctgagatcatgccaccacactccaccctgggcgacagagagagactctgtatccaaaaaataaaaaattttttttcacttaggccaggtgcagtggctcacacctgtaatcccagcactttgtgaggctgaggtgggaggattgcttgagtccaggagttcaagaccagcctaggcaacatactgagaccttgtctctacaaaatatacaaaaattagccaggcatggtggcacatgcctgtaatcccagctccttgggaggctgaggtgaaagatttgcttgagaccaggaggttgagtctacagtgagctgtgactgcaccactgcactccagcctgggagacagagagtgagacactgtcaaaaaaaataacttattctacagttttccccctttctttggtgtctgactacaagtgaacaaaaagaaaaactttcagaattgtttaatgcaagaaaaaaatcattattttaacaattaaaaagcaaacttcatattacagtccaaacactaaacctaccttgggtctgatttgtatgaaaaaaaaaaaaaaaaaaggatttctctccaataagaccccaagaaatatacaagtcttcagtgggagatgcaatataataaaatgacaaaatattaaaattgaagaagaaaaaggaaaaaaaaaaaagaaactccaacccatataaaaaaataagaactagaccagatgcagtggctgacacctgcaatcccagcactttgggaggccgatgagggaggactgcttcagcacaggtgttccagatcagcctgggaaacatagggagatcccgtctcaacaaaaaatttaaaaattagccaggcatggtggtatgtgcctgtggtcccagctactcaggaggctgaggtgggaggattgctggaacccaggaggttgaggctgcagtgagtcgtgatggcaccactgcactcactcaacagagtgagatcctgtctcaatagactaaaaataaaaataagaagagccagctgggcattgtggctcacacttgtaatcccagcactttgggaggccaaggcaggaggagcacatgaggtcaggagttcgagatcagcctggccaacatgatgaaaccccgcctctactaaaattacaaaaattagccaggtgtggtggcacacacctgtaatcccagctactcgggaggctgaggcatgagaattgcttgaacctgggtggtggaggttgcagtgagccgagatcccaccactgcattccagcctgggcgacagagcgagactccatccccccctctcaaaaaaaaacagcagttattgcagacttatattccagagaccattctaatcactttacataaattactttgcttaatatgttgaacaactctaggacatagataaccccatttaaaatgaggacaccagggcacttagaggttaaataacttgcctaagattgctcagctagtaaagtggcacaactcttaatttactaccaaatattgtctctcacagcaatctttatagcaagctctatgcaaagcaaaatgatcattcaacagactgaaaagtcaaaggctatgataatagcctttaacaattgaacactagtttaattgtttataacgctacctcccaccttttccacccacagccacccaatcccatccaggctgggtaaccagttagctcccttcaccaacaccactaccgacctgaccctcaaatgtaacacgtgaaactgccacacattaagcattcatctcctattaactttatgcctcctgttttttaattcttaaaaacagttgttattcatcatttatcatatttctgtgtactcaaagtacatgaatgtgccttctgtcttcgtaggtccaagggggcgccttcttgatatcgtcatgtatagagctatggccaaatgctgtgacatagggtatgcccctccagactcttgacgaggctgttctttctatgtaaacagtaccagtctctgagctaaaacacttaagaaacacaaaatagatcaagagcactgtttagagtgaatctccctaagtttatatgtatcaatcagtatgcatatgaaaaccaaatgagtgaaggcggctgatgtaaacaaaagagcctgcaacaggcaaacataagcaatgaaagctaatatagtatcttctggtgtgtagaccagctgtctgactttctaatggtgaatgttagcctacagtaagataaaacaaaagatgactataaggctgagagataaagactaaaatgaggttactggcttacagcctgaaaagtattctgaagccaaaaatcagatacagaatttggacccctatgaaatgcataaggctctccccaaatctcaactacacctccctaccctgtcattgattcttagtgggtcagaatacattcagtaagaatactagcatcaacatgaaataaaatctaaaaaggaaataaactctagtaaataaagttctgaggaaagtaaaaaagggtccctccaagaataggaaaagctgtcacaagaggtacagaacctccctttagctcttcatgtgctggattgatcctatatactcaaaagctgcatcagaatgagtaacatatgaataagagtggataagaatactaaatcaaaaatgatttatatcaattattgtccatcttcaatactaaaataattctttcacgcttaataattaaaatgctattcttcttctccaccttttcactttatttatttatgagacagggtctcattctgttactcaggctggcgtgcagtgacacaatcttggcttactgcagcctcgatctcctgaggctcaggtgatcctcccacctcagcctcccaagtagctggaactccaagcacatgccaccatgcctggctaatttttgtattttttgtagagacagggcttctccatgttgcccaggctggtctcaaactcctgggcccaagcgatcctgtcaccttggcctcccaaagtgctaggattacaggtgtgaaccacagcacccagcttcaatattttcagtacctacccctcaacctacctccatccctatgaaagtcgccatgacttcaggagcactctatatgatatgtacttctagtacacagttaatgtatgacatgtgcttctactataccactttattatttatgtgcctattaccctctataaactgtgagctcaagagtgaggattttcggccaggcacagtggctcacgcctgtaatcccagcactttgggaggccaaggtgggtggatcacctgaggtcaggagtttgaaaccagcctggccaacatggcaaaatgccatctctactaaatatacaaaaattagccaagcattggtggcaggcgtctataatcccagctactcaggaggctgaggcaagagaatcgcttcaacccagcaggtggagtttgcagtgagccgagatcacgccattgcattccagcctgggcatcagagcaagactccatctccaaaaaaagaaaaaaaaaaaaaaaaaagagtgaggattttcggaatatttggatgctcacccagcacctatcccagttccaggagcatggcagatgcaaaagaacgtatgaaagagtgaaggaaagaaaaatatgtgtttttctaattctcaagtcttcatttttttctttttatcaccatccatggcaaaaaaaaatttatattatgatccatattcacatacacatatataaatgaaacagaagttttataaatcaatactcatccatactatgtacaatgcactgaaactttttttttttttttttttgagatggagtcccactctgttgcccaggctggagtgcagtggcacgatcttggctcactgcaagctctgccttccaggttcatgccattctcccgcctcagcctcccaagcagcggggactacaggcgcctgccaccacgcccagctaattttttgtatttttagcagggacggggtttcaccgtgttagccaggatggtcttgagctcctgacctcgtgatccgcccgcctcggcctcccagagtgctgggattacaggcgtgagccactgtgcccggcctactgaaatcttctattccattatcttctagtgttgttttgcttttaagagttggctgtaggccaagggcgatggctcatgcctgtaatcccagcattttgggaggctgaggtaggcagatcacacgagcccaggagttcaagatcagcctgggcaacatggtgagatccagtctctacaaaaaatacaaaaattagccaggcatggtgatgcacgcctatagtcccacctatttgggagggctaagataggagaattacctaagcctggggaggtaaaggctgcagtgagccgagatcataccactgcactccagcctgggagacagagggaaactctgtctcaaaaaaaacaaacaaacaaaaacagcaacagaaaaaatagttggcagtgagtcataatttgaaaaatttcagtcctggtaaaaaccaatctcttaacagaaagaggtactattaaaactggttttcagttttccagtgctgacgatcccctcacgagaacaggcctctcacaaagaatctccctccctctccagaaaaaaagagcaagcacaagaagtgcctggtgcagagccccaattcttacttcctgaacgtgaaatgcccaggatgctataaaatcaccatggtcgtcagtcatgcacaatagtagttgtgtgtctggctgctctgctgtcctctgccagcctacaggaaggctctccttcagatagagacagcactgaaagaaccctgaatcaagatgagtgggaaactatatcaataaacacatatggatgccaaaaataaataaaagtagttttcaaactttaacgtggacatcccatggaaaggtggtttaaaagagattatgaagttctattcccagaatttgatttagtaaatctgggtaggagtccagaaatctgtattttaaagcagtccaaatggttctgatgcagatgataaaacaatccttatcagaaacatgcttacataatttaagatttaatctcaaaagtcatagcttgaactcttcttgcactaagttaaaggttaaacaaagtatctgcaagaggattctgtcctgctaacagactggtttttaatctgaacattgtttggctcaacagtcctttcatagacttcctctaaagcaacttggtaagccactaaaatctaactgttcctcttaactacagccctttgcaccaagaaaacagaagaatgatataaatgaaaggcatttctgttgcccagtcattggctctataactgaaagggcttttgaaaaccagtcacattgactatacaagtgacatatgcagtcatcagtttggaatctctaaggactacagctcaaaaacaatcactaacagctcaaagtctgaccccaaagtgcttaaaagccattgatgaaataaagccttcataagaacattctacaatccacgcttctactccttgctattacaagccaataggatcttaaggttttaaatttgacaaaatcatattatttatttttatttttttatttttttttgagacggcatcttgctctgtcccccaggctagagttcagtggcgtgatctcggctcactgcaagctccgcctcctgggttcaggccattctcctgcctcagcctcccgagtagctgagactacaggcgcctgcagccatgcccaactaatttttttttattgttagtagagatggggtttcaccatgttagccaggacggtctcgatctcctgaccttgtgatccgcccgcctcggcctcccaaagtgctgggattacaggcgtgagccaccgcgcccagcctatttatttattttgtaagacagagtctcactgtcacccagctggagtgcagtgccgcaacctcggctcactgcagcctctgcctcccaggttcaagcaattctcctgcctcagcctcctgagtagctgggactataggcatgcgccaccacacccagctaatttttgtatttttagtagagacggggtttcaccaattggtcaggctggtcttgaactgctgaccttatgatctgcccgcctcagcctcccaaagtgctgggattaaaggcgtgcgtgcgccaccacatccagccaatttttgtatttttgatagagacggggttttgccgttgttagccaggctggtcttgaacccctgacctcaggtatctgcaagccttggcctcccaaagtgctgggattacaggtataagccaccatgcccagccaataaaattgtattttaaatgcaccaagtacctgcgtcaacaatccaaaaatgatattaagaaaacaattctgcttaaaatagcataaaaaaatacttaaaagaagtgaacaatttatttatttattttgagatggagttttgctcctgctgcccaggctggagtgcagtggcacaatcttggctcactgcaacctccgcctcccgggttcaagcgattctcctgcctcagcctcctgagtaacagagattacaggcacatgccaccatgcccggctaatttttgtatttttagtagaaatggggtttcataatgttggtcaggctagtctcaaactcctgacctcaggtaatccacctgccttggcctcccaaagtgctgagataacaggcataagccaccgtgcccggctgaagtgaacaatttatactctgaaaaattaaaaaaaaaaaattcctgaaagaaattaaggaagatttaaataaatggaaagacatttaagttcatggatcagaagatttaacattgctaagatggcaatgcttcccaaactgatctacagattcaggcacagtggctcactcctgtaatcccaacactttggtaggccaaactgggcattattacttgagcccaggagttcaagaccagcctgggcaacatggcaaaaccccatctcagtctgggtgatgcggtgcgaccctgtgtccaaaaaaatacatgaaaatcacaccaagcttctttgtagaaattgacaatcaatcctaaaattcatatggaaattcaagggacccagaatagctaaaacaaccctgaaataaaaacaaggttgacggacacatactttccactttcataacatactacagaaagctataatagtcaagacaatgtggtactagtataagcacagacaaagtcctgggagggtagcacacccgaattccaccaggagagatgctcctgctctcaggacctttccagaccttgtcttatatatctcttcagctggctatttatgtgtatcctttaaaatatcctttgtaataaactggtaaacatgtgttttcgagttgtgcgagctgctctagcaagttaagcccatggctataaatgggaacaccaatttatagccagtcagtcagaagcacaggtaaaataagcgggagcttacaactggcatgtgaagtgtggggagaggcagtcttggaaactgagccctcaacctgtggaatcttgatgctatctccaggttgattatgtcagaattgagtggctgtcagctgcagaaatgactgcttgcttgcctgctggtggggagaaatccccacacatctgctttcagtagggtgctataagaatatcagcagtaggagaaacggagtttgttttttccacacacacctgtatctaaaataccaaaaactctggcaacttaataataaaaaggcaaattaatttaaaaatgaacaaagaatctgtacatttctccaaagataatatacaaatggccaataaacacattagtcaccagaaaaatgaaagtcaaaaccacaatgagatcctacacccagtagcatgactaaaataaaaaaaaacaggtaatgaatggcaagtgttttagatgtggcaagaactggaaccctcatatactgctaatgagaacataaaatggtgcagccaccttgaaaaagtctgggagctcctcaaaagattaaacagagttaccatatgaaagcagaaataacccaaatgttcctcaacaaataaatgataaataaaatgaggtacatacatacaatggaatattattcagccataaaagggaataaagtcctaatacatgctacaagatgggtgaaccctgaaaacatcacaaaagaccacctactatattaatctgtgtatataaaatatccagagtaggtaaatttatacagaaagtagattcatggttgcctggggcttggggtttattgtattagggagtgataaagaacatgggatttcttttgggggtcatgaaaatgttctagactttactgcactaatggtgcacatgtctgtgaatataccaaaaaacaatgaattgtacattttatttatttatttattttttgtgatggagtcttgctctgtcacccaggctggagtacaatggcatgatcttggctcactgcaacctccgcctcctgagttcaagcgattcttgtgcctcagcctcccaagtagccgggattacaggcacgtgtcgccatgcccggctaatttttgtatgtttagtagagacggggttttgccatgttggtcaggctggtctcgaactcctggcctcaagtgatctacctgcctcggccttccaaagtgctgtgattacaggcatgagccactgtgcctggcctgaattctacactttaagtgggtgaatggtatggtatataaaatatatctcaacaaaactgttaccaaaaagagagataacaccaaacacatgaaacttccttcctatgagattattcttaatactagctttaaggatatttcctttttgcattacttttagaatattttctacaaatattattttcagtcagtccaagttttttaaaagcaaaacttgtcaaaggaaacatactttgttagagatgcatatacaaactctgcaaagaaaaggctagttagggggtacccctaaaaactaagaagaaaaattaaactttccacagtttacaaacaggcagctttcattttacacaatagtgcaaaaccgtaaaagtaagaatgcacgctgaaaccatgcaaagtgatcataataattaatgagaaaaactgcaattgctctgtaatctttttttttttaaaattgagacggagtctcgctctgtgtccagtctagggtgcagtggcgcgaccttggctcactgcaatctccacttcctggggtcaagcgattctcctgcctcagcctcctgagtagctgggactacaggcacgtgccaccacacccagctaatgtttgtatttttagtagagatggggtttcaccatgttggccaggatggtctcgatctcctgacctcgtgatctgcccacctaagcctcccaaagtgctgggagtacaggcgtgagccactgcacccagccgctctgtaatttttttttgtttttgttttttgagacagtctcactctgttgcccaggctggagtgcagtggcgcaatctcggttcactgtaagctccacctcccaggttcatgccattctcctgcctcagcctcccgagtagctgggactacaggcacccgccaccacgcccggctaatttttttgtatttttagtagagacggggtttcaccatgttagccaggatggtctcgatctcctgacctcgtgatccacccgcatcagcctcccaaagtgctgggattacaggcgtaagccacagtgcccggccgccactctgtaatttttaaaaaattttgggccaggcacagtggctcatgcctgtaatcccagcactgggaggccgaggtgggcagatcacttgaggtcaggagttcgagaccaccctggccaacatggcgaaacctcatgtctactaaaaatacaaaaattagccaggggtagtggcacacgcctgtaatcccagctacttgggaggctgaggcaggagaattgtttgaacctaggacgggttcactacagaggttgcgtgagctgagactgcaccactgtactccagcctaagtgacacagtgagactccatctcaaaaaataatttaaaaaataaaataaatattacccaggggtggtggtgagcacctgtaatcccagctactcgggaggctgaggcaggagaattgcttgaatccaggaggtagaggttgcagtgagccgagatcacactactgcactccagcctgggcaacagagcaagatcctatctcaaaaaaaagaattttttttttgttgaggccaggcacagtgtctcacacctgagatcccagcactttgggaagctgaggcaggcaaatcacctgaggtcaggagttcaagaccagcctggacaacatggtgaaaacccatctctactaaaaatacaaaaaattagtcaggcatggtggtgcatgcctataatcccagctgctagggagcctgaggcaggagaatcgcttgaacccaggaggcggaggttgcagtgagccgagatcgcaccactgtgttccagcctgggtgacaagagtgagactcagtctcaaaaaaaaaaaaaaaaaaaatttcattgaaacattaaaaactctgtcagttataattataggaaaattgaaagaacaggaaaactaatcattaatgcactaaagcaggaggtgagcgaagggcaggcgagcatctctgcctcctgtcacatcagtcgtggcattagattctcataagagcacaaaccctactgtgaactgtgcatgcgagggctctagactgtgcactctttatgagaatccaatgcctgatgatcttctgaggtggaagagttttatcccgaaaacatcccctcccccagcgtccccttccatggaaaaactgtcttccactaaatcagtgctaaaaaggttgaggaccactgcactagagaacatagaaatattgaaaattataatgtttaagttctttgaaaaaatttattaggggtagtttaaatagtgcttacattcttctcatcatacaatagagacggggtttcaccctgttagccaggatggtctcgatctcctgaccttgtgatccgcctgcctcggcctcccaaagtgctgggattacaggcgtaagccaccgcgcccggctgcaatagacatcttttctatgccttagccaattgtcacactcctgtctgagtctggaatagcatcaaatactttatgtttcatatttcaatatcacagaataccttcgagagttctttcactacaaaatttcttgcatcacttcttttttttttttttttttttaccaaaccactttcttcacttatgtagataagctcaccttcactaagttatttcggctacatatccagagtgttttgaatgagagcatcagcattccctcagtgatctatttcttctataactccatttgagttcaatttgaatttcacttccactgttgttactttttggttttttcctgaactttcatctttttcggccaattctctctatcggttatcgatttttcttaactatcacatagatttatcactgggagacaaggaggtaacacaaacccatgctttgcacagttgttacttatgtagtgacagaagagctggcagcgaattttgtactttatacgattattcacagttaatatgctgtgtaaaatttaaaccatgttattagggaattggtattatttaaccaaaccatggtaagtgaaagtgtatatgagaaccacataaagcaacaactccctgtatatcacatcacaaaatcacagaacttaaaagccttcttcacagtaatctagccacagtgtgtatgtggacccttgatgtagtattaatgacccgtctacttcctgcctgaccatttcaagtgatgcccacattacttcacagggtggctctttcattgttgaacacttctaacagttagaaaaataaagcccccagctagtataatggtcaaaagcacaggttctaaaatcagaccacctgaattcctatcctttcttttcctctgttgagctaggtaaatttgggcaaggtatgtaatctctccatgactgtttactcatctataaaataaaaatgttagccgggcgcggtggctcacgcctgtaatcccagcactttgggaggctgaggcgggtggatcacgaggtcaggagatcgagaccatcctggttaacacggttaaaccccgtctctactaaaaatacaaaaaatgagccgggcgtggtggcaggcgcctgtagtcccagctactcgggaggctgaggcaggagaatggcgtgaacccaggaggcggagcttgcagtaagccgagaccacaccactgcactccagcctgggcaacagagtgagactccgtctcaaaaataaataaataaataaataaataaataaataaataaaaatgttaaggccttcaatcatgaagttgttatgagggatggcaagtgttcagtaaattataacctatataatttatcatattatcatcatcgtctgtagagtgcttagtcttccttatccatccccatgtactttggttcaaacccctcacctagattctgcactagactcaactgaacactgacagtctctcacccagttctccatatggtcaccagaattatctctctaaaaataaaatctgactccggtcagcataaacaatttagcctaaagccatcaggtagggtagagcaagcagagcaaaatcagagtcttcgtttaggggtggggaggaagccatggtggctgaaagcagggtatcaaataccaagcaaagtggggagggaattcatgtggtaaggtggcctggcccaacataacttataaggagtcaaaagacggctactattttaaaaagatgacatgaaacctacaaattgaggaaacacaatagtccaagagggaaagaaaacccaacatctgtcaagtagacacaattacttactttaactccatgttttcttgtttccttgtaaacacatgggtgttttggtgttcgttcattttgttattttcttagcactggttttcacaaaattcactttcggaataaaatttcatttggaatgatgtctctcttgaatttgtcaacaaaaggaaactcctagtgatgcctcatcatcagctacacaaatatttggtatttgaaaaaatgctggttctttaaaaaacacatttgtggttctctatcacttaaaaaataaagagacagagagagatgtttggcacagtgacacacagcctatagttccatctacttggaaggctgagacagaaaggattgcttgagtccaggagttcaaggctgcaatgagctatgattatgcctgtgaacagccactgtactgggcaatgtatctagactcccatcttttaaaaagagagagagaaagagaaagtacaaaagagaaaagaaaatgacaagaacaaagaaaaaagcagacaatattaactgtgaatctaaaataggttgtagagctcctcctgatgctgtaacctgatcatggtgcacactgataagctcccattacaacataagaaagccacagacaatggagcaagtcatcaccttccttgtattacaatctcatgtccttgctttggatgctgtgcctcctaaccacacctagtaaaagtagcatcacttatttggcaacatctagtatttaagaaccaagtaaaggcctgaaaggaattaccaggcaagactggatggtactgtgcaaggaacacacactttatcatcaggtagatccagatctcaattatcttttttttttttttttttttttttttttgagacaaagtcttcactctgtcactcaggctagagtgcagtggcagcgccaaggctcactgcatcctcaacctccaggactcaagtgatctcccacctcagcctccagagtagctgagaccacaggtgcatgccgccacactgggctaattttttaaatttttttgtagagacaggatctcactatgttgcccaggctggtctcaaacattatgacactgatacataactgttaactagactacagaccttattcagttttcactattttttttaacctgcatttgtgtgtgtatttctaagcagttttgtctcatgtatagatttttataaccacaactgcaatcaagatacagaactgttctgctacctctctgtatttatagcccctccacctactacccccctgtcccctggcaatcactaatctattcttcatctttacagttttgtcactttgagaatgtcatataaatggaactatataatatgtgacctcttgagataagcttttccactaagcacattacccttgtagtctattcaaggtgttgcaggttatctatagcttgcttgttccttttgattactcagtagtattccatgctatggatgtcatatgttttgctttacacttgttgacacaacatttggattggttcacattttgctgttttgaataagtctgctatgaacagttacgtacaagtttttaagtgaacataaattttattttatttggagtaaataaccaaaggagtgatttctgggtagtatggtaagtacatgtttaatttttaaagaaactgccagctggatccagcacctgtaatcctagcactttgggaggccaaggcaggaggatcgtttgagcctaggagtctgagaccagtctgagtaacataaccgtaccctgtctctacaaaaaatgcaaaaatcagccgggcatgatagtgcatacctatagacccagctacttgggaggatgaagtgggaagatcacttgagcccaggagttcaggttgcagtgagcaatgatggcaccactgcactccagccagggtaacagagtgagaccaggtctactaaaaaaattgactagtaaaaattaaattaaggccaggtgtggtggctcatgcctgtaatcccagcactttgggaggccaaggcaggcggatcgcgacgtcaggagtttgagaccagcctggccaacatagtgaaaccctgtctctactaaaaacacacacacaaaaaaatagctgggcatggtggcgcgtgcctgtagtcccagctactcgggaggctgaggtagtagaattgcttgaacccaggaggtggaggttgcagtgagccgagatcgcaccactgcactccagcttgggcaacagagtgagacttcgtctgggaaaaaaaataaattaattaaattaaattaaaaatttttggccgggtgcagtggcccatacctgtaatcccagcaatttgggaggccaaggcgggtggatcaccggaggtcaagagtttgagaccagcctggccaacatggtgaaaccccgtctctactaaaaatacaaaaagtagctgggcgtggtggcacacacctgtaatcccagctactcgggaggttgaggcaggagaatcgcttgaacccgggagccagagattgaagtgagccgagatgacactactgcactccagcctggcaaaagagcgagactccatctcaaaaaaaaaaaaaaaatagtaaagtcaaaaggcaaataacggagtagaagaaaatatttgtgttacatgtactacacaatggattaatttttataatatactaagtgctctcacaaacaaacagaacaactatcaacaacccaacagaaaaatgagtccaggacacaaactcttcatagaaatccaaataataaatgtgaaaaaaaaattcagcctctttcatctaaaaagaaatacaaattaaacaatgagatactatttttcatttctcagaaagattcggttttcatttaatattcctgtattatctgattttcttagtgttgtttcaatttatcataaacttaaaaaaaaaaaaaaactatagaggacgtgcgcggtggcccacaactgtaatcccaacactttgggaggctgaggcaggcggatcacaggtcaagagatcgagaccatcctggccaacatggtgaaatccatctctactgaaactacaaaacttagctgggcatggtggcgcatgcctgtaatcccagctactcgggaggctgaggcaagagaatcgcttgaacccaggaggcagaggttgcggtgagctgagatcgcgccattgcactccagcctgggcaacaagagtgaaactccatctcaaaaaaaaaaaaaaggcagaaagccaaaactattctaaaagatttttctttaatccctcatatatcgcggtacaaaaattgacaaacagagaaaagaatggaagaatgagggaagggaacacaaacatcttggattcacagtctatgcaaatgctaatcaaatcacctttgaaaaccattcaatttccacacacacacacacacacacacacacacacacacttaggctggctgtggtggctcatgcctgtaatcccagcactttgggaggccaaggtggatggatcatctgaggtcaggagttcaagaccagcctgggcaacatggcaaaaccccgtctctactaaaaatacaaaaattagctgggtgtggtggtgtgcacctgtaatcccagctaccaggaggctgaggcaggagaactgcttgaacccgggaggcagaggctgcagtgagacagagcaagactctctctgaaaacaaaaacaaaagaaaatttaaaaaattaaacacacacactcagacccacatatccttttcaagtcaaccaaaccacagccagtctttaatttctttatagcaccattgagactcttaaatttctttgaaataaactataaaaatcagactcttctacacattcttttttatggttattgattttggcaagataggaggattaaaagagggaatagtctatacagctatgtgaagtctaccaatctagatatccatcaattatgaaataactaagaatcattttagttcaaactaccaccacataatcatgttcattcaacaactacatcccaggctctagactagggttcatggctcccagcgaggacatcatactattccagactagactaaactgagtcccttaggtccctaagactcttttttctatcatctgtataaccccaatacatttaacaattttacataaattataaatcgaccatgtaagataatatcctactgccaatgtgagggctaaaaatttgatcttgcaatttgtttagtctaactctcttccagagtttcttaacaccttcactactgaaattttggacaagaaaattgttatgagaggttgtcctctaaactggaagatgtttaatagcatgccaatagcaccttcccagttgtgacccatgagaatgtttccagacactgtcaaatgtcccctaaagggcaaaatcacaactctacccctacgccaactgagagccatacaccataaaaatctaggagttgtgagtgcagggaaatggaaggattaggtggaagagtagctaaggagaacagggtgggtttttttgtttttgttttttgagacagagtctcgctctgtcgcccaggctggagtgcggtggcgcgatcttggctcactgcaacctccacgtcctggttcaagctattctcgtgcctcagcctcccgagtagctgggattataggcgtgcactatcacacccagctaactttttgtattcttaggaaagacagggtttcgctatatcggtcgggctggtcttgaactcctggcctcaagtgatctacccgcctcagcatcccaaagtgctgggattactggtgtgagccaccgcgtcctgcctgagtaatgaaaatgttctaaaactgattgtggtaatggatgcacaactgtgaaaatactgaaaaccactgaactgtacattttaagtggctgaactgtatgttttataaattgtatctcaatagagctattctttttaaaattcagattctggactccactccagatctcataaattagaatcaaaagcagaaagccaaaactattctaaaataccttccaggatcactaggaggacatttggggttcacagccagacagtgatgaacatctcaaaccacaagatgcacagaacggctaagaggaaaatgagcttgctgtgcactacccaatggttaactgcttggaaaaatatggaaactgataacgtgttaaatatgttcaataacacatctcaaatttatgtctaagaacacatttcaatttcaactccatgttaagttgaaaggatagcttcccaaattatgacatatgtaccttcacctttaaagaaacagaaactaaaacaactccaaatattatatgcttttacatctacattcattcattaagtggttttataattactggttttgagttatactgcagctactcacatcataagaaaaagacaacataaagtacaagaataaacttgagtataatttttaattagacctgatgcatcaatctgaatagctaataccaaaaatcctaagctatgaaatctaaatttcccaataaatctgaacatctgcaagtataccacatagcaattagaaaaaactgtactatggaaaagatttaagtcgttctggtttctgttttgcaagttccagcagaaaactaatgctagggttcattgaaacaacactgctagtatctcctatttcctccaagaacaaacaagaaagccattattatctcaaatgttcttctgaaaagtataatgacccttcttataatattatggaaaatatgaacaagaattttaatcaaaatagcattcgtaaagccacatgaacacttttattttttttatttttaaactttaaaatctaaatacctacccaaatacccagtgtttctaaaactaatgactaaatctgatttacttctaactctctctagtatataagtgatgtctgaactatgagattcatgtgaaaatgtacgtcgtttatttgtacatgatctgtctctcaggcactcgacctaggggagtaacacatattgatgatctccagaatgtgcacattacaacctgattgataccaaattggtgctatattcatgcatttattaacaaggaatgatgcttatatcgagcaaaaagttcatgagtagtatatatagttcttattttcacaagaaaaatatgtatatatattcacaggaaatgtctagaagaatatatatgaaaatgttattctcttttataatttttgtgtttctaaattatctacattaaataaaacttttgcaaaaagaaaaaataaatgtcattttaaaaacatacccagccaggcatggtggctcacacctgtgatcccaaaactttggaaggccgaggcaggcagatcatgaggttaagagaccaagaccatcctggccaacatggtgaaaccccatctctactaaaaatacaaaaattaggtgtggtggcacgcacctgtagtctcagcaagtcaggaggctgaggaaggagaatcacttgaacccaggaggcggagatcgcagtgagccgagatcgcgccattgcactccagcctggcgagagagcaagactctacctcaaaaaacaaaaaaaacaaaaaacaaaaacaaaaaatcagctggagcaggccaggcacggtggctcacgcctgtaatcccactttgggaggccaaggtgggtggatcatgaggtcagaagttcaagaccagcctggccaacatagtgaaaccccgtctctaccaaaaatacaataaagtagctaggattacaggtgtggtggcgggcgcctgtaatcctagctactcaggaggctgaggcaggagaatcacttgaactcgagaggcagaggttgcagtgagccgagatcatgccactgcacgccaacctgggcgacagtgtaagactccatctcaaaaaaaaaaaaaaaaaaaaaaaaaaaaattagctggccatggtggcgggctcctgtaatcccagctactcaggaggctgagacacgagaatcacttgaaacctgaaagcagaggttgcagtgagccaagatcataccactgcactccagcctgggcgacaaagcaagactctgtctccaaaaaaaaaaaagaaaagaaaagccccaacaaaagtcagtcttctttagctaaaagaccaagaaagtagcagtctagcaagacagaaaagttttagacaataaccaatctaccccagccaaacaccaagaaaatactgtggtttaaaacctacccgttctagcaaaggccaagtggggagcctagatttccaacctctcaaagctgtaattaagcactcaataccccttccaaggtggagacagaaagccaagtagggtatccaggaatttcatccctgcagaccagtaacaagatcagcggggaccacgtggggaacctgggcctccaccatattatatcaatacaaatggcagtttctttaaaaagtctccctctccctctccctctccgtctccgtctccgtctccgtctccgtctccgtctccgtctccccatggtctccctctcatgcggagccgaagctggactgtactgctgccatctcggctcactgcaacctccctgcctgattctcctgcctcagtctgccgaatgcctgcgattgcaggcccgcgccgccacgcctgattggttttggtggagacggggtttcgctgtgttggccgggccggtctccagcccctaaccgcgagtgatccgccaacctcggcctcccgaggtgccgggattgcagacggagtctcgttcactcagtgctcaatggtgcccaggctggagtgcagtggcgtgatctcggctcactacaacctacacctcccagccgcctgccttggcctcccaaagtgccgagattgcagcctctgcccggccgccaccccgtctgggaagtgaggagtgtctctgcctggccgcccatcgtctgggatgtgaggagcccctctgcctggctgcccagtctggaaagtgaggagcgtctccgcccggccgccatcccatctaggaagtgaggagcgcctcttcccagccgccatcacatctaggaagtgaggagcgtctctgcccggccgcccatagtctgagacgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccagcagccaccccatctgggaagtgaggagcgtctccgcccggcagccaccccgtccgggagggaggtgggggggggtcagccccccgcccggccagccgccccatccgggagggaggtggggggtcagcccccccgccccgccagccatgccgtccgggagggaggtgggggggtcagccccccgcctggccagccgtgccgtccgggagggaggtgggggggtcagccccccgcccggccagccgccccgtccgggaggtgaggggcgcctctgcccggccgcccctactgggaagtgaggagcccctcagcccggccagccaccccgtccgggagggagatgggggggtcagcccccccacccggccagccgccccgtccgggagggaggtgggggggtcagccccccgcctggccagccgccccgtccgggagggaggtggggggggtcagccctccccccggccagccgccccgtctgggaggtgaggggcgcctctgcccggccgcccctactgggaagtgaggagcccctcagccccgccagccgccccatccgggagggaggtgggggggtcagccccccgcccggccagccgccctgtctgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcagccccccgcccggccagccgacccgtccgggagggaggtggggggggggtcagcccccctgcccggccagccaccccgtccgggaggtgaggggcgcctctgcccggccagccgccccgtccgggagggaggtggggggttcagccccccgcccggccagccgccccgtccgggagggaggtggggggggtcagcccccctgcccggccagccgccccgtccgggaggtgaggggcgcctctgcccggccgcccctactgggaagtgaggagcccctctgcccggccaccaccccgtctgggaggtgtgcccactagctcattgagaacgggccaggatgacaatggcggctttgtggaatagaaaggcgggaaaggtggggaaaagattgagagatcggatggttgccgtgtctgtgtggaaggaagtagacatgggagacttttcattttgttctgcactaagaaaaattcctctgccttgggatcctgttgatctgtgaccttacccccaaccctgtgctctctgaaacatgtgctgtgtccactcagagttaaatggattaagggcggtgcaagatgtgctttgttaaacagatgcttgaaggcagcatgctcgttaagagtcatcaccaatccctaatctcaagtaaccagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaataaataaataaataaaaaagaaaaaaaagaaaaaaaaaaaaaagtaagcatgcgactaccatatggcctagcaactgtactcctaggcaaactgccgaactatttttcagagtggctgtaccactttactgttaactgtttcaatgtcaataccctggttgtgatattgtaccatgattctgcaagaaatttccaccaggggaaactgggtaaagtgtacaagggatatctctgtattattgtttcttacaattgaatgtaaatctataattatctcaaaattattttaaaaaactgtgtttaaaaactaaattaaaaaacacaaatatactaaatatttagacttaaggctgaactatgagttacatatccttatatcccaagcacctacaccaaagcctagaacatattagacaataaatatttattgaattagattgaacatacaatcagcacttcaaaaatataagatgcttacaaacctaacagttccatttcgttggctgtaaataaagtaacaataccttaaaacaagtgcaaaaaagttaccttcaagaaaatataaagtattctggaattttttcaaagagaaaaatgactcagtcctagactacaatgacttagatattacctcattattttggctaatttattgtacggagagagggagggaggccagtaggccggctggccagcctgcgaggcttaaaaagtaccatgtacataatttaaaaattagcatatagtagggagtctttagaaaccaagtagcacacataaatactacacatacccacccacttgcaaaggtgttttaagccaaaaatcttactctacgtgtccaagtttcatcggtatttctgattttcactaggtctggctgaacaggattatgtcttatcttttagagtaactatcagaactggtgattatctccatcatctatgaacacagtccttttcatctgataaaactggcattcggtaacaagaaagcatcttattttaccagaatgacccaagtaattcattaattaaagaaaaaaatgtatacaggaatctttattgttgctttggtttgttggttttctaaaaccaataaaacaattgtcttttcctgcataaacacctgatttgaaaatctagatacaatattattttattttattttatttatttttgagatgaggtcttgctctgtcgcccaggctggagtgcaatggcactatctcggctcactgcaacctccacctcctgggttcaagtgattctccctgcctcagcctccgagtagctgagattacaggcgtgcaccaccacgcccggctaatttttgtatttttagtagagatgggtttcatcatgtgggccaggctgctcttgaactcctgacctcaggtgatctgccctccttggcctcccaaagtgctgagattacaggtgtgagccaccgtgcccggcattacaacattattttaaacagccttcatcattaagtaatgaaagtgaaagtagagtcagcagtcagtaaaaacactttgtgattgaataattcaagtacagaattaacagccaaaactacatgaactgaacagataatgataaaaacccaatcagggccaggcacagtggctcacaccttaatcccaacactttgggaggccaaggtggggagattgcctgagctcagtggttcgagaccaccctgggcaacatggtgaaaccccgtttctactaaaatacaaaaaattagccaggcatggtggcgtgcgcctgtagtcccagctacctgggaggctgaggcatgagaatcacttgagcctgggaggtggaggttacagtgagccgagatcgtgccactgcactccagcttgggcaacagagcaagactccatctcaaaaaaaaaaaaaaaaaaaaaaaaaagacctactcaggatagcaacattacaataatggcaagccatacttattttgatcctttatggtccatatgaacacatgaaatcttaattatttgagaattcaacaacttttgggctgggtgcagtggctcacacctgtaatcctagcattttgggaggctgaagcgggtggctcacgcctgtaatcctagcactttgggatgctgaggcaggcggattgcctgagctcgggagttcgagaccaccctgggggcaacatggtgaaaccccatctctactaaaatacaaaaaattagccggcttggtggtacacacctgtaatcccagcaactcaggaggctgaggcaggagaattgcttgaacctggaggatgcagtgggctgagattgtgccactgcactctggcctgggccacagagtgagactctgtctcaaaaaaaaaaaaaaacttttgaacatctctctcttaaacctctggcctttaaaatcccaatcatatcacatttaatatacatgggttattaaatgggttcaggaattgttagtctgcagtagaactctgcaacaaacaataaacagtttcatcaccaaaaggtacctggatgtaatctcaattagtaaaaactcagtcactcatatgtcactgacatatttcctttggacaaggcaactcattctgttgatctttctcagccactatgaagtttatcactcatgcctgtaaatggtacatggtcatgaactgctacagaataaagtccaagagaacccaccaaaactgtggaagattaaaagattgatggatcattaaaaaaaaatggattatagacctaaatgtaagatacgaaactataaaactcctagaggataacatagaagaaaatctaggtgacctagggtttggcaatgacttcttagatacaaccccaaaaacatgatgtaggaaagaaaaaactgataagctggactttactgaagttaaaaattctgatctgcaaaatacactgctaagagaatagaaactcaacagattgggagaaaatatttgcaaaacacatctctgacaaagaactggtatccaaaatatacagaggccaggcgcagtggctcacgcctataatcccagcactttgggaggccgagggagatggatcacaggagcccaggagttcaagaccagcctgggcaacgtgtcgaaaccctgtctctacaaaaaaaaaaataataataatacaaaaaaaatgtagccagtcttacaacccaatctcaaaataaataaaaaattaaaaacgaaacaaaatatacaaataactttttttatttttgagacggagtctcactgtcgcccaggctggaggacagtggtgcgatctcggctcactgcaagctccgtctcccaagtacacgccattctcctgcctcagcctcccaagtagctgggactacaggtacccgccaccacgcccggctaatttttttgtatttttagtagagatggggttttaccacattagccaggatggtttcaatctcctgacctcgtaatccacccacctcggccttccaaagtgctgggattacaggcgtgagccaccgcgcctggacccaaagagctcttaaaatttaatatgaaaatgaacacctccccctccccctccccctctccctctccctctctttccacggtctccctctgatgccgagccgaagctggactgtactgctgccatctctgctcactgcaacctccctgcctgattctcctccctcagcctgccgagtgcctgcgattgcaggcacgcgccgccacgcctgaccggttttcgtatttttttggtggagacggggtttcgcctgttggccgggctggtctccagctcctaactgcgagtgatctgccagcctaggcctcctgaggtgccgggattgcagatggagtctcgttcactcagtgctcaatgttgcccaggctggagtgcagtggcgtgatctcagctagctacaacctccacctcccagccgcctgccttggcctcccaaagtgccaagattgcagcctctgcccggccgccaccccgtctgggaagtgaggagcgtctctgcctggccgcccatcgtctgggatgtgaggagcccctctgcccggcagccgccccgtctgggaagtgaggagcgtctccacccggcagccgcccagtccgggaggtggggggcagcccccgcccggccagccgccccgtccgggagggaggtggggggcagcccccacccggccagccgccccatccgggagggaggtggggggcagcccccgcccggccagccaccccgtccgggaggtggggggcgcctccgcccggccgccaccccgtccgggaggtggggggcacctctgcccagccgccccttctgggaagtgaggagcccctctgcctgaccgccaccccgtctgggaggtgtacccaacagctcactgggaacgggccatgatgaggatggcggttttgtcgagtagaaaggggggaaatgtggggagaagatggagaaatcagattgttgctgtgtctgtgtggagagaagtgggcataggagactccattttgttctgtactaagaaaaattcttctgccttgggatgctgttgatctatgaccttacccccaacccggtgctctctgaaacatgtgctgtgtccactcagggttaaatggattaagggcggagcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctatgaccctgccaaatccccttctgcgagaaacacccaagaatgatcaataaaaaaaaaaaaaaaaaaaaaaacatcactatgtaccccatgactatgtacaattgttatctgtcaattaaaaataaaataatgtttaaaaaataaaaaaatttaaaaaattaaaaataaattaaaaaaaagaaaatgaacaatgtggctgggcgtggtggttcacgcctgtaatcccagcactttgggaggctgaggcgggcagatcacctgaggttgggagttcgagaccagcctgaccaacatgaagaaaccccatctctactaaaaatacaaaaaattagccaggcgtggtggcacatgcctgtaatcccagctactcgggaggctgaggaaggagaatcacttgaacctgggaggcgggaggttgttgtgagccaagatcgtgccattgcactccagcctaggcaacaagagtgaaactctgtctcaaaaaaaaaaaaaagaaagaaaatgaacaaccccattttaaaaataggcaaaagatctgaacagacacttcaccaacgatatacgaatggcaaataagcatatgaacgaaaagatgttcaataacatatgtcatcagagaattgccaattaagacaacaataattctgacaaccgtggttaaaagaaattattaataagaaaaaaagacttcaaattcattaaaaaaaaaaaagacaacaatgagatgccaccgtgtccgtatcagaatggccaaaatccaaagcacaacaccaagtgctgacaaggatgtcaaacaataggaaatctcattcattgctagtggaaatgcaaaatggtacagccagcaaggtgagctggaatcacctatagtcccagctactcaggacgctaagccaagaggattgcttgagcccaggagatgagtctagcctgaacaacatagcgagacctgtgtcttaaaaaaaaaaaaaaaaagttatacccagtttgggaggttcttacaatactaaacatactctctcaccacacaatccagcaattgcactccttgatatttacccaaagatgaaaactcatgtcaacacaaaaacctacatgtggacatttatagtagctttattcacaattgccaaaacttggaaccaactaggatgcctttaataggtgaatggataagcaaattgtagtgtacccagacaatggaatactattcagcaataaaaagaaatgagccatcaagccacaaaaagacattgagaaacctcaaatgcatattgctaggtgaaaaaaaagccaatctgaaaggctatatactgtataattctaactatacgacattgtgaaaaaggcaaaactatgaagacagaaagatattagtggttacagtagttaaggggaagaagtagggataaataggtggagtacaggggatttttagggcagtgaaactattccatatacatattattatgaaaccatctttgcaaaaattataactgagacaattattacagtgaaagagatctgatctaaccaactccatcctgcttctaacctcccagctgtccttgttcattcctagacttagcccaaactaactttgtttgggaggaacttagtttacagtttaggttagttttcccagaacaaacccccttcctggctggggactagactgcctttgcaggactaacaaattctaacaagattagaaatcatggtttaggagtcatgcagctagaggctgcaagattctaaacctccctaaattactcctggggataacatcattattgtaaaacccaagatcgtgtttgagatattttgcagaccctatattcaatggattagctggcaccacccagactgatataaactggcctatcttgtcttgtggcccccacccaggaactgactcagcacaagaggacagcttcaactacctatgatttcatctccaacccaatcaatcagaactcctgactcactggtcccctacccacaaaattatcctttaaaactccaattcacaaattctcggacagactgatttaagtaataataaaactctggtctcccacacagtcagttctgcttgaattactctttctctactgtaattcccatcttgataaataggttctgttgagccagcgggcaaggtgaccccgttgggtggttacaattagacagtcatgcatcacttaacaatgggaatacattctaagaaatgtgttaggtgacttcatcattgtgcaactgtcatagagtgtactaaacaaacctagatggtacagcctgctacacatctaggctatatggtataatctgttgctcctaggctacaaacctgtacagcatgtaactactgaatactgcaggcagttgtaacacaatggtaagcatctgtgtatctaaacatatctaaaaacagaaaaactaaggtgttatgccaagcattacatcactaggcaatgaaaaattttcagctccactatatagaaagtacccatctctacaaaaaaagaaaaaaaattgccagccttggtagtgtgcacgtgtagtcccatctactgtggaggctgaggcaggaggactgcttgaacccagaagttccaggctgcagtgagttatgatcgtgccactgcactccaacttgggtaacaaagcaagacactgtctcttaaaaaaaagaaaagtctattaattttaaaaaagaacctctgcacaatggaatgatcttcattctttatatactactgtaccacctcataaccatgactaacattactaataccactcacatctcaaacatagcaatctaactccttacaacttaaagtgtcatctgtagaccaacaggattagcatcaccttatagatcagaaatgcaaaatcttgggtcccacactaaaccttcagaatcagaatctgccttataaaaagatcatgtgatttgtatgcacactaaaatctatgaaggcctaatccaaagctttcaattcaaaggccacacaaggcaagggggacagaaatcaaggccctgggccctcccaaagttaagccttataagacaccccaccatatacctctccaatctaaaccaagccccaaatttttcactatccctagcggactatatagaagcctgccttggtgttgagcaaatcaaaagaataaaaaattcctgagaaatcatagccacgaggaatccctgtatgcactggcatcttagtttcttataatctggataagccaatgactgtcaagtcatgcagtttgaggaaataaaaaactagtgatgccacagagtacctgacagatattaacaccaaggctaacttctcaagcaacaatgtaagccagaagataatggaatgataagttcaaggctggacagggtggctcacacctgtaattccagcactttggaaggctgaggtgggaggattgcttgagtccaggagtttgagacaagcatgggcaacatagtaagaccccatctctacaaaaacaacaaaaaaagaaacgataaattcaataaactgaaagaaaataaaatgcaatactaataaacatacaaacaaacatacaatactatgccccccaaaaaagtagttttcaaggatgaaagaaaatatatacctatatagtatatccgtagaagttttctggggacagggtctttgctgttggttagattctcaaggggatatatactcatgaaattaagaaccatttatttacaaaaacattaaaggtcattcaacttaacttcctccccagtatctctaaataccctggctctgttttaacataagttaaactcagtatcttactttaacatgaggaaactcactatcttataagaaagttacattccatttttctctttaacttctacttgatggtccttgttcttttgtcaaagcaacaaaatactaaatctaatgcctattccacttgccagatctttgatatatagttagccctccaaagccacaggttccacatccttggattcagccatcacatatatatattttttattttattttattttttgagacacagtttcactctgcctcccaggctggagtgcagaggcgcaatctccgctcactgcaacctctgctacccgggttcaagtgattctcgtgcctgaacctcctaagtagctgggattacaggcgtgcgccaagtatatcgcaggacatgcagaggtacatcattttatatatgggaccttatcatcctcagattttcttatctgcaggaggtctgagaaccaatctcccatgaataccgagggacaactgtatttgaaaatagctgtccccacctctttattctctaaatgaaacatctctaattccttttttttttttttttttttttttttttttttttttgagacggagtctcgctctgtcgcccaggctggagagcagtggtacgatctcggctcactgcaagctccgcctcccaggttcacaccattctcctgcctcagcctcctgagcagctgggaccacaagcgcccatcaccacgcccggctaattttttgtattttcagtagagatggggtttcaccatgctagccaggatggtctcgatcttctgacctggtaatccgcccaccttagcctcccaaagtgctgagatcacaagcgtgagccaccgcgcccagcctctaattccttaaataatgtctcaaatcattttaattactccatcaccagacagactgttttctcctggaaagactctatccatgctccgaaaatgtgcctcttaaaactgaacactctcattttacagtagaggggaaaaaaaaacctcaacacaatactaaaggtctggaatattatgttcccctgtattttcatttatatttttaaattttttttggcgtgattgcgccaagctggattgcagtggtgcaatcatggcttactgcagcctctatctgctgggctcatgtaattctaccacctgagcctcccagagtagctaggactacaggcacaagccacagtgcacagctaatttttacatgttttgtagagacaggggtttcactttcttaggtttaaaaatatagaggcggtctgggcatttatgcttctgactacctgaataataccacctccccgttactgtctcaaagttaacaagagaaaccttttttttttttttttttaaatccccagacagagtctcactctgccacccaggctggagtgcggtggcacaatctcggctcactgcaacctctgcttcctgggttcaagcgattctcctgccttagcctcccgagtagctgggattataggcatgcaccaccatggccggctgatttctgtatttttagtagagatggggttttgccctgttggcaaggctggttttgaactcctggcctcaagcaatccacctgccttggcctcccaaagtgctgggattacaggcgtgagccactgcaactggcccagagaagcatttttttaaaaactattttaaataatatttaaggaccaggtgtgatggctcatacctgtaatcccagcactttgggaggctgaggtaggcagatcacttgagctcaggagttcaagactagcctggacaacatggtgaaaccccatctatacaaaaaatacaaaaattagccaggcatggtgccacacacctgtaatcccagctactcaggaggctgaggtgggaagatcatttgagcccaggaggcagaggctgcaatgagccaagatcgtgccactgcactccaacctgggtaacagagcaagattctgtctcaaaaaaaaaaaaaaaaaaaggaatatttaagtaataaacatccagctctactaattaaaaactaatgaaaattaactgaatccttggctgtgagtcaattcaacaaagcaccatgatctccttaaggcatttattttatttatttatattttagaggtaggatctcactatgttgtccaggttgtacttgaactccaaggctcaagtgattctcccgcctctgcttctcaagaagctgggactggccaggtgtggtggctcacgcctgtaatcccagcccttagggaggccaaggcgggcggatcacgaggagttccagaccagcccggccaacacggtgaaatcccatctctactaaaaatacaaaaaattagccaggtgtggtggcaggcgcctgtaatcccagctactcggaaggcagaggcaggagaatcgcttgaacccaggaagtggaggttgcagtgagccaagatcgcaccactgcactccagcctgggcaacagagcgtccgtctcaaagaagctgggactatgggtacagttcaccatgccaggctcctaagacattcatttaaatccacttagtcattcatacctatgcacaatatgtatagcatttacagtgtgtatcatgacacttttaataataaagtcagtgttttaaagtcagtgtgtattgtttcttctattttactttttaaaaaatcacctacagcacttaccacagtgtatgcacctagaaggtatataaatatccgtggtattaaattgaacacagtagaaagaatgctagagattaaagttcaaattctgactcagctacaacttagtaaatgaccttaggagaaggcagaattattctgggactcaaagtggttccagtaagtccatgagtttcatatttcacagccaatttgccatctatataacccaatgaaacttacagggaatgtaatttccattgaaaacatcaatgcttcaccaattccatatacacaaaaattattttctgatttgtatcactagacagtgtcttactagcattctgaaggtcacccatcccagtcacgaagcccttaattctcacaaccttgattttataaataaggaaacagatagactgatctgccccagacctcacagttattatgtggtacagatgaaacctgaaccttggtcttttgacactcagtccagtgctattactgccatactatagttgcctgtcactgataattgcaaagtttgttaatttgggcaagtctaccttagacttttagacaacacactgttgaaaggcaccccacctctggctgatgaaataggctgactggtttgcctctgaagcatctcagcaagtctcagctatactgagcacacaaagttattcagaatatctttcaaacatttttttgtccctattattgttatcttattttagcttgataaagaacaactgtctgggtagccactgacactcttaaaatatactcagcccaagagaacttgctaaaatggaacatactaaattggttgagtactaaagcaactggctatatcagagaacctcattatcggtgacccaaacttacctttaattatcagatatatgaccatgcaatactgatgttattgttttaagaaaatcagatgtgattaaaagtgtgagattatccctttttttaacctattaaactagcaatattagtgaaaaaaaattttttttctgagacagggtctcactccattacccaggctagaatgtagtggcacgatcatagctcactgtaacctcaaactcctgggctcaagtaagcctcctgccttagcctgctgagtagctgggactacagacaccaccatggctagataattttttttaactttttttttttcagagatggggtcttgctatgttggccaggatagtctcttttttctttttttttctccctcctcaggtgctacttaaccaggcttgttttgaactcctggcctcaagtgatcctcccacctcagcctcccaaagtgctgggattacaagtgtgagccaccatgcccaaccacggtttctttttatccttcttcttcttcacagagacctcttcttctaccactactacttttccttcttctccatcttcttcaattttaattttactcttggccttttttgctttctttgtggtaatttcatcttctttatctgttctgagttttttttaattttttactttttgtacaaatggggtctcactatgctgcttaggctggtcttgaactcctggcctcaagcaatcctcccatccttggtatccgaagtgctgggattccaggtgtaaaccactgtacctggccctattttgtgtttttgtagaacaggttggaagtgtggacccaccaatacattcttttaaaaaaatttttagtattttcttattaaaagggaactgtgggccaggtgtggtggctcacacctgtaatcccagcactttgggaggcagagacaggaggatcacttgaggccaggagttaagagaccagcctgggcaacatagtgagatctcgtctctacaggaaaaaaaaaaaaaaaagcaaaaacttagccaggtccaggtccatatggtggtgagcgcctgtagtcctatcaacttggtaggctaaggcaggaggatcactggagcctgggaggtcaaggctacagggagcagtgatcacaccactgcactccagcctgggtgacagagtgggaccttgtctcaaaaaaataaataaaatgaagtaaaaaggaactacccctttttgaagtacagtgtgcttttaaaaagcatttctccatgtctcgtaataaagggcagacaaaaatataacaaacaaatgggtcagatactgccctttaactgcaaatggtttgttacccccatgtctctgtaacttagtgaataagagggaaaggaaaataagtaagcttgagtttactcaagaagaaatctgagggccaggcacggtggctcacagctgtaatcccagaactctgggaggccaagatgggcagatcgctcgagctcaggagttcgagaccagcctgggcaacatagtgaaaccctgtctctacaaaaaaaataccaaaaaaaatcagccaggtgtggtggcacacgcctgcagtcccagatacccataaggctgaagttgggaggatcacctgaaaccagaaggtcaaggctgcaatgagccatgatgccaaaccacactccagagcctgggcaatggactgagacccatctcaagaaaaaaagaaaagagaaaaaatctgaacacagaattaacaatgaacatagccaatcattacgataaatacttctaaattcatgaaaaaagtagccgggtgcagtcgctcacacctgtaactccagcactttgggaggccaaggcaggtagatcactagaggtcaggagctcgagactggctgggctaatgtggtgaaaccccattagcagggtgtggtggtgcgtacctgtagtcccagatactcgggaggctaaagcaggagaattgcttgaacccaggaggcagaggttgcagcgagccaagatcgcgccacttcactccagcctaggcaacagagttagacttggtctcaaaaaaataaaaaataaaaataaataaattaatgaggccaggagcagtggctcacgtctgtaaccctagcattttgggaggcccaggcaggtggatcgcttgaggtcaggagttcgagaccagcctggctactaaaaacataaacattagccaggcatggtgacatgcgcctataatcccagctactcgggaggctgatgcaggagaatcacttgaacccaggaggcggaagttgcagtgagccaagatcatgtcacttcactccagcctgggatggaaactccatctcaaaaatactactactactactaataataaatttggccaggcacgctggctcatgcctgtaatcccagcactttgggaggccgaggtgggcggatcacttgaggtcaggcattcacaagaccagcctggccaacatggcaaaactgcgtctctacaaaaattacctgggtgtggcagcgtgtgcctgtagtcccagctacttgggagggtgagacaggagaatcacttgaacccaggaagcagaggctgcagtgagccaagaaggcgccactgcactccagcctgggcaacagagtgagactctgtcccaaaaaaataaattataaattcatgaaaaaactatttttttaatgaggccagaacacatttccctagggaaataatatataaaatcaaattaatgttcctattcttaaatgcctaactttatgatccttagtattctgagttccagaaacaaaggataattaggggcaaaaggtatagaagagcagagacaaacgtgagaattgcctttcctggacctcaggaagcattttataataggtaaaaatagttttacaatatcccacttcccttctgtgccattttccaagtcattagtggcattatgctccgctaagtcccactactgtagcacctgactgcagcatcaattgaacatacatttgccagtagagaaagagaaacaagaaatgaagtatggtctctgacttcaagggactctcaggccagtgacaagatatatttaattttaggccaagtgcagtggctcacgcctgtaatcccagcactttgggaggctgaagctggtggatcacttgaggtcaggagttggagacgagcctggccaacatggtgaaaccctgtctactaaaaatggtggcacatgcccgtaatcccacctactcaggaggctgaggcaggagaatcatttgaacctgggaagcagaggttacagtgagcagagattgtgccactgcactccagcctgggcaacagagaggctccatctcaaaaaataatcataattttaaaacaatatggaaatccaaaggaatacacacacacacacacacacacacacacacacacacacacacacacacacacaaattagcattagtaaacaagttcagccgggtgcggtggctcacacctgtaatcccagcacttagggaagctgaggcgggtgggatcacctgaggtcgggagtatgagatcagcctgaccaagatggagaaaccccgactctactaaaaatacaaaattagccaggcatggtggcacatgcctgtaatcacagctacttgggaggctgaggcaggagaatcgcttgaacccaggaggcggaggttgcggagagccgagatcgctccattgcactccagtttgggtgataaaagcaaaactccatttcaaaaaaaaaaaagaagaaaaaaaaagttcagcaaggccacagaataccagatctataaaaatcttttatttctctataccagcaatcaacaacacaaaatgaaataagaaaataattccattttcaatagcatcaaaaggaataaaatactaaggaataaatttaaagtaaaagacttgtacactaaaaactacaaaatagctggagaggatgtggagaaataggaactcttttacactgttggtgggactgtaaaactagttcaaccattgtggactacagtgtggcgattcctcaaggatctagaactagaaataccatttgacccagcgatcccattactgggcatatacccaaaagattataaatcatgtgtcttttaaagacacatgcacatgtatgtttactgcggcactattcacaatagcaaagacttggaaccaacccaaatgtccatcaatgatagactggactaagaaaatgtggcacatatacaccatggaacactatgcagccataaaaaaggatgagttcatgtcctttgtagggacatggatgaagctggaaaccatcattctgagcaaactatcacaaggacagaaaaccaaacaccgcatgttctcactcataggtgggaattgaacaatgagaacacctggacacagggtggggaacgtcacacactagggcctgtcatggggtggggggaggggggagggaaagcattaggagttatacctaatgtaaatgatgagttaatgggtgcagcacaccaacatggcacatgtatacatatgtaacaaacctgcacattgtgcccatgtaccctagaacttgtaagtataataataaaagaaaaaaaaactacaaaatacattatatatatatatacacacacttttttttttttttttttttttgagacagaggctcactctgttgcccatgctggattgcaatggcaggatcacagatcgacgtcctgggctgaagggatcctcccaccttatcctcaccctgatgagtagctaggattacaggggcaagccaccacatccagctaattgtgtgtgtgtgtgtgtgtgtgtgtgtgtgtgtgtgtgtgtgtgtgtgtgatatgtcggccagactggtctcgaactcctgggctcaagcaatcttctcacctcagcctcccaaagtgctgggattacaggtgtcagccaccaccacactcagcttaaaaaatattcttgaaagaaattaaagacataaacaaatggaaaggcatcccacgttcatgaagtggaagatctgacattgttaagatggcagcactctctaaattgatctacagatttaaggcattccctatcaaaattccaactgccttttctgcaaaagttgccaagttaatcctaaagctcaaatggaaatgccaaggatccagaatagccaaaacaatcttcaaaaaaacaaaattagaaaactcacacttcctaatttcaaaacatattacaaaagtacattaatcaagacagcatatttatgcagatagtagcagatagtagtaccacagggtgaaaatacaagaaagcaagcatgatggtactggcatagacgtacaccaatgcaatagaattgaaagtccaggccgggcacggtggctcacacctgtaatcccagaactttgggaggccgagtcaggcggatcacttgaggtcaggagttcaagacccgtctgaccaaaatggtgaaaccccgtctctaccaaaaatataaaaattagctgggtgtggtggtgcatgcctgtaatcccagctactcaagacgcagaggcaggagaattgcttgaacctggaaggcagagaggttacagtgagctgcgatcacgccactgcactccagcctgggcaacggagcaagactgtctcaaaaaaaaagaaagtccagaaataagcccacacctctgtggtcaattgactcaaaacatggatgctaagatgatacacaattcaatggaaaaagaagtcttttcaacaactggttcaaggacaactagatatccacacaccaaaaaaaacaaatgaaaaagattttgggccgggcgcagtggttcacgcctgtaatcccagcactttgggaggctaaagcaggtgaatcacccgaggtcaggagttcgagaccagcctggccaacatggtgaaaccccagtctctactaaaaatacaaaaattagctgggtgtggtagcgggcacctgtaatcccagctacttgggaggctgaggcaggagaatcgcttgaacccgggaggtggaggctgcagtgagccgagatcacgtcattgcacttcagcctgggcgacagagtgaaactccatctcaaaaaaaaaaaaaaaaaagaaacaaagaaaaagattttggattcctacctcacacatcatgtataaaaattaatttgaaattgataaaaaaaaaactaaatacaacagctaaaactataaaattatttaaagaaacataaattacacctataatcccagcattttgggaggcaaggaaagcggatcacttgagcccaggagttcgagatcagcctggacaacatagtaagaccacatctcagccgggcgcagtggctcacgcctgtaatcctagcactttgggagcccgaggtgggcagatcatgaggtcaggagatcaagaccattctggctaacatggtgaaacttcatctctactaaaaatacaaaaaaaaaaaattagccgggcatggtggtgggcacctgtagtcccagctacttgggaggctgaggcaggagaatggcatgaacccgggaggtggagcttacagtgagcagagatcgcaccactgcactccagcctgggtgacagaacgagactacatcttaaaaaaaaaaaaaaaaaggttaccaaaattagccaagcatcatggtgcacacctgtagtcctacctactcaggagactgaggtggaaggatagcttgagcctgagaggtggaggctgcagtgggcagatatcatgccactgcactccagcctggacaaaagacagagaccctgtctcggaaagaagaaagaacgaacgaacgaaagaacaaacgaatgaaaaaaacaaacaaaagagaaatctttatcaccttaaattaggcaatcgtttcttagatgtgacacctatagcacaagcaaccaagaaaaaactagataaactggacttcatcaaaatttaaaacttttgtgtttcaaaagatactatcagtcaggcatggtggctcacacctgtaatcccagcactttgggtggccaagcaagaggattgcttcagcccaggagttcactgggcaatataaggagaccccatctctaattaaaattgttttttttaattatccaggtgtggtggcacacacctacaatgccagctatccagaaggctgaggtggaagaatcacctgagccctggaggtcaaggctgcagtgaatcatgatcgcatcactgcactctagcctgagtgacagagcaagatcttgtctcaaaaaagaaaagaaagccaggcacggtggctcacgcctgtaatcccagcactttgggaggcggaggtgggcagatcacctgaggttgggagttcgagcccagcctcaccaacatggagaaaccccactctactaaaaatacaaaattagccgggcatggtggcacatgcctgtaatcccagctactcaggaggctgaggcaggagaatcgaatcacttgaacccgggaggcggaggttgccatgagctgagatcgtgccattgcactccagcctgggcaacaagaacgaaactcagtctcaaaaaaaaaaaaaagaaagaaagaaagagaagaaaaaaataattttctggttttaatttttttttttttatagagacagggtctcaccatattgcctgccccaggctggtcttgaattgctgggctcaagcagtccaccctcctcagcctcccaaaatgctaggattacaggcatgtgccaccacgcctggcgataaataattttttaaaaggttaaacataattaacacataaccaagcaattctccttctaggtatttagacaaaaataaatgtccatataaaagcatatcaatcttcacagagcattattcataatagctaaaaaatgcaacccaaatgttcatcaatggatgaatgcataaacaaaatgcattatatccatgtaatgtaatattattcagccataaaaatgaatgaaatgatacatgctacaacatggatgaacctaaaagcattatgctaaatgaaagaagccaaacacagaaaggccatttattgtatgattccattaatatggaatgtccagaacagacaggaagatgattagtggttgccagaggctgggtgaatgaagggaatggaagagactgctaacgggtatgaggtttcttttgggggtaatgaaaatgttctggacttagataatggtggtagttgcacaacattgtgaatacaccaaaaaccactgaattctatgattttgttttgttttgttttgacagggtcttgctctgtggcccaggctagagtgcacgatcatggctcactgcaatctcaaattctttggctcaagtgaatgatcctcccacctcagcctcccaagagtctgggactacaggtgtgcaccaccatgcctggctaattttttttttttttttttttttggtagagacagggttgccatgctatgttgcccatgctggtctcaaactcctgggctcaagcaatcctcccacctcagcctcccaaactgctgggattacaggcatgagctaccatgcctaccccaaattgtatgctttaaaatggtgagttttacgatatgtgaattatgtatcaacttttttaaatgtggaatgacatatgcccaaagatatacattggggaaaacatcaaagagtagggtagaaaggggccgtgaatgaccttctaaaggtgaaacttgagctgatatgtagagaactaagcctgtaaatctgccttatcccccactttctctgctcccaatccttcctaaactgagaaatcacttgtcacccaaagcaacacactcactacccaaattcaaattatttcaataaaaatatgttcttcccataagaaaatgactgagagctctccagagtcctactagtggatttctattcctaaaagagaaagtgggctaacccaagtgaattatatgctgagcatcccaaatccaaaaatctcaatcctgggctgggtgtagtggctcatgcatgaaatcctcagcatgttaggaggctgaggtgaaaagatcacttgagcctaggagtttgagaccagcctgggcaacatggtgaaacgctgtctctacaaacaatacaaaaattggctgggcatggtggcacgtgcctataattccagctactcaagaggctgaggcaggaggatcacctgagcccagaagttcaaggctgaagtgagctgtgattatgccactaaactctggcaacagagcgagaccctgtctcaaaaaacacacaaaaatccgaaatctgaaatgctccaaaatctaatactttttgatgtcaaaggaaatgctcactagagagcattttggaatatctgtatactacagatattccaaaatccaaaaaatccaaaatatgaacaattctggtctcatatttcaaataatggatactcaacctatatctgattaagaatttcaaggctggagctgggtgcagtggctcacgtctgtaatcccagcactttggcaggccaaggtgggcgcatcacttgaggtcaggagttcaagaccagcctggtcaatatggcaaaaccccatctctactaaaaatacaaaaattagctggggcctggtggtgtgcacctgtactcccaactacttgggaggctgaggcaggaggatcgcctgaacccaggaggcagaggttgcagtgagccgagatcacaccactgcattccagcctgggtgacacagcaagactccatcttaaaaagaaaaaaaaagccgggtgcggtggctcacacctgtaatcccagcactttgggaggccaaggcgggcggatcaagaggtcaggagatcgagagcatcctggctaacaaagtgaaacaccgtctctactaataatacaaaaaattagctgggcacggtggcaggtacttgtagtcccagctactcgggaggctgaggcaggagcatggcgtgaacccgggaggcggagcttgcagtgagccgagatagtgccactacactccggcctgggcaaaagagtgagactccgtctcaaaaaaaaaaaaaaatctataaataaatttgttgtaactttgtcttctgacaataataaaaggcttagaaagcacatttcacgagaggtagctgggggaaaagccactagtgtggaaaagaaaaaggtgggacaaaataactgtcattgaataggtgcaaagttgagattagagctacagggaataactgtagacagaaaaattaggaccactgaagagaaactgcagggaggcagatctacaatcattatccggaaaatctttctaaaatgacaaatctgcaaacctggaattggtagcaaccagctgtgaagtacttatcttgggaaatacctgcatagagaactggaggaatcacctattatgtgaaacatttgtctagattatctctaaatctcttctatgattctacgaggaggaagaagtccagaaaaagaattgtttttgctctcaatactgctgaaagtattttttttaaaaaagctaaataccaggaacttctttaattaaaaggaacaatcccatcaagaagacaaaggttgatttgttagtcaagataatgagactgctttccttaggatcaagtatagcactgggagtgagaataggtcatttggccaggaacagtggctcacacctataatcccagaactttgggaggctgaggtaggaggattgcttgaggccaggaattcaagaccggcctgagcaacatagcaagactctgtctcttaaaaaataaataaataggccgggtgcagtggctcaagcctgtaatcccagcactttgggaggctgaggcaggcggatcacgaggtcaggagatcgagaccatcctggctaacatggggaaactctgtctctactaaaaaaatacaaaaaattagccagttggccgggcgccctggctcacgcctgtaatccgagcactttgggaggccaaggtgggcagatcacgaagtcaggagatagagaccatcctggctaacacggtgaaaccccgtctctactaaaaatacaaaaaattagccaggcgtggtggcgggctcctgtattcccagctactaaagaggctgaggcaggagaatggcgtgaacccgggaggcagagctttcagtgagccgagatcatgccactgcactccagcccaggcgacagagcgagactccatctcaaaaaacagaaaaaacattagccgggagtggtggcaggcgcctgtagtcccagctactcaggaggctgaggcaggagaatggtgtgaaccccggaggcgcagcttgcagtgagccgagattgcgccactgaactccagcctgggaaacagcgagactccatctcaaaaaaaataaataaataaaataaataaataaataaataaataataaatcttcaattctagatacaatcactcacttcctgtttggccaagggtaaatgatttcatctctctacctgagctgaaaaacagtaatttaaaataccaatattataggagtataatttaaattagttaacaactgcaaaatgctttggaaatttactttatatgacaattaagactattttttacttcatatatatattagagttgaaaaaattagcatgtattattcattaaatcagccaaatttctcactttcagagaaagaagcaaggaagagaatgctagaatgaactctgtggtgctggatcagcatcagagatatcagtataaactcatgtttatatttatatacagacagatacggaagtaaacgaagatatgtgtgggtcagtatatatatatattacttcctaactatcccctgagagggcctagaagcagtgataccctagcagtaatgagtgcatcaagctcatttagaaaccagatagtggtttccaaatactcttctccaacagaaggaaccaggacaccttggagaaatggctgattttagggttggggcaggtaaagtacaagatgagactggggcatcttacagtgccaggaagtacaaaagtgctaaaagacaaagaaaggtagggaaaggtatttcaaaagaacataggtgccaatgttagaatggccaaagctggaacaacttgagcaacaaaatacagtactggattataagcaaagaaaaaaatattcatgggtccatgttgacataaatgatttaataaataaatgggggaggcataaatcttccttacaaaaggattccaaatcataaaagtagaaagaattagaaaaatagaaaaccaacagaataatataatcaacgctgccgcaggcaagattcactaatgaatgctaaaataagtagaggaaatttttaaggagaaatcagattctgtataacctcacagttatcttccccaaaatattaactaattactttaggaattttaacatgcccacaaattctttgatactcctcccttcaggggttggagcttaattcccttcccccagaatatggatatgacttggtgactcatttctaggttctatcaagtaaaattaaaaagcagaacaacagtcactttacagtgcagaacatcactttaatcaagttatcaaagttaacaaggcacaatggctcatgcctgctatcctagcattttcggaggatgaggccggtggactgcatgaggccaggagttcaagaccagcctgggcaacatggcaaaaccctgcctttactaaaaatacaaaaattaggtgtggtggcacgtgcctgtggtcccagctacttgggaggctaaggcacaaaaatcacttgaattgggtaggcagaggttgccgtgagccaagatcatgctactgcactccagcctgggcaacagagcaagactttgtctcaaaaaaaaaaaaaaaaaaaaaagttaatcagtaacgagtcatgttgatatcaggtattcccagatatgatgtgacaagaagggtaaaccatctctatggtatttttccccaaaatgcataacctcgggctaatcatgagaaagcaccagaaaacccaaaatgagaaccattctacaaatgcatgaccactcatctttaaaggtgtcaaggaaagatagggaaggagagactaagaaactgtcacctattggaagaaactaaagaattgtgacatctaaatgcaatgtggtatcctggattggatcctgtaacaggaaaaggacatcagtggaaaacacaggaaaatcagaggaaagtctgtagtttgctcaataatattccactaatgctaatttcttaattttgataagggtatcaggttatataaaatgttaacgctaagagaaatggaatgaatacagaatgtatatagaaagtctgtactacctttacaactcttctgtaaacctgaaattatttaaaaggagttttaaactattttccatataaaaagaagtgaggaaagttataaataaaaaaatttattttttgagacagtctcgctgtagcccaggctggagtgcaatggtgcagtctcggctcactgcaacctctgcctcccgggttcaagtgattctcctgcctcagcttcccgagtagctgggattacaggcgcccgccaccaggcccagctaatttttgtatttttagtagagacggggtttttaccatgttggccaggctggtctcgaactcctgacctcttgatctgcccacctcagcctcccaaagtgctgggattacaggcatgagccaccgcacccagcataaataaatttttaaacatatttaaatatatgcaaactaataaaatattagtttacagtaagattaactttttttttttgagatggagttccactcttgttgcccaggctggagtgcagtggcgtgatcttggctccctgcaacctgtgcctcccagattcaagtgattctcctgtctcagcctcgcgagtagctgggattacaggcgcttgccaccatgccagctaatttttgtattttagtagagacagggtttcaccatgttggccaggctggtctcgaactcctgacctcaagtgatccccctgcctcggcctcccaaagtgctgggattacaggcatgagccatcatgcccaagccaagaagattaacttttttaacctataaataatcacaatagctggtcgcagcgggagtgcctgtaatcccagctactcaggaggctgaggcaggagaattgcttgaacccgggaggtggaggttgtggtgagctgagatcgcgccactgtactccagcctgggaatacagcgagactcagtctcaaaaaaaaaaaaaaaagaataagaacaagaatcacaaaagttagccaggtgtgatggtgcacatacacagtctgaactactggggaggctgaggcaggaggatcacttgaggccagaagttcaaggctgcagtgagctatgatctcccccactgctgacagaacatgatctcatctctaaaaaaaaaaaaaaaaaaggaaaaagaatcacgaaagtaattgtgttgactttcaaccttaaaatgttaatgacatccaaaatagttcaccataaggtctgcatttaaagactggcctaggagctctaaaatggtagatgagtatgatgaatatgatcccctatatgtatcagtgtgctttattaccccttttttttttttttgcaggggtgagcaggtctggctctttcagcaaggctgaagtgcagtggcacaatcatatcactggagccttgaactcctgggctccagtgatcctcccaccccagcctccagagtagctgggactatagacacatgccaccacacctagctaagtttgttgttgttgtttttgttgttttgctgtacactaaaattatctggggaccgactaagttgtttttgttttttttttaatggagacagggtctcactatgttatccaggctggtatcaaacttctggcctcaagcaatcctccgcctcaggctcccaaagtgctggaattacaggcatgagccacccagccctacaatcccccttcttaaccttaattgttctcaacccactcactcctagcaataagtctacaataacctggttctaaaagtgctgtttagaaagacaaagtgaaatcactgatacttacttggtttccttttcaaattgactatatacatgaactgccaagatgccttccactgggtcaaaatgttcctctcagattttctcacatcttaaggaaatctaaaagctacatagcaactactcacgcttaatctttaaaaaaaaaaaaaaaaaaaagcaaagtgattccaaaaactgtcaagagcaaaagtttacagagccaaaggattgatcaccaaattcagaaacaagattaggaaagaacaagacactatgagattaggaagaacaagacactatgagattaggaagaatctactctctgactaaagctaagccgcctatatataagaaaatccaggtgcttccttcactgtcagcaaacaatggaaaatgactttttaataggtaatataaatgtatttgtaaatttgaaaattttaacaaagggatgctggaatgacaaatatttgaagagactacttaaaaaacaagtgagacagagtaggaaaatgtgttaagacatcctccagcactgtatgtgtttttacactggggaaagggagactcactagacttttgttccttgattaaaatacccgtaaggccaggcgtgatggctcatgcctgtaatcccaacactctgggaggccgaggtaggtggatcatctgaggtcaggagttcaagaccagcctggccaacatggtgaaaccccatctttactaaaaattcaaaaattagccaggcgcggtggctcacgcctgtaatcccaggactttgggaggccgaggcaggcggaacacgaggtcaggagatagagaccaccctaacacagtgaaaccctgtctctactaaaaatacaaaaaattagccaggcgtggtggcacgtgcctgtagttccagccactagggaggctgaggcaggagaatcacttgaacccaggaggcgaaggttgcagtgagctgagatcgtgccactgcactccagcctgggcaacagagtaagactccatctcaaaaaaatatatatatatgtgtgtgtatatgtatgtatgtgtgtatatatatgtatatgtgtatgtatatatgtatgtgtgtgcacgtatatacacacactcacacacacacacacacacaaattagccaggtgtggtggtgggtgcctataatcccagctatcaggaagctgaggcaggagaatcacttgaacctgggaggcagaggttgcagtgagccaagatcatgccactgcactccagcctggatgacacagcgagactccatcttaaaaaataaaatagaataaaataaaaataaatggccgggcatggtggcttgcacctgtaatcccagggcactttgggaggccaaagcaggcggatcacttgaggtcaggagtttgagaccagtctgtccaacgtggcgaaaccccgtctctactaaaaatacaaaaatcagccgagtgtggtggcacatgcctataatcccagctactccggaggctgtggcaggagaactgcttgaactccggaggtagagtctgcagtgagccgagatcctgccactgtccagcctgggcgacagagcaagaccctgtctcaaaaataaataaataaataaaatttaaatttaaaaaatacccactaagaatatctagtgcctttccaattccataatcaactacctttttattactgattaggcagcccagaacaatggaggtgtcctggtcagtggacaattaaatccaattgtgcacatggcacttaatacttccaacatgcattaactggtatctggtttatcagtctctggtgagtttgtttactttgcatgaataaattctcaagcacttgaatcatcccaatgtaaaccaaaattctgaagtttctgaactactatgtgggggttggagagaccttggtttggttggataccatttttgccacttaactatctgtgtgacctcttcttcccatcagtctcaatttcctcatctgttaacaaacatagctagtgcctgggagatggcaagtgctcaaaaagtgacagctttattattttgaagctaaatttgaaaggaagtgtgtaactgaggtgaaaacatttcatttgaaaagtagtagtacggatcagcaaactacgttaatttaaaagacacagcctgaagagagatgtcccaatctttggagttgagaaaagcaaagtttaaaagttgcaagtaaagtacacactgcacagtacagatgggagtctcctgcttagcaactttaatgttgtctaccaaacacccagcttgtaatagagcatgacaactgttcactctaaatccatgtgctcagcttggattcaggattgatttataaaaatagctgctggtggtgctctttgaatctctttgggctgatgactgggcagtgttaccccaaaggcctagagcagctgtattccctcaccacacccatttctctgtctacccagccaagctgacggcaccctgcccccgccccccatctctacagcatactattcaccctcctcctgggctgagtgagcaaattacaagcacaaatatcccctgatgcaatgccacaaccatccctgggaaagagcagaggcagttgccaaaagcacagcagcagggaaatgggcgggagacgcgcgcgcgcgcacacacacatacacacgcacgcgcacacacacgcacgcgcacacacacacacacacacacacacacacacactgcaagaaacactgcaatgctatgcaaccagggagagagaatcgagaggccctggggagcaatactgtaacaggaccagagaaggcaaaggagaaaagggggtttccagtagaaagctgggtaacactaaccttcgcgaggaacacgtatttcatccgagcttgggtcctaaagcacaaacctaaaggtaatcaatcactgcctcttccccaaagcagcaaatgcatttaatttacccgttcctggaagtgagcaaaaccctcacaactcctccacaggacaatttcaccaaagggatctaactcacaccggcggagaacttgttccatgtgctaaatcacaatctctgttctgggtaatgtttccaactgcctctcctagtccctgtaccctccccacccccaccctaatgtgaccctttcgcactcccactgccagacacacgctttagtccccacacagtgtcggggcctttgcaagggggaagagccccgcctagggcccggttctccagaccacccctcagccccacccataatccctgactggacatactaaggctcacctcagcctcacatcaactgacccccacaaagcctcagaaaacgacccctgagttctcctacacctccgaaccccacccagggccccagactgcggccgaccctcgctccgcggctcagccccatccagagcccaaggcatgtcgctcggccccaccgccccgaccctcaaaagctggacctctcagcccccctcactccaaagacccccctagatcgcgcctcaaagactccgaaggtcaaagccgccagccccccgcctggccccctccctcggacgcccccgcgtctcgcaggccggcggccaccgcccttccacgcctcgggcgggccccgtggggtacccagctgccgcagggcaaggctcgggcagccccgggacagtgaggaggccgcccctccaatcggaccccgcctgcggctgcacctacccgccgccgccgagacggagctggggcagaagggagccaggagagcgccgggaagagccgtgaggaggtaggagacgtcgggaggagccgggagccagcgagctagccggaggggcggggcgcagggaggcggccgcttcctcgtcgcctcttgagggccggcgcaagggagggacgccgccaccgcctacccggcgagcgccgccgctccggccaataagcgtggcgagggggagggcggagggctgtggcggaccaatgggtgctggccctgccgccacgacgtctctgcagagctgcccgagccgcgggcggttggggcgaggtgcgcctgggggctctagcctcccgcctgcggcctgcgaatgccgaagcggaccgcaggccgatcgactgccttcgctgttctatgatggccgtcgctctctctcagagtctgggcgcccggagcgaggagagtgcgagagtcggcgcacacgcggaccgggccaccagcgggtggggcct

SEQ ID NO: 1456 - DNA, 236509 bp, Homo sapiens
tgttcgccgattcctttatttatttaggaggtgggggcaggacgcggagtaagtttcctatagggaaagagttgagaagagtctgcagggactgacctagaaagcagtgacactccgtagttggaaaaaagcagagcacatctttaagtacctggtgtgagttttgtaagaaaacctaccttatgaatgagtacagtggaatactacttagtacattcatacatgtttctaccatctcaagatttttatatatacagtatatgatctgtttttataaatgtacagcttgaaaaaagatccttcttgtagtaagtacagcatttaaacacaaaccaatatgggccagccacattctaattgaagacccagagaaagcaaagccagcagcccagcccccagcccccagcccctgacctgcttggcggccctgatggtcccggcaaagtgtaaaccagtgcccctctgtcgccctgggctcagcaggccagcttacccttggcacgtacatgggaagtgcctgctcacgctaagcccagtctgcagagggcgggtcctccctgaaggaaggtggcagagaggaatgtgtctatcaggtatggacaagagagatgaaagaaatgtgctcttcaactaaaggcacttgtcagcggccacctacagccattctctaggcctggtgagcaagcagggtgctgttttgatagaagcctacaaggtctgagcagacctcacttgtcctctcaccaggtttaaatacaataaataaatcttaatgcatggtggttttgtcctcctgggttcctatgaagaggctaccttttaggatcacttatggagtgatactccctgtccccaacccagccttttcagtgtcctccatggggaaggtaccagaatagctccaggccttggagaagcaattgctcattgtggattgtaaggggagcccctaaatatcccctcccctggtctgtgcctggagctcctctgccccatgtgtcagagtcacgggcacctcagatcttggtcacatagttgttggggaacaggccctgcttgcctcgtagtcgacccgtccaccagccagaaggatctgcagggagagagaggtggtggaagtgaagatgagaaagtctgttctgccccagccacacacactccgctcccatgggctcaagtgatttggctccatccatgttgttttccctttgttctttaaatcaaaaagtttgttgaaaaaagtaagatatctaccaaattaataaagcactcagccaagcccatggactgctttaataatggatattcaaggttgtcttcctggcttccactccatccactttcattatgaagaagccaggaagtgtgggtgggacagacctccccgtttctggggacagcccctaccaggtctcatcctctcagggtacagcctttgtcttgctactgaagttggttcagggatggacacatggctaatttggtctgatcagaataaaagtcaggacttttgtccaatgactaagaacagaagtttcagagatgatgcacatttcagacatggtttgatatgttggcctggaattgctgctgccgttttgctaccatgaagaaaaacagcttgacaagggagggaatataaataagggggcagagctgaaagaagcattaaaaaagctggtgtcttgatcagactgagcctgaggcctgacctgcctctacaaattgcagtttgaggagcccataaattcttttcattttcacactagatcttacagcaatgtgactgcatgctctttgggaggctgtcccagccaaccagccacacacttaccttctttgataatatcaataatgtcattggcattaaagctgagttcgtctgtgtcctgagcgtcataggcatacaaagccttgcactgtggcacctgaggcttgggcttgggctggggcttgggtctgccccctgctgggggaggccgactggttgtttgtctcctgaccctgtggagagagtggagcagatgagactgggccccaacagggggcagcagcaccgaacggtggtttggagcatggcggccggcactggcctgttcaagttcaaatccagctccatccttagaagacatgtggcccagggtgcagtctttaaacttgaggaataaaagtaacttttctgacaaggttgttgcaaatgcacatagctcttaaaaaccttagctgctgttgtcactgtgtccccagcatagaaggaaatgtgggagacacatatccataaaaaagtgtcaaaagtatacccatacatttaaatcaggaacattcaggtatctgtccctccttcctcaagtttcgaaatggaacttttgcaggtgccacagaagcctgtaggcatttctccttcactgcattccccccagattaccaccaccttacagtttgtattaaccattctctggctcatctctacagtttgccacacatgtaaatacccctagccaatatttgtggtccgactgtcaactgtatgaaaggaatcatattccacggtcacatgctcaacaactggatgacgtgccctgctgatgcctgcagctatcgttccttcacccttgctgcctgatactacaccactgcgcgagtgagtgtgtcacagtttacttctccagggcactgtggatggtcacttgggatggttccagttttcactattataaaaaatgctgccatgagatttgctccccattcacaaccttattatgcctcagacctcactcctgtctactcccatcccatctatccacccaccctcattactccagagacttccctcccaccagttcattattactccttagacttccctcccatccctcattattactcctcacacttccctcccaccccctcattattactcctcaggcttccctcccacccccctcattcctcctcagacttccctcccaacccctcattattactcctcacacttacctcccaccgctcattgttactcatcacacttccctcccatccctcattattactcctcacacttccctcccaccccttcattattactcctcactttcctttcacccgctcattactctgcagacttctttcccacccccttattactctgcagacatccctcctaccccctcattattactcctcagacttccgtctcaccttctcattatttcttgtcaaacttccctcccatccctcattattactctgcagacggccctcctaccccttccttattactctacaggcttttctgccctctcattattactccacagatgtccctcctacccctcattattactctgcagacttccctcctacctcctcattattactcctcagacttccctcccgtccctcattattactcctcacacttccctccgacctgctcattattactctgcagacttccctcataccctcatcattactccacaatcttccctcccaccccctcattattaatccacagacttccctctcattttatcaatcagttattactcctcaggtctccttcccattctttcattattacccctcagagctcccctttgcccctccaaaaatgttgctgtaaatattcttatacaagagtttatccagagcagtttctcaacatctgcactactgacatttgcggctgggaattctctgttgtgtgtgtgtgtgtgtgtgtatgggggtgggtgcgggaggctgtcctatgccctgtaggatccctggcctctacccactggataccagtgacactcccttcaccccactgtcataattattaaaaataactccagtgctctaaccctaatccagatcttctagctttaaagttattcttcctatatactatgctgccttaagtcaccattcatacattctttcaaaggtgtgtaagttcaacttgttcctatttagtgagatctttacacttatacctgaaacatttattaaatatgttcataaaaagcatttagcaaaaacaaaaaggaaaacggaaacatggagaacatttctttttttccacttcgcttaaggacaaaccaaagtaaaggctacattcatttccctacaaaacaaacttaagatttctccctcaagaagttgggctggacctcaacagggtggggctggctgttaggtctgtgcacatcattcacacctacaggagcaaggaggaaaagggagggccttcctggggcctgagttctggaaagaacaaccacacccagttttgagctgtgctctcaggagccacagcctgctggccttgcccaggtcctgtgatgacagatgttcatggggtgctgatgaacaacctggatcacaaaggggtggctggggggaacactgactgccagcagggtggtggactgtccccaggaggggctgggcgcccctgagactcggcttttacaccaccccacgtgggagggagcaatcctcaaggctactcaggctccactcctcccaccaccaccacccccctgcacttttctcttagtgcagaggaaaggcattttgtaggttcttagtgtgacatcattcgttttctacctagtgcctactggaaatccccattccctgttcaagaagtgcttgcttctctgaaagttggccaggcgagcaggtttttaattaagcaccctatatattgggatgtgtcagcatttggttaataagagccattagcctggataccagacgtcatgtgacttctcagcaacaaggaatgaaaggggatggcggcgggcattacaacaccctgggagggaggaagcctccagcctggcagtccacagaactgggctacaagtgcacatggaaggacacagatgcacacatgtgcacgcacacacaccaaaaactcatccctatctccctgggggactggttccaggactcctcacagatactaaactccacagacacgtccctcatatgaaagtgtaacaattgcatataacctatgcacatcctcctgtatacgttaaatcacctctagattacttataatacttaatataatgtaaatgctatgtaaatagttgttatactatattgtttagggaataatgacaagaaaaaggctttttaaaaaatataggactggctaggcatggtggctcacgcctataatcccagcaccttgggaggccaaggcgggtggatcacctgaagtcaggagttcgagaccagcctggccaacatggcgaaacccgtctctactgaaaatacagacggtagctgggcgtgacggtgcatgcctatagtcccagctacttgggaggctgaggcaggagaatcgcttgaacccgggagatggaggttacagtgagtcgagattgagccactgcactccagcctgggccacagagtaagactttgtctcaaaaaaaaaaaaaaaaaaaaaggctgggtgcagtggctcacgcctgtaatctgtaatcccagcacttggggaggccgaggtgggtggatcatgaggtcaggagatagagaccatcctggctaacacggtgaaaccccgtctctactaaaaatacaaaaaattagccgggcgtggtggcgggcgcttgtagtcccagctattcgggaggctgaggcaggagaatggcgtgaaccagggaggcggagcttgcagtgagccgagagcgtgccactgcactccagcctgggaaacggagtgagactccatcccaaaaaaaaaaaaattttttttttaagtctgtacatgttcactacagaggcatctatccatattttttctgaatattttcattccaagtttggttgaatccacagatgtggaacccatgggcacagcgggccagttgaacccacagatgctaatttgtcctgtcttgttcagggaaaaaccctagtgtccttagtgtagactgacaaggtctctggagcccaagtatgggggcttagatacagggtcctcctgctgaaggactcccctcgccagggtcggggtaagacctcttagtgggaagacaagacggatggctcctgagaggtaagaccctccctgccctgggcatcacccacttgttctgccccacctgcctccagctttgactaagacctgtttctgtccttcgtgtcttccttgccagttgtttcctttctaggacacttggccctcatgctagctcagctgttattagttcgccccatcctcaacctgaaaatctttctaacagcttctctctgctcttggaaaaaggaccaaaacccttcatggcgcctacagactctgccaggggcggcccctgctcacaccccagccttactccctgctgcaggccacattggtgccttcctacctttcttcatgagccctggttggggagaggacccttgtccacatacttcaagcttacatcatatttactggtgaaactcacaatgatttccccataagatcaggaacaaaacagggatgtcagcactcaccacttctgtccaatattatcctggaaactctagccagggtaattaggtgcaaaaaaaaaaaaaaaaaaaaaaggcgtctagattgttttaaactagagatcgtaagtctcatggaacggattctttctggtgataagataccaaattataaataagacctaaggggatgcaggacgcaaaaagctgtgtgtatgtggccactgcgtggtctttgatatcaaggcatcagaggctacttcctcaggataagtgactcctggccaaagtaaaacctccgaaattacccggggaatttggggtccataattgtccaggttgtggacaactgctaccatgctggcagtgtaagccatttggccctttatcactaggctgaatggggttcctagtaactccacaggtgagaggtgggggaggccagggcagctttgagatgggtgtggatagtggggactgtctgatggcagccgggaggagtgggcaggtgggtggaggagggaggacctctgcagtttgcactttgcattaggaagggcaacactgatgctgccaccattggctctgtcttgtgaccacaaagaggcacagctgctttgctggggcggcatattcccaaagcgagccacagtgagagccattctccctggccagcctgcacatgtctacacccttcttgtgagggctagcagacaggatgtcttctgggaaactgccggtagctgtgtgaagtctggataaactcccctcaactcagccaggccttgtcctaggcattttcacagatgctgcttcatttcaccctcacgacactcctgtgagatgactgatgcaggctcctgggatttcctgctggtttcatccctggccaacatggtggcacacgcctaaggctcctggcactgcagccacatggaatctttctggatccttggtctggctatgctcccctggcctctgcccacttcccaggcagcactgctaactcctgctcggccttcggatctcatttccatcactgcttcctcatactctggcaaacccccggccataccctctcctagcccacggcttctccagaacatgggtcaattgtagcatgacagtgacttgtgtggctatttggctaactccccctgagatggggcctcaagctctatgttgacagtgtgtagcaggagggggacgtgggcttgagtctgtgtgctgggtttggggccaagctctgcatctgtaaaacctgagcagattcaggcaatggcctaggtcctttttctttttccttttatttatttattaatttatttttatttttttgagactgagtctcactctatgacgcaggctggagtgcagtggcatgatctcggctcactgcaacctccacctcccaggttcaagcaattctcgtgcctcagcctcccaagtagctgggattacaggcgcccaccaccacacccagctaatttttgtatttttagtagacacggggtttcactatgttggctaggctggtgttgaactcctgacctcaagtgatccgcccgcctcagcctcccaaagtgctgggattacagttgtgagccaatgcgcccggcctctttatttttagagatgaagttttgccatgttgcccaggctggtcttgaactcctgggcttaagcgatcctcccaccttggcctcccaaagtgctgggattacaggtgtaagccaccgcaccgggttccaggtcttttttctgattctaggaaagttttacagagagctctcaacagcactgaggaacacaggaaatctgtgtcaacgaagccgtcacaatctctacgattcaccagactggagacctggaagccaccttggaacacagttggtgggaacagccattttcccagactccaacagcctcgaaaacccaggcaatctcctctgcgtcactaggtggcaatcctgtgtcattaatgagaagaaagaatgactttttgttttgttttgagacggagtttcactcttgttgcccaggctggagtgcaatggtacgatctcggctcaccgcaacctccacctcctgggttcaagcgattctcctgcctcagcctcctaagtagttgggactacaggcatgcaccaccatgcccggctaatcttgtatttttagtagagatggggtttctccatgttggtcaggctggtcttgaactcctgacctcaactgatccacctgcctcagcttcccaaagtgctgggattacaggcgtgagccaccgcatccggccaggaatgactttcaaagaaactgccagaaatttgattaatgaggtcttctaggcaggtggagccccctactcccagccgaggcaattggctagtccaggaggaagggattacacacccccttacagggcacatgagacccgcatgcccactgtgccagaacaggcttagtccagcttgcgagagctgatagaactttcaggaattttgtgagccagttgtcaaacatggccattattaaaaaccaaatcattgacaacaaagaaattacattaaaacaaaagcaataaatgctcatcatttatctcttcctacttctcactgcaacctccgcctcccgggttcaagcgtttctcctgcctcagcctcccgagtagctgggattacaagcatgtgccaacaagcccggctaatttttcttttgtatttttagtagagatggggtttcaccctgttgcccaggctggtctcgaactcctggcctcaagtgatccacccgccttggcctcccaaagtgctgggattacagtcgtgagccactgtgcccagcctacttattttcctctatctatgcatttgaagttattaaagtctattgctgatgtatggtagaaatactatacaatggtgagactgcccatgttttcccaactccgcactcagtagtagtcacactggtagcttgaaattggccatgaagagagaattttaccatggaaactggtaaatgttacagttcaggccttttcctccctggagtgcccactgtttaccagcacactaccatcctaccatcctaccatcctcaagctgccctcacgacagcacaggctcactcatgtctaaaaatgccttgccaacttttgtttcattatttccttattgttattatttttagagacaaggtcttgctatgatgcccaggctggggtacaatgatatgatcatacctcactgcagtcttgaacccctggacttgggccatcctcctgctttagctatctgagtgctgggactacagccatgtgccaccatttgttttataattgtacaacttagataattttggtaggtctggtactctgtgatacagtatttgtatttctaataaacatcacagaattgaaaatcgtgttataaaaataattatttcattgagataatggttgttttttgttttgttttgttttgtttgagacagatccttgctctgtcacttggccggagtgcagtggaatgatcttggctcgctgcagcctccgcctcccagattcaagtgattctcatgcctgagtctcccaagtagctgggattataggcacctgccaccacgcccgactaatttttgtatttttagtagagacagggtttcacatgttggtcagcctggtctcgaactcctgatctcaagtgatcctcctgcctcggcctccagaactgctgggattaacggcatgagccactgtgcttggctagatgatggggagttgcagcaagatttcagactcacaataacttattttttcttttgacatttcaataataaaggctcattatatatataatatatattacttatattgtatatattatttatatatgtaatatacatatgttaatatatggttataaaactatacatcactgagcaaatccagtgtttcattatatgtaatttctgtacaatccaatttagttttcttattttagggtaatttgtacacatcactttatgtgtctattaccaattaacataaatgcacgaaaaagctgacccacagcaacttctttttgcaccaggttcttttttctgagtagggcaatcacattataacccagaaacaaataacatttcctgatgaattaagtacactacatccagtttgctttgtgaaaacttgctctgcaagagaagtcctatattagtgaccagagaagaccaagtgatatacttgccccgagacatttggatgtcagctgacatttgagtcctcatggatggctgccgaatctcacaaggtgccaaaagcccacaagaaaacaaaaccccaaatgacatgaaaactctctaaactgagggctaattccctctgccctagcaatgtccatcctttccatgggctgttcattgttatgatgactgcagctcagatgtttagttagaaagagaccgtggaggccaggtgcagtgactcatgcctgtaatcccagcagtttgggaggctgaggtgggcggatcacttgaggccaggagttcgagaccagcctggccaacatggcgaaaccccgtccctactaaaaattagccaggtgtggtggctcatgcgtgtaatctcagctgcttgcgaggttgaggcatgagaatcgcttgaacgtgggaggcagaggttgagctgcagtgagccaggatcgcgccattgcactccagcctgggtgacagagtgagactctgtctcaaaaaaaaaaaaaaaaaaacaatacaaaaaaaagaaaggaagagactgtggaacggtgcagagccagaaggagtttgtgacttttcatcttcaaattgtccaaatgaggctctcatgtctagtgattattaccattactgcagaactctgtgtgccactgatgctctgtgcccacggagaacaggcacagctgccaagggtgtgtgtgtgttgggggcgggcgtctccctgtctggtctccttgtcttggcttccctaggctgcccattccccgcattacagccaacaatgcctgaagcgtagaccttcatggagtccacagctctaggcaggccagagatttgagttcttgagaataaagccactgggccaggaaacatcacctttcaaccctggtagagcattaaaatttccttgcaagaccagccaatgaataatggtaatgaatcaaatacaaaataactttcaaatagcattgtgctttatagcacacaaagcccttatttaaccttcaagaaaaccctgaggagtgggttttcaaaattattatattagtatccctattatacaggtgaagacaccaagagtagaaagattaagtgacaagcctggggtagcacatagaaggcacatggctcagtaaatattgatgaataaaagaaaaaggaaagaatgaatgaaccaggactcaccctactcttacagatgcaaatcctgtgctctctgcactctaaatgccaccttttgtgaatttctctgtagctcccacacctcctgggtgggtgtgcctagtctatgtcgggggagctaggattaagctttcgaatatcacctctttgttctgcagatgggaaatttatgtcttgaaattccaagaaggaaaataatggcattttatttcactggctcttaaaaatatgctgtgttccaaaaggttgaatctataaacattactggaaatgtggaaatggatgccaggaattcctcagcaccatgtctgcctgggccaggatatggctgctgctcccatagattatgggttgagaaatattgctattggacacttgatggaaattttaagccccataaaaatatgactccattgggaggatcttgacaagagacacacaggcagcatttaaatatttctattgacccctcctttgtggcatgcccagaagccctaccactgagcacttccaagacttttctgtttttccaacttctagttggattaatctctggagtatcttgaaatttcctgaagttatcctcccacaaaatggaccacaggattaaaaaggtcaacagacatttccagtctgggttttaatgcttccaagaatgaactgcaggtagattaggtacatttcagttataggagggaaaattacaaagcacactggatagtgagatcagagcaaaggtgggtggatgaactgtttttttttttttgttttttttttttttttttttttgagacagagtcttgctctgtcgcccaggctggagtgcagtggcccaatctcagctcactgcaagctctgcctcctgggttcacgccattctcccgcctcagcctcctgattagctgggactacaggcacccaccaccatacccagctaattgtttgtgtttttagtggagacggggtttcaccgtgttaatcaggatggtcttgatctcctgacctcgtgatccacccacctcggcctcccaaagtgctgggattacaggcgtgagccaccgcgcccggcctggatgaactgttaataggattcttgcctaacctcttccctttccttgagaaacaggaaagatctttgacctgaattaagacttctcaaaagctatgctaatcgatggcaagatcctgattcccacgcagatctctcagtgtttcctggagaatgataatgatagctaccatgtgcaccaatactgcaatgaaagggtaaagaatccagttgggatggtaattaatttagtgaaatcttcatgctctcttcagaacaactgattgaacctaaaataaactgataaagacttgcctgaattaacttgaggtgctaattacatcatttgattttatccatattacatgatccaaaataaattacagaaaaagtgcactgagggatgagagagaggaaggaaagataaactcagaatgtgaaagccaggaaagaaagaccatagtaatcctacttttatagattggtaaagtcaaggtgactgtttagaactttgatgtataggaattttcatgtttatggaaaaagtacaaacttgggatcctaaaattccctgcatgcttcaacagcctcctgtggaataaatgcaattcatgttttcttggcaaataggagaagctgttaaatttaggtaaccatggggatccataaaatgccacatccaaagtctctggccacattagatacttttaattttcacctttacatgttttagaaaataaatactaagaaaaggctgagccttttgcccaaggtactattttgtaaggaatgtttgcacagcagatttaaggttacaaagaggaggctggctaagacacagtgtgcctactaattgtgttttacatacaaggaaatcttaatgcctagcagacaggtgtgaaggtgtcctctccttccggcctcatggcctgcctccaagacagcaccacgtgtacccagtctttaggctggagggtggcaaagggtgccataagacttaaatagggaaccacatggcagagggctggaagggagcagccttggttaagacacagtgttcctaaattgcctacttttggctgacagatgctcccagctggctgatgtgcaagtttgcaacttgcaaagtaggctggaaagatggttttgcttgccaaaaccaaagtaagtaggcagctagcacacagagctaagagatttggtgcattctgttgactgcttttaataccctgcctactttgaggcatcaaactgggcctaggtgggattgtgacttagtgatgctcacccacctgaaaggtgtaggtctgggttagagagcaaaaatcccataaacctaacagcacccttgcaattcaccttcacatggaggcttccctggctttatcaatcagactacaggtgccttcagaccagtggttttcaaaatgtggtccctggatcagagcatcacctgggaacgtggtacaaatgcaaattcttaggccctaccccagacctacagaatcagaaacgcggaaagtgggccagcaagctttccagcggattctactgcacactagagtttgagaactactggtttagaccaagccaatcacgtgaaccacggtcatgagagctggtgggatatagctacttacccaagactggggggtagtggaagggaagaggagagggacacacacacacacacacacacacacacacacacacacacgcgcgcgcgcgcacgtgcacttagagagaggtctacataagggcggcatccactctactgatggctgtctgtgtgataaaactaaggtgctttcagctgggcgcggtggctcacgcctgtaatcccagctactatgggaggacaaggcaggcagatgacgaggtcaagagatcgagaccatcctggccaacatggtgaaaccccatctctacaaaaaaaaaccaaaaaaattagctgggtgtggtggcacgcacctgtagtcccagctactcaggaggttgacgcaggacagtcacttgaacccaggacatggaggttgcagtgagctgagattgcaccactgcactccagcctggcaacagaacaagactccatctcaaacaaacaaaaaaccccccccaaaaaaaccaactaaggtgctttcatatttgtagcccaaatgaagtgagataagacttgccagggcaaaaggaatgctgctaggagagaacatggtaaagctcttaagagctctgtggtctttagaaggaagctgccaaggcaggaaaaacatcaaataatagggcataaagatgaatgaggccaggcacagtggctcacgcctgtaatcccagcactttgggaggccaaggcgggtggattacttgaggtcaggagtttgagaccagcctggccaacatggcgaaaccctgtctctactaaaagtaaaaaaattaggctgggtgcggtggctcacatcttaattccagcactttgggaggccaaggcgggtggatcacgaggtcaggagatcaagaccatcctggccaacacagtgaaactcttgtctctacaaaaatacacacacacacacacacacacacacaaattagccgggcatggtggcaggcgcctgtagtcctggctactcgggaggctgaggcaggggaatcgcttgaacccgggaggcagagattgcagtgagccgagattgtggcactgcactccagcctggcaaccgagtgagactccgtctaaaaaaaaaaaaaattagctgggtgtggtggtgcgtgcctgtaatcccagctactcaggaggctgaggcaggagaatcacttgaacctgggaggaggctgcagtgagccgagactgcaccactgcattgcagcctgggcaacagagcgagaccctgtctcaaaaaacaaagcaaccaaccaacaaacaaaaaggtagatggatggctgccccctcagaggaaggagctgttgtttctcttcctgcacaggtctattttgcattcatacctcctgatcctcatttgaaacttctccatggtgctggagacaggagacagtggaaaatggaagtgggcttgagagaggggaagagaagagagagtgggtgggagcaggccattactagctttagcagacagagccactccaccatggagagtcgtgcagagctggaagattccttacaagtctctagttcaacctccatgaagtgacgggggtccttatgatcatcaccctgtcaccgtcattaccaccctcaagctagagttaagtgagcagacgcctgcatgccaagtaccatgctagagattttatgtatataatttctagtcctcccaacaagtttgctgcaagtttgatggcattacattagtgcttagacaaggaaactgaagctcagagagagcaaacagcaggtccagtgttagagaggcctctctttccccttatctaccatttgacaacactactctgaacactcctgcctggtgatccccatccacctggtgcctggatgctcccaggaacaaaatgctgtttacatacgagggcaactcatatttgggttgctacgttcttccttttactggagccaaaatctacctcctggcagagttcaccaactggctttcagttggcgctagttccatccctacgactccacaggacatgtcttaacccccttttaaaactgatagctcttttaatatctacacagagtttcaggaatcttcacttcctccggctaaaaaggctgggttctcttcaccactctttatttatattctagaaaggcagagaggctctcactataaagccacaaagacccatattcttcaacaaatatcatatagaatgctgggatgttatgcttaatgttgctgaagactcttaaagctgttgtatttatgcaactgcaggcacagacacaaatcaaaagatccattattcctcaaccatgcaagaaagcacaaagaggtcacagagtaaccatatctggggccaaggggaacccgtcttctgatgtttccaagataagccctctctggagaatgaaatgaattgtgtgctattaatgtgactgtacctttacaaataaccagccacagccccacagccttgggtcctggcatatagcactgaggtggaaaactaaaccttagaatcctgtgtattgacagcccacaggaatctctgaacccttgttttgaatgatggagatggagcttgccggcttcatccagaggatgtgagaatcttaccctgcagctccctggtccgggaccttgaggaaatccaggctctctggcgtctgtgacactcggtctgaactggtagactgctgccgaggcaagggcgggcgggccatggaggtgtacaggcttttctgattggacctctggcttccaggagcatggggatatggcacatactggtttctgatgactccgttctgatggtatcctagagagaggaacagagaaggaaataaggctcagatttttggatcctttgccaaaagtctctccacatttcttccatgtactacaagggcagcttacttaacttctgagtctcaatttccgcatttgaaaaaaatggaaggcatcactgctaacacattgtgagaattagagctgattccctgttttccccatcaccgggctttactgaggtataactgacaaataaaattgtatgtatttaacatgtacaacaatgcatggtcaacttcccgggatgtgcccggaacacagcggacactcagcacatgcttggtggcaatagaatccccagatttcctggggttcaaagcccacagtaaggtaagcttacagccggctgggagacaccttcttgggcctaagaaaaattatgagattatgactcaagagggctgacaggcagctgcttaaacagctggacatccattttcgaggggtcaatcttgggcatccacggcaggagcctgctgtgtgaggcagagggggtgctctacacaggcaagggaaaagtggccacccagttggatcagtccggatggagcaagctctctcagccaaacagcgatgtctagttaaaatcgcattagccaataagtaatgggttacagtggcaggctccaaaccatgcgtcttggcagactcgggcattagcattccatgctacgtatgaagaggcccttattcattctcccactgacagatctgggctgagtggagaaagagaacaagactcttcaaggcccactttggtgaaccctacctaaagacctcttccaaccaaattaagagaactctttggtaccagtgggatgacccttaggaaaggattaggggttcagttctggctctgcctctgagagctatactgatcatgagcaagagagttgatctttcatagtctcagttcttcatgaaagaaccacgagataggtccagaatctgcttggtggcttccagctccgacaagcattttctctatatccttattattgcagaaatatttcatgcccagtaataataggtggaattcttactttgaaccacggttttatcagggtggagctttcaagagggtggctcctcatccagccatgtctctagcaatttcctcccacaggccgtcagaccagatcagaactagacatttggggcaaacagctgctcttcatcttacctcattccctcagtgagtgagagctgaatgggctcccacagggtctggggatggggagggtagaaggaccctgcttgctgcctagggtcccaacaaaaggagaggggcatcttaggagtgtgacatgccctcgggatgtcacatggccagtgataaaagtggggtccccacaggggctgctccacatgctgctcgagatccccttgtccacgataaggtcagaaatgaagagtaagcatttagaaacgttcatggcagtttgacagatctatttcatgcctgttgcatcttataataagacattttggcttatattttatatgttttgaaaattccattcttctactaattcatttttattgtaacatacaaatacatggtttgtgacggactggaaattttttaaaaccccctgaaaactcctggtctttcaccacagacagtttgagaagtgctggtcaaatggatctggtcccattgtctcatttttttgatgaaggaactgtcatttagagagttggggagccctgctcaaggtcggaaactttgtggcctgatttgatctgaggctactttggccaacctagctgaggccagtgagctttccaggtggacttggccagaattctccactggaaccagcgcacacgcagtaatatgatactacagtgcttctcttaagttcctttgtgcttggattttcttcaaagaagaaaggaggagacagagccgggtcaaggcaggatggggactccaaaagagatgagaattagtttctcactgctgggccccagtgtccatactttagcatgcaatggtgagattccagagactaaagaaatgcccttttctggggggaaggtgggggtggatggggaggggagacagactctcactcagttacccaggctggagtacagtagtgcaatctcagatcacagcaacctctgcctccccggctcaaataatcttcatgtctcagccttgtgagtagctggaatcactggtgcatgccaccacgcccagctaatcttgagacagggtctcactctgttactcaggctggagtgcagtggcatgatcatagccacctcagcctcccacttcagcctcctgagtagctgggattccaggcatgtgccaccatgtccagctaatttttattttttaatttattttattatttatttatttttgagccagagtgttgctctgtcacccaggctagagtgcagtggtgtgatctcagctcactgcaatctccacctcccgggttcaagcaattctcgtgcctcatcctccccagtagctgggattacaggtgtgcaccaccatgcctggctaatttttgtatttttagtagagacagggttttgtcatgttggctaggctggtctcaaactcctggcctcaagtgatctgctcgtcttggtctcccaaagtgctgggattataggcatgagccactgcgcctggctgcagctaatttttaagaacatttttgtagagatggggttttgctgtgttgcccaggctgggctctaacttccggtctcaagcaagtctcctgccttggtctcccaaagtgttgggattacaggcgtaagccaccatgaccagcctcaagaaatgctttttactccttatcttggacattggtacaaatagaattctcttggctgggaagactggaatcaaatacagtctcaaaatgaccctatcagacttagaattctaaactgcttaataccaaacactctgggagtaattttttatgaactgaattttgtgagtgatggaaaaacattaaaagattttatgtatttttgcaagcattctgcaaacactacacagatttttagagacagaaaatcttagattcaggtttagagtgtctggatatgtcagttatatttttactattaaaaatgagaggccaggtgcagtggctcacactttcaatcccaacactttgggaggccaaggtgggatgactgcttgaacctaggagttcaagaccagcctgggcaacacagtgagactccgtgtctacaaagagtaaaaaaaaaaagagccaggtgtggtggtgcgtgcctgtagtcccagctactcaaggggctgaggtgggaggatcacttgatccagggaggctgaggctgcagtgagctatgatggcaccactgcactccagttgggcaactgagaccccatcccaaaaaaagaagagataaatatgaaatatgagcataaattttataacaattttgtaatactctcagatattactttgtttttttgaacaggcctcctgaatcctaatctcagaaaataaatagaaaacagatttcttctattcagtcattaagctgctataacttacaaaatagtagccccctcccctccttatccatgattttgctttccactgtttcagttacccatggtcaactgtggcctggaaatattaaattaaagttccaggaatgaacaattcctaaggcttaggttgtgtgccatctcaccctgtcccgccaggacacgaatcgtccctttgcccagcctatccatgctgtgtgtgctaccccatcatcagtcactaagcagccatcttgttattcataatggccccaggaagctggcaatttgggtatgccaaagagaagccattaagcgcttcctttaagtgaaagcgcttcctttaagtaaattcagtaacaatatatcttctatctgtaacactgtgaagacagaaaaaaatttctgctggttttgtggaaaactcaaactggaaaagtatagataggttttggtaatatctgcattttcaagcccccactgggcgtcttggaatgcatcccccgaggataagggggtgctgctgtagtggtatttggccggagctgggtagtggtggtggggttagacctgtaaactcctatttccataaagcagcatcctgtgtcttaaaagctgacaacagtctggttgttacggacaaggaactcctttctctctgtcagaagcctttcctaagggagtaatatttcgaggtaatgaaatccagattgcaaactcagccgcagttcagtctcactgactcctatttttctgaattttgaggtctcaagtagggctgctgtgttgtacatgtggcactgaaatggtccatgcctggttaatatgtgtgcattgatttgctaatgggtttcttcccaaacatattttataagttatgggtccagatttagtggtcccagactacggtacgtagctggcttacctgggggaggaggggcagctctcactgggtagttggcattttgagtcccactggaataacctgtattttgggtagtgttccttctggtaggacctgaaataaacaagacaaagttaaaaccagtgctactggttggttttatggatcctcatggttctttgcatatggaaaatttttgagaagcttggattccagctctcaggtggatctgcaggagaacagttgcagtggagaaggagccgttgagggaagtatgtaatggtagctattgggtgggaggggctggaggacagggttatagaggtacagttttgaaatgttagagacagtggttcttaaagaaggattggtcatcttacaaaggtgtttctatttttacagacttttaaaagagacagatggaacatttaaacatttgcattcatgttctaaatgctaagtggctgagcaggttcactaatgctgcggatcaacggggttggcatgaagcccgttctggcactgactgcacacctgcctacgtcaagcgccttgcacgcaagagtgtgtgttctacggtccttgaactaaacacagaccacaaggaggagaagcagacttgtacccttgacacagacatgaaggaatgaggaacaagctggggccaaaggaacacactgtgggtcacagtcagggctggacagcagggccagaggagccagaggagatctctgcagagacatctatgtggggaagaaaaacaatagggtcttgaatggaacaggaaggaaggtaggattaaaccagctggaagaggggtgcagagggaatttcttataaagagaagagctgaagaatagagaagggtaggaggtgacaaggtgcacagtgcaaacacagcaaaggagctgcagctctagggcctgggagaaccgaccacgtgggatcggggcaaacccagtgtggcctgctggacgcttccctcccagtacctaggccactctcgccaccccaaataagatagaatccaacacctattgggcaatttcccctcgggggcccgccgcacaaacatagcctgctggttatttgcagcctttctttgcccggctctgtgccctggggtctgagtcctgtggacagccaggcctctgccttccagtggggtgaggcctataggccaggccaacaggaggcactggaaggagactggagtgtcaggagggaggtgggggacttcatgtgcctccttcctgactgtagccttcagttcacctcgttcctccctctgctgcttcaggtttgcggataataatgatttcctgccactccctttccctgggtccctactttgttccctaaaccccgtccacatcttttcactgaaaaatcgcttcagaaatccctccaaaagttgctgtctgttttctgcaagtactaacggatacacagacatacatcaacattttctgagtggctctacatatataaagatatgatggcatttgctggtattgtattaatatgttagagaacatgttaaggtgtacctttgcagacagatttgagaaatggctaattaattaattaatttttgagatggagtttcgctcttgttgcccaggctggtgtgcaatggcgcgatctcagctcactgcaacctccacctcctgggttcaagcaattctcctgcctcagcctcccaagtagctgggactacaggcatacgccacaacacctggctagttttttgtatttagtagagactgggtgttggtcaggctggtctcaaactcctgacctcaggtagtccgcctgcctcggcctcccaaagtgcagggattataggcatgagccaccgtgcctggcctagaaacagttattttatataaggcatcttcatgtgtgtgatcacacacaggctaaatcttagaacaatatcacagtatatgcatacatagcatgtatgattattctatgctgtgtgctatagatataagtttataaatatcaattataaatacaaaaataaaggccagggaaggagttagactggggtttgaggtagtgcgtgtgtgtgtgtgtgtgtgtgtgtgtgtgtgtgtgtgtgtgtgtatggtgttttatttctttttcatcttcttttttttaatgaggcagggtcttgctctgtcacctaggctggggtgcagtggcaccccagtaaagatcatgatttactgcagccttgacctcccaggctcaagccatcctcccacctcagcctccggagtggctgggactacaggcatgcaccaccatgcctggctaatttttacatttttatttttgtgtgtggagacagggttttgccatgttactcaggctggtctggaactcttgggttcaagcgatcgtccggccttggcctcccaaggtgctgggattataggtgtgagccaccacgccgggcccagtcaatttctttaaaggtggcatagaggatgatgttggtattgtggacaagatctgactggaaagggaggggaaatttgaagctaacaaactttgatttgttttaaccacaatattgtaatgccaggtgtactgatacataagtactaagtccctcagaaacttttaacctgctcattttccttgctgttgctttagtttgaaatgttccattctgaagaaagcgtgagccccagcaagcagaaggtgtactgattctcagcccccacatctgtgcacatgtttgcagcatttgctcgggagactcgggggagcggcggcagttctgcctgcagggcccgtggagcacttacgggagttcttgggcagtccaggtccgatgctgacctgcagcactttgttactgggcttgaggacagccaggtccccaaacccttggtggaactgcacttgccgggagccccctgcactccaggggccccagttttcctttttcaacttcagttcaagcctgcaaaaagcacagtggggttaacaggtcgaaggacgcagtgagaaaacggtgctcagagatcccgccacggagttctgctgctggaaaagcataaacatgaggcgagaacggacaatctacaccaggagcagggccctgaggatgcgcaccgcatccatggggtggcactgtcgctgcatgacaatgagccagaaaaaggagcatctggggcccggtaccgtgagacaccaggtggtgagggaggtacatctggctaatgtgccagtgccactctgtcaggtggtctcagaggcgcctgctgaggggacagaggaaagagacaatttccaggtcataccgctgtgctgtcattgtgcttccagctgttgtccctgattctgtgcttgtggaggactgagagatgccagacacaggccagcttgaggactctagcatagaacctggctttgtttagtcctgtactattcttgcaccatcacagcccacccagggatggaaaaagacacacactagcaaccaaaatccaaatagaaggcaggatttacctgcaattcccaaactccccatccagttttaatgcttctatattgcatatatgcctgtattatgcaatccttattctgtttttaagttatattttctgatatcataagaaggaaaaatcataattttaagtagctgcctattataagtttccctcatcatgatataaaggctttgtcttggccttatttttgtagctaggaaaagatggaggatattcccattttatagatggggaaatttaaaaagaaaagctaaataactttctttctgtgttttagacagggtcttgctctgttgcccaggctggcgtgcagtggtgcggtctcagctcactgcaacctctgcctcctgggctcaagtatcctcccacctcagcctcccgagtagctgggactacaggcatgcaccaccatactcggctaattttttttttattttttactttttgtagagatgtggtcttactatattgcccagactagctaaataactcttactcagcaaatatgagattagagggtcaacagtatgccagccagtacctggtccattagatcatgttgccaaaagaaatgaaggtgaggctgggcatggtggctcaagcctgtgatcccagcactttgggacgccgaggcgggtggatcacttgaggttaggagttcaagaccagcctggccaacatggtgaaaccccgtatctactaaaaataagaaaacattagctgggtgtggtggtgagcacttgtaatcctagctactcaggaggctgaggcaggagaattgcttgaacctgggaggcagaggttgcagtgagccaaggtcgcaccactgtacgccagcctgggcaacagaacgagacgccatctcaagaaaaaaaaaagaaaaaaaaaaaaaaagaaagaaaggtgaaccacctacacaatacgttggccacctatagtcctcaagcccccggaggctctaccaataaacaggttttattatgcattggtttggggaatttaaacccccacctctgtcacttttatctgcttccagtgtgattctactcctgtctgctctcctaaattaaaaaaacccttttttgggtgatacataaaaatctgcctttgtctgcctcattcaggtgatttttgtctaaatgataaaatacactagtctatgaagtcattatttcacagaaatgcaaaagtaaccttttcaaagtctgtgactactatccagactgtcttctgcaggctctaaggttccactggggccagccagaccccactcttctcctcgcaggcctcctccagccccatcctgaatcgcaggggtgcgatcaagacccctttttagctacacgcagaagtctgggtcccagatccggacttacgtattgctgaatttcagaggtagttgcttctgggtcttctcctcgtaacgctttgctaagaggcttaggaattcagttttgaagacagattcaagcaaactgtcatactcttgctcatggagaataaaaatgtcatcctgcatagtactgtaaagagattggacaaacacacttggtgaaagctgtgcttctgtttactctattgttttttttttcttccattttaaaaatcctgcaagatagtgctaagattttacagtctttctttctataagtaataatctttcaaacaaaaccaacaacaatgaattacataatgaaattgctgaaatctgctttcaaagaaggtttatagtccaacaaaagcatgatcaaagtactttttccacatgatttttacaatcaggaacttaaggacaatttagcccatattaaaaaaaaatccattttcaagtccaacttgtgtttttaagatcataaaaatccagaaagttatgaatagaatgcagttgaaaagggatgactctacatttaagttccaagttagtataatttatgatatggttatagctattgtagtaaatttgaacttgaagaatcataagctcggttctcaagagggaagccaatatcctggacttcaaggtacttattaagaaccttctggcaaacagtgctctgtggacactgtaggccaggagctactagaacgtacagacacatccaagttcagaaatgcgaaggccagaatggacaaacagcaaacaagcaaaaatcatcaccttcaagctaatgaattttgtcagacaaggaaagaacacacctttgcgggaactgcatgtttggacagggtgggattgtggagaaatttatgcctggaggggagcaggtgttacaagctatagggtgatggcagagagacgctgaggcagacccagctccgaggaaacgcttgctggtcaggggaggttgatgagacaaagttccatcttcaagcctggctaggcttggtagaaagcaacaacatgtatgtaattgagaatttgcattccctgttagatttatcactcaggtgaatggggccaccaccccaaagactataatatataagtttacgagtatctccaagtaccactgccaaataccaaagacaaccctttgaagaatgagatttcgttagggattgtaagcattttcccaggcattagaaacaaattaggcaaacctgcttcagtgaattgaccatggtaacattttattctctccaagtgccacagacacggttctttgtatatccagagccctgcagcatcactcaggagctctgctctgctctcagagcacctggtgtcactgcaccagtgggattactgtggctgtgacaaagccagatgatgaggcaaggggatcacaagaggactgagctgtggagaatctttgagaccctggatccttcttccatgtaaaatctgatccatttagaaggaaactcctgtggtatccctgttcagccccattcacaggtcaaggtaggggttgggcccttcttggaatgacagggctcccttgggcagagaatcttgggggactatctcaggcttgtcaggaaccttctctccagactgagacagggagctagtgacccagaggtgatggagccagtagctgtagccacagcctctaccttggtctgatgttgaaactcattcaccaatgtgctagtattaagaagtgtggccttaaggaggtgattaagttacaaggaagaggtcctcatgaattggattagtgaccttacagaagaggtatgacagagtggtttgccctttctgtcattctcccatgtgaggacacaacaagaggcgccatctataaagaaaagactgggccttcaccagacaccacatctgcctgcaccttgaccttggacttcccggtctctagaactgtaaaaattaaattcttactgtttacatattacccactttcagtcctcctacaggaaaggggcttggtaatccacaggagaaaaagaggtcgaaggaaccacagcacaattggataggaaggcgtagaatggcagtacgcgcaaaccatgggggtggggcggggcggtgaatggagttcactggaagcaagaggccagtgtcaggggaaaggagcttggtcctttcatggccagcttactgaagagcagccaaagagtttcccttggacgtaaagtcagaaccctttacagtgttttttggacaaataatagccatttgggtggaacacttggtcattatcattacctcagatgtttgttttcagacatccacacatcatagccatgcttcttgcccactcctgtgatagttgggatcaaggataaaccctgacaagcagtggtttaaacaatagacggttttcatctccgtcactcaacagctcatgcaaaggcaattcagggccaacgtgccagttccatagtgcctgggaacaaacacctcctacttacctttaaaggtacagccagcaatctaaaaccccaaaaagcacttatgaaaagctgctcaaaagagctcttccaagtcattttgaattaataaagtctaagcctcctggcaccctagcccaggtgtaagaacccggctgcattaggtagagtgcatgcaaaagaccagagtaaaacaagaagctccactttttggcctttggggtgaggaatgaaacgccttcctgttttggttgtttgctcaaagctttctttggcatgtctggtcatgcctggtggcctggctgaactgtggcaggatggtgattattcaacagggctaaatgagcccaacacaagtcaccttgagtggtttaatgggcttagatttattaggagtttcattactattataacgaaaaaagcaagcaggccaaaacttcaaggtcaattatcagcatgaatctagaaatgagaagagatgtgtttggacactttgactttaaccaacaactccaaaatcccctcccttcaatgatccaggcattggagctaggcagaccaccttcacccaggccagggtctcagctcattctgctctccttagcccacgctcctgaacctgaaaacaaagctttcgtgtttatttattctaaaaagtcagacttatctttggacttcacccctgacttattcctatgctgcaattccttacagatgtttgacgctgtaagctgtgttgaaagacctcttcctagtctctggtttggatctgcccttgtttttttattcctctgtctttgcggcttactgttgtattgctgaaaacactagaaaatctgttttactctcttcaccaatatatcttttcacagaaatgttagttacaaaacaccaaggaaagtcctgaaggagttttgttttttttttttaaagctgaaaaggcaatttccaaggatagccctgcctttatttaagcttttataaaagtctttcctgattatgaaatatatgctgcttttaggaaactggaagatacggaggcgaatcaagaagaaaataaaccttgcccagaattctaccactcagagaaaccagtggcaccagtttcagaaccttcttaacttctctgagaaagcccggacgcagatgcaggcctcagcagtgacgtgtccagctcaaagaagcttcacctgacccgcagatgcaaagacccactctcctctcttgtgtcccaggaatatcctttaaatcacgctgggaacacttatagtaaggcacatgtttactcagctgtctgttcccccttccagaatgagaggagcttcctgaggcagtgactgtgcctcatccaccttcgaataccagggctcagcaccaggtaggtgctcaatcccatgatgttgacaacttccaggttcccaatgcttacagaccatagcaagtcaagatgccagtaatgcttcaggtcagcaggacaggcagtgaagcgggctgtttttattgccagaaagtttaggggattcaggcaaggagacattctgggcaagaatgttgtgaccagggagctggagcctctgtctaaaagcaccgtcttacgggttgtttttccaattggagataagtactggaaaatctattaacccagacagacagccacacaacttttggtctcatccttctggtgatcagccaccagaatgagaagaaaaatgagaagcctcatcagagacccccaaataagagcttccatggcaccgaactcaacacctacaatagcaaagccaagaacatgggtcattacacctgtggtcacccttcctgcaattgagtttttcaaataagagtggggccaggccagtacttgaacaagaagcaactctgggaggatccttcaaaaacccaggcatggccttctgccagcagccaccatacactcagaaatcccgtgtctcaactctgtattggtgtgtcacctcctgacactcttcccgagtctccaatgaagccagaaatgcaagcgtcagtgtttcactttaatttttatttatttatttattttgagacggagtctcgctctgttgcccaggctggagtgcagtggtgtgatcttggctcactgcaccctccgcctcctgggctcaagcgattctcctgccgcagcctcctaagtagctgggattacaggcacacaccaccatgctcaactaatttttttgtatttttagtagagagggggtttcatcatgttggccaggctggtcttgaacgcctgacctcaagcaatcggctcgcctcggcctcccaaagtgctgggattacaggtgtgagccaccacacccagcctaatttttatttaaataaggatttttcctgatcaaattatcctggagtccctttgacaaactattgtcttaatatctctctgagctattggccctatttctacctgttgggatcctattttttcttgtaaatgaaaacttcaaaaaaatttttaaccgtaactcaactagacatatatctgtatgtttagaaaagataaagacttctaaaaatttaacatctactggaggattagaaaaacattttattatggaaaattctaaattgtaaacaagtaggatagtagggccaggtgcagtggctcatgcctgtaatcctagcactttgggaggcgaggtgggtagatcccatgagcccaggaattggagaccagcctgggtaacatggggaaaccgtgtctctacaaaaaatacaaaaattagccagaagtgggggtacatgcctgtagtctcagatacttagggggctgaggtgggaggattgcttgaacctggagggcgaggctgcagtgagccgagattgcgccactgcactccagcctgggtggcaaagtgagaccccgtctcaaaaaaataaaaagtagtatagaatgaaccaccacatgtcagatttcaagcaccaattcacggataatcacaattatctacaacctcactctccctgcttccactttaaaataactaccaggctggagtgcagtggtatgatcatgactcattgcagccttgacctattgggctcaagcaatcctcccacctcagcttcctgagtagctgggaccacgggcacgtaccaccactcctggctaattttcacattttttgtagagatgggttcttactatgttgcccaggtgggtcccaaacctcctggggtcaagcgagcctcctgccttggtctcccaaagtgctgggattacaggcgtgggtcactgcgctcagcctttatttcatgctcaaatgtttcagtacatattattaaaagataaagtctctttatattaaaattaaccacaaaacattatcatacctacagaaataaacaataaattcttcataccaaatatttagtcatgctcacatgttgtcttgtaactgttactgaatggttggttggtttgaatagggagctgtaggcccactgtgcactgacattaattgtaagagctagagatgggctaagatcaagcttatgggatactttgataaatcgtaactaggaggccatatgttgatatcattccagccaatagtcaactggtcaatctcagaaattcttaaaaacacatacagatgttgcagcttttttcctgaagtacaagccaactgttaaaatctttctctatgccagtactgaagtattttgagaacacacacgcatgttcagtagtctggtaccagaattaatttccactctgggttcgattctgcacacacatcaccctctggttgctttcctaacttggttctgattactggcctaactcaagtataaagaaatgaggggacactattattcatcttggcaagtgtgaggttcagtgactgcaatacacagacatcacaagttcaaatgactcacactttctttttttttccttagagtcagaaaaacttttaggctaagtacctcattttactacagcctttaaaaaggaaagaccgcaagaaaggaaccttccagataatgaatactgaacaggaagaagaaaaagaagctggtgctcccatgacagattatatccccagaggctgtaaaagaagacaataaacaaacaaaaaacaataaaaggaagaaatttgagtgtgaacagtccctacagtccctgcttgacaaccccctcaaggacttatcaataagatagtaagtgtcaaagtgcttgatacaagtgtagctcaaggccaggcacggtggctcacgcctctaatcccagcactttgggaggctgagatgagtggatcacttgaagtcgggagttcaagacgagcctggccaacgtggtgaaaccttgtctctcactaaaaatacaaacattagccaggggtggtggctcaggcctgtaatcccagctactcgggagcctgaggcaggagaaccacttggaccagggaggcagaagttgcagtgagctgagatcacgccactgcactccagcctgggtgacagagcgagactctgtctaaaacaaaacaaaacaaaacaaaacaaaacaaccacacaaatgtagctcaattaggataatttatggtcccagtcatgagcactccaccaggggtctgagggactgaagacatacctgggcaataacagaaagaacaagtcactctcggcacagcgactacacacaccctagagctgtggttccctgactttcacctgctgtgcctgccaagcacgctgtggccaacctggcttagtccaggcatggcagggccccatgcaatgacaaacaaagcaggagcttcctgttgggtttccacggcagcctcagggcccagctagccaggaagagtgtggccagcaggcactgccccgctcaggttgggacccagccagtgagctgaatgtttaggaaggccttcagaaaatcagtcagcgcctagagctttaaaaaaaaaacaaaaaaaacaatagccttgaaacctacctgaggtggggctgcaaaatggacactgcggactcatctgcttagcaactttaccacatcctgagttggcacgttttaaatacttcactgcactgcactgcctggtcctttatccagggaaattaggaacagatagaatcagaaaccacagagacacaggcaagaatggatgcaactagaaatctgttttggattatcagactggaactaggatttccagcttggtacatcagacgcctgagcacataaaacccctgctttttcctgagcgcaccagttttgccttctgtgtggagtaagagtttgacaggcgtcccaattccatgttcatgtgagagcagaacatctttaatgcaaaggcccaaagcttttcctgattaaagtagtgttagcctcagaggcccagggacacgattcttggaggaagctatggggctcaaggaggcctttcttccattcttagtcttcatggattgcgaggatttcctgtgtcagcggaacttagtctaggagttcttaccatgggaggacttcgggaggacttagcatgggaggactcctagtctgggagttcttggcatgggaggacttcttagcatgggaagacctcctatgctaagaacccctagcctaggtcccactgacggaggagatgctgacggccggcagaggagcccttctgccgagaggaagccaaggtgctgccgggaggagcaagggcccttcctgaggccttgtggaagcaaacaccactccccactgcctgagaattggagcgaagagagcatctcacgatgactccagggctacagagaatggagaccaacttgcactccctaaggaagtcccaaagaaacttccctttcaggaccctctgctcagggaaatgggtgaggcctccaacctgggtgaggtggactgggggacagggctctgaatccttggctctactgcaacaagagaaattattctctgaggtgttccatataccgggttcatttctaacacgtttcggttacaagagatctgggtcccccttgattagaggagctgtccggaggcaaccttttcttggtaccttcttcctgacatatcaagacttgctgagactagggagtcttccctttgggacaaagggaaattccattctcttgatcatgattttgacagctgggaagcccagcccggccttcctcctggctgtttggaacagcggaccgtgatgctgaggcgagaaggggcagtcctgcctctgcacctccactactcacctgagggacacagacaagatccgttctatctcgattttccgcttcaggacttctttcaccaggcccttgtctgggccctgtttgactttttctcgtccgattaagtacaagcactttggggtaaggagcaggtctcgctttacaccctgtaaggagaggagctttaagaagctggacaggccaggcatggtggctcacacctgtaatcccagtactttcggaggccgaggcgggtgaatcacctgaggtcaggagttcgagaccagcctgaccaacatggtgaaaccccgtctctactgaaaatacaaaaattagctgggtgtggtggtgggcgcctgcaatcccagctacttgggaggctgaggcaggagaatcgctttaacctgggaggtggaggttgcagtgagccgagattgcgccattgcactccagcctgggtgacagagcaagactccgtctcaaaaaaaggtggacagacatggtcaatgtgatgacaacaattcacacagtggactgctgttaccaggacagggggaagctgccttggacagtcaatcttcactactgttgagaggccattccattcatcacatgaccgggccccatgacagtgaaagagggcattgttcatgattattaggatgacatgtaaaaaatgatgacatttgactctttttgacttaaaaactggcaaactcatatggagtcacttcacatatcaggacagcaggtgtaaagggaaagtcaccaacacctgtggtgaacttagcaaggatgcactacagcatgtttctaaacagggggcagtgtctgcatatattttcttgggagttcataaaattttcattctaaaatactgatatattgtcatttgaatgataattctcaataatctaatagaaatctacttgggaatttgtgggtaaccactttataatgagtaccgctgcgagagctaagcacccctgtgtgcatccagggctgccgtcacagcagctggtgccatgcacaggttgcaaggaatggtttggttttagcaaaacatgcttccgttgtttatttcgttaaatttttttcttgacctccccgcccctggcaaaaagccaaaagctcttaacgggtccatgagcttctgaagcttcagatttttctattaggaccaagactttatcaaaaggtatctaaaggaggaggtgaaaaatcaactgttcctcctgtggctggaaaagccttacttatcagccactctgggaaaatggatgaggatactctgcaatattacttgatactctgaatcctttgattcaacgatttcactcctatcaatttcttctaaaaatattaggagacagatagatacacaaagatgtgtgaaaagatgctcactgaagttacgatagtaaaaaagaaaaactcactaaaaattgattcatgagaaactggttaaaaataataaagcatctgtcaaatggaatactatgcagccatgtaaaataacttatattgctaactgtattactatcgaaaattctcgcattatttaaaagacaaacaaaaaaccacttcaggacataaaacagcatgtaatgtatatctcattttttgtaaaactaaatacgcaaatgtatgttttcataaaaacattctgaaagatatggatatacacagaatgttaacagtgaatgtttctgggcataggtgcctgtttatcttttggtttactgtattttctctaaatttttctacaacgaacacattctgatttggtaacaacaaaagcaaaataacaagttattaaaaaaataaggaatctgtttggtgatctcagaggcaggcagttagcacgtaccttgaacctcctgtcatacttggtgactgtgtctgcgaaatcaatcttctccctcttgcccacgaactgctggagttctgggtgctcttccatcccaatataatcccctataaagttcctgttaatactgtttctccttctctccttcttgttcaataagaggtctgaggctacaattcccaagagggtcaagatggaagaaggataagtcagtcagaaaagggaggaaaatactgtggaaatatacaaagaaactctaaatgatgcaatatttttagcgtgacattatatgcaaaataaaatggaacttaaaacttcacttaagctccaatttactcttcagatttattaaaatcaatgaaacaaaattgctaaaataccttcttctctcatttgaacgtatttcttccgggccacgaatttcctccatgatttctgtatcactcgagcatacccatcatactttctctctctcatctcttctaaaagaaatagctgtgaatggagagaagacaaatgtgagccaagccccaagccccaatccctgaacaacacttttcttgttattccagggaccctcagtttagacaatgacacacacgggaagcagcttctctgattcatgaacgaatatgtgaaacgcttactgtggcatgttgtttattctcactataaaatgacctatacctttttttcttttaatggaaaacaatgggaaataggagaatctgagtgtattcagttagaccttgtcctgccttgctacagtctctgtgagaatcgaatgagcgattcaatgcttctccacttattccccaccttgatccaaagagtgtattattaggaagtcagatcaagtgagtgggtggaggctgttgctgttgtttggcgcggcacttctgcatgcagcctctaaacagaattttccagtttctgcaggagctgggcttgtgctgctgtggaaggagggctgccctactttcagttccaagaaaatatagacttcctgtctcaggattcaccaatctcaggattcaccaaggaccagcggagcagaggataataaccacagtgactggagctggacgtgaggtgtgttaatgaggacttgcatttgcccagaaaggctggggctgtttagggaccacatcagcctctagcaggtcttgagagtccggccattttaccaatgaatgctgacagctgcgcctcaaccaggccttggaatgataaaggtgacagcaaacagctgtagtgagccgagtgcccactatggggcagaagtcaccctagatgatttccacacagtttcattcaacgcctccacagctacatgagccgcatactctgtcatctctattttacagatgagaacattggaactaagactgggtggggctagaaagtgaacctaggtctttcaggctctgccaggctcctcctcatttagacacgcaaagctttctctgtaaatctgcacttgatccacttgtaaaatagtaggaaaccttctcatttaccttgagagtggcttacatgactctctaggaaaaaaataaaatcaaccaataaaaatccaaagtaaagatgatgaacagtcattgcaaaaatgttccagaagtaaacaagccaatgtggtttgaaggcagctgggcttgatttgttgtctctgtttatccgggtgcatgcttgggagacagacctatcctctcctgccactcaacttctctcctcacagatccatctgtgcagaaacaacaactcaaactccaaacaccaggggagggaccacgtaattcccctggcttcagtgctgtaaacaataggcataaggacagatttctaaaccccaagtggaatgcacagattagcaactggacagaatgtttaaaatctgagccctgcagttgcctgttgtaagaatatccattgatatttcttatcttgtgtattgggtttctgagtaagtcttgtttccttcttctttcccagaactattttgggcgtatcacagaaaatacacttgtgactcagagaaaggatgaacaggcaaacgattcccaacttcctagagactatctcaaagattcgctggattttagatttctttttaaaagcccagggggttagaaattagggaggttcaagaaaaaaccttgataacacagataaggagagaataaaaaccaaaccaaaccaaaaaacaacaacaggaaaacacacaaaacaaccttaaatgagaaaagccaaaagacatggatacatttaacaaaacaaaaacaaaccctatggtgtctgatgtgggttttgttgttgttgttgttgttttccgaggcagagtcttgctctgtcacccaggctggagtgcagtggcgcgatctcggcccactgcaagctctgcctcctgggttcacgccattctcctgcctcagccacctgagtagctgggactacaggcgcccgccaccatgcccggctaattttttttgtatttttagtagagatggggtttcgccgtgttagccaggatggtcttgatctcctgacctcgtgatctgccggcctcagccccccaaagtgctgggattacaggcgtgagccactgcgcgcggttatgatgtgggttcttaaagcaaataggtaattttgtatattcagaacatttactattaaggtgaaaccacatggtaggttttctttttccttttttttttttttttcttttttttagagaaagggtctttcttgatctgttgcccaggctggactgcagtggtacaatcatagctcactgtaaccttgaactcctgggctcaagtgatcctccaacctcagcctcctgagtagctaggacagcaggcgtgtaccaccacacccagctaattttaaatttttttgtagagaagaggtctaactgacttgcccagtcttgaactcctggcctcaagtcatcttcccaactcagcctcccaaagtattgagattagaggcatgagccactgtgcccagccagattttaagagtcaacttttgtgaaagtatttgcatgtcagggctagatggggatgtatgcgtttggggcaggggagagagcggaggtgatggtgtgcgtgtgtgagtgcatgtgtcaaagatgggggaaaggagagtcaaataatggtaataacacaattgaatgtaaggcaaggaaaaggacagccaaaaataaatcttgattttgaatataaccccctccaacgcaactgaagcagaaaaaaaagtattacaaatattgaggctgttttaattatatatgaaaacctcacaagttgaaaagtaacagcgggtatgaaacaaggagttctgcattgtaccgataaatcactccatcccattttagaaagaacaggaactgttctgtgggttgcttaatggcgaatgacacaacattttcactttatatttggaaatgaaaattcttgtgaagctacaaataactcaaagtagaaaaatgctaccacaaacgtgtcataaatgggttccatctctgtgtgccgcttatttaataatcttgatgtctcacaaagccattcagttatagccattatcattcctgagtctcaggctgatcctacgaggcaggcagaaacagtggctatggggcccaccttagaggagaagaaaactaatggcaagactgggatctgcctgaagtcaaatgcttccctttttactgtgagttcccatatgatttccccttggtctgatgactgatttctgccaagttcatcactgactcttgaaataggtcttgtgatggttaagggagccttgagaaacgatgatgctgagcctcggttccagcagtttctccagcttaaaaaggaatgaatgtctttattccgcagccctggagcaaactgggcagaagaactgaacagaacttcctgtggacattcatggggctcactgaccacactctcatcaggaaagaaagaagtgtctctaaatgaagctgtagcagactgtttgtgaattgtaaatgtgtattatgaatgccttactggtaagtactgtgttctataaaccagagatttctcctcccacctattttccccctcacagtcctttctaggctcccccacagccttctaggtacaatcctgggaattcccacccggcactctgctgcaccttccaggaggaatcctgagactatgcgtaactgacttggtgtcaactaaccatgggtgggacactgaagtccctctttagcttagacactcttagagattaagtaactattgagcattttctgtgtgaggctttgggtatataaacacatatggaacaaagagtccctgccctccaggagtgtagcagctagagaggagcgagacagtcagcgaggaaggagccactctctgatgcccctttttctacctgcttagtgctctgcaggaaatgaaccgggcagtgatgggctatggagagcaggtgtttagggaaggacccacttagaccaggaagggagggaaggcttctttgaggagacaacattgatggcatgaagcgaagaatgagaaaaagaagccagctgaggggtggagcagggctggcgggggccccgcgggagggaagagagtggagagccagccaagcactcacagactcgggggctttgatgaacactttactcctccccagctggaactggtcgctgtccatgttgaccgactgcagcaggtgcaggacgccttgcttctcctctccctgccaagaaggccaggtggctttggtcagaatggcatacctgtggggacattggggagaagagaatcacacttgggcgggaccgcactggttttctacccgggcaaggcagcaagagctctgctctgaaggtgcccagtgctgcaaagttactgatcatctgtttaccagcgttcgaaggctcaggcgtggactgcgatgactgcaaaaatcccgagtctgggatgctcgttcccgagctgcctcctgcttctttccctttcccagcattcccacgtcaacaccctggtgaaaacctgcgtactctttctaccactgtctgaaaatagcattgtggaaggccaccaggggtggtctttaggcaaaaatcaaacggtcttgtctcaataatcatctcccctgacttcttcagggcatttaacacttaatgcaaagagttttataaagctcctgctaaacagctattatgacaactgtgtatcaactttcacctttgaaattctgtgcatctgggtcacgaggcccttgggatctggtcgttggctgttctccagcctcgcctcttcattctcactttggcttgctgcatttcttcgagaatggcctcttcttcatgcccaccatgccctttccttcctcggcgcctctgcccctgctctcccctctactggtgtgctgctccccaaactcatcactcggctggctcccgcttgggtgtctcaccttcagtgacactcccagacaggccttcttggaccaaaaatcaaaaactgctctcttgttagtttctctcatagcaagtactatttttccttcagagcatgtactctaattggtagttatattcacggtggtgtttatttggttaatttatgcctcccagatgaaggtgagagctccaggagaccggatgccacatctgtgtggctcctgctgtacatccagagccttaaaccgtgcctggcacacagcagtcataatgaacattcctggctaatgcggatgggtgctctctctgcatgaggtgctgtgattgaagcttttgatgtacgatctcctcttactcctacagcaacctgatcaggttggttttccattttgcagagtaggagacagaggcaaattatgacttgcccaaggctacttagccattaagcgtcagagatgggatttgaatccctctctgtctctttcatgatggcactgtaaaaaagccatggactggttcacatttaaatatttcttttaaagattatccagtctactatacatgcctatgttagaaacattactattatgtcagaggctgatataatcaaggagagacaaacacattacagtttgtcaaatatggatagaatcatcatgggtatgtgtgggtgtgaagttggagggcgtggcccacgtgagagcacatccagggcccaggcaataggcccccaggccttgagcgaagccagggccctcctttgttcccagaaactactgtcacgattagactgatttatgacagccaagggagaagggaaccttgagtggccctgccagctggttgcgactcaggtgattttaggagccttctctgctcctctcaaatgtctgcatcttgcctgataatatcataaacttcctagagaggtaaatcctcctattccctaattagagataaaaagcttaaaaatgaaaatgcctagtggaagtcacacattagcatgaataacattcatatatgttataaggatgttaattaaaacaaattaagctacacataaatgactaatagcagaacctgtctagatgtgattgggggagttagtgaaaatgagtaggtgctaggaatctaattgggtgaggcagaaagttcatggagggtagaagtgagaaggaaaagactatagactttcaaggtgacaagcttctgagagtacagttttgcttggcttgatctaacctaaaattataaactaaagtatatttatcgtgcaactggaaatgggtctttatggcaattcacattttttcctacaaaattaatgctgcgtttctctttttttttttttaatggtaacgaaccttgcagagactttctctcccttatcctgacaaggcctccagtgttgagggtcttggcaatacatgggaattgcctggggcttcctttgcttccatgaagcctgatacatcctcaccccatcctttggtatcgcactggagaccagggcataaaccaacaacacatgttctcctaccaagtgtacccaggccactctctttctctaggatatactcatgggaacaggttgcacagggcaatggtgcccctgcctaactggtgcctgtgataattttggacagatggcaataatagcttacattcctttcatcacatattttcagtttaagactcaaatatgctaatatttcctctcaaggcctttgtgccagctcctctttctgcctggaaatctgttccctgctcttgttatctcttggatcactgatcccatgtttccttctcagaggaaatgcagctgggaccccagggactcccagctgctggcacttgagattaaggatgtttctgacctcggaggacacaaacatcctggcagccaggagaacgctctccaccactccgtgctttcctgggcttcctattcctccttctctcttgcccgtgaagtggaacgcctttgctgatgaggcatccctttatcatccccacattctgagaggctaaggtcagaggaagcatgcttgtgaggaagtgtaaatcatgctacaagatagactttgcaaatctgttatgtttctaccacattcttcctcctaagcatcagaatctgtatttgggcttatttctgccaaccacagaaagaaacacacattgcctagctcagagaggtgttttctggagaacttattttccaagacacaacatggctatttgtaacagttttttaacactttctgaaggcataaaagttgtagtggggagatggtgtaaatgggttcttcctactactgcttcaagtagcacagcacttacttcaagagcatggggcccacccatgggggaattaaggcatcttttgatttttgctctccaatattcagtcaagagggatggttttgataaatataaaggattttccagagaggaaacgaacacacactaaacacacagaatatttcctaagcaaacactatgctctgggtagtctgtgagccatggctctgtttaggcctgtgaacttcctatatagggagggtgtataatacatgcagatgtggatagttgtgctgggtattaatatatcctttcccttcaggcttttactttctgtttctcatttggcagcctttctgtggacacctagagagcaattttataaacaaagcctttcctctcacctttagagaaaataaagttatgagatggttcaattacttgtagagcatcataggatgagacagttggcggtggactctggatgaattctgcatgaccaagatcccagactcatgcgtcttatggaaaattgtgttctctccagagaaatacccccgcccactgatatagtgggacttcaagccacttttgagtggactgcttcaataacagttttgaaatatagtgtgggggattgaaaatgtcctttttatagaaaaataatttctttccaaactttgattctcctcccagtattctttttttttatttttatttttgagatggagttccactcttgtcgcccaggctggagtgcagtggcgcagtcttggttcactgcaacctgcgcctcccgggttcaagcgattctcctgcctcagccttctgagtagctgggactacaggcacccggcaccatgcctggctaatttttgtatttttagtagaggcggggtttcaccattttggtcaggctggtcctgaactcctgatctgaggtgatctgcccactgcggcctcccaaagtgctgcgattataggcattgagccatcttgcccagccccagtattctcaaaccaagaaaagtatgacaacaataaaagagcctactttttgacaatagagacaaggctatttgtctgttctgaaaggaaaagcttacagcaggagagctaagggaggcatccaaggatacaagcatttcagtggaagttcctcaacataaaaggaataacaaatttcacaaaatgcctactcagagtgcggcacagcgtaaagtacagcatggaatcatgaagctggcatggcactcgagacagatccggataatcaacagagtcagttcacacctcatgcacgtatcacagggtcccttacaccagccaatctttttggcaccaggattcatggaagataatttttctatggacggggttgtggggatggttttgggatgaaactgttccacctcaggtcatcaggcattagattctcaaaaggagcgcacaagctagatccctcgcacgtgcagttcacaatagggtttgtgctcctatgagaatctaatgccaccgctgatctgacaggaggtggggctcaggcggtaatgctcgctggcctgctgctcacctcctactgtaaggcccagttcctaacaggccacagaccagtactggtcccctgctgcgagttggggacccctgccttagacgggaaaaaagagtgcatagacttcctgctctcctgagatggcagcactctcagcattgtttatggaagtcagtttggttggttggttggtttttaaaacaaggtagaaggaaggaggtctttcagaactggtttctcaaaaaacaaacaaaaaaacccagaatagattaaaaaaggtttgatcaggttttttttttttttcttgttttcttgagacacagtcttgctctgtcacccaggctaactcactgtggccttgacctcctgggctcgagtaatcctcctgcctcagcctcccagtgttctgggattacaggcatgagccactgcacctggactgataagttttttttggggggtggatacatagtaggtatacatatttatgggttgcatgagattttttttcttttttactttttgcatgagatgttttgatacaggcatgcaatgtggaataaccacatcatggaaaatggggtgtccatctcctcaaacatttattctttgtgttatatgaaatccaactatactcttttagttgttttaaaatgtacagttaaattatatttgactatagtcacccagttgtgctaggaaacactaggtcttactcattctttctatttttttgtatgcattaaccatctgcacctcccttccccttcccccactacccttcccagcctctggtaaccatcattttattctctatcttgatgagctcaattattttaatttttagctcccacaaataagtgagaacatgtgatgtttgtctttctgtgcctggtttgtttcacttaacataatgatctccaattccatcgtgttgttgcaaatgacaggatctcattctttttctgagacggaatctcgttctgtcacccaggcttgagggcagtggcgtaatctcggctcactgcaacctctgccttgggttccagcaatcctttcacctcagcctcccgagtatctggaattacgggtgtgcgccaccacacctggctaatttttgtatttttagtagagatgaggtttcaccatgttggccaggctggtctcaaactcccgacctcaagtgatccacacaccttggcctcccaaagtgctgggataacaggtgggagccactgcgcctggcctggatctcattattttttatgcctgaatagtactccactgtgtatgtgtaacacattttcttttttttgagacacagtcttgctccattgcctaggttgtatgtagtacagtggcaaaatcttcactcactgcagcctctgcctcccgagttcaagcaattttcccgcctcagcctcccaagtagctggcattacaggcatgggacaccacacttggctaagttttgtatttttagtagagacagggtttcaccacgttggccaggctgatctcgaacttgtgatctcaagtgatctgcctaccttgacctcccaaagtgctaggattacaggtgtgagccactgcacccagcctgtatcacattttctttatccatttgtctgttgatggatgcagcttacttccaaatcttggctattgtgaatagtgctgccataaacacaggcgtgaacatatctctttgatatcctgatttcctttcttttggctccatacctaggagtgggcttgctggatcatatggtagctctatttttagtttttggaggaacttccaaactattccccatagtagttatactaatttacattcccaccaacagcatacgatggttccctttctccacattctcgccagcatttgttattgcctgtcttttgggtaaaagccattttaactgaggtgagatatcgcactgtagttttattttggctttctctgatgatcaatgatattgaacacgttttcatatgcctgtctgccatcagcatgtcttttttttgagaaatgtctcttgagatcttttgctcatttttttgattggattattagattttttccccacaaagttgtttgagctccttctatattctggttattaatcccttgtcggatggtttgcaaagattttctcccattttgtgggttgtctcttcattttgtggattgtttcctttgctgtgtggaattttttttttgagatggagtctcactctgtcgcccaggctggagtgcaatggcgccatgccaactcactgcaacttccatctccctggttcaagcaattctcctgcctcagcctcccaggcagctgggattacagatgcatgccactgcacctggctaatttttgtatttttagtagagacaggtttcaccatgttggccaggctggtctcaaactcctgacctcaggtgatatgcccacctcggcctcccaaagtgctgggattataggtgtgagccaccgtgcccggcccctcttaattaaaaaagggtattttggggtcgggcatggtagctgatgcctgtaatcccagcagtttgggaggctaaggcaggaggactgcttaagcccaagagttcaagaccagcctgggcaaccaagggagaccttatctctaaaataaataaataaataaaatttaaaaatgattatctaagccaaagttcctcaactgactgtgccctgtagggggaacattagtcaatgcctggatacgcttttggatgtcacaactcagaggaaggtacactactggcatctagtgggtggaggccaagaaggctgctaaacatcccacaatacacaggacagacttcgcagcaaagaatcttccagcctaaaatgtcagtggtctgaggttgagaaaaccttttctgagctagtgttactgatctgtttaaggaagtctcataactaacatctcagttgtgtgtcagcaaatgggtggtgctatgtgatgcaaaagctctacaaataccttttctcaacttcctaaatatttctttcacatagtcctgcttacactataggcgtactgacgtctttaattcagagaacaaagagggtaaaccttgttcctagtctaactcacctccacggttattaggaaactcaaatgtgggggactgagtttctgacgctttattatacaaaatcattagctcttttttaaaacctctaaatggtgagtcggctgtcctaatctcatagcagaagaaacaacagccctaaataagaactgtcttattagaaatactagattccaaagacagtaattaacttcttcttcagttatatacaatctgaattttaaaaaaaaaaacattatatccagcccctgcataatatatcaggaagatgtaattgtttctgattaaaatgctcagtttgacgcggtgtggtcgctcgtgctgataatcccaacactttgggaggttgaggtgggaggatcacttgagagtagctggggcaacatagcgagaccctgtctctacgaaaagtaaaaagtcatctgggcatggtgatgcatgcctgtagtactagctacttgcagactgaggtgggagagaatggcttgagcccaggagttcaaagatgcagtgagttatgattgcaccactgcactcctgagtaatagagcaagactttgtctctaaataaataaataaaacactacatttggcttacttcttttttgtttccctattccttcaaggaaattaaatagatgtagaaatacagtggaacgccacagaatcattagagaagttagagtgatgtaacattttaagggtaccacattttatccttttacaaacaacacaaaataagaacaatttaagtataggtcctgccaaatacatgttaagggatatataaaaataagtttaaatttatacatggattgtacaaaatttttgaggttaaatattttaagcttattgtcttaagtgggttaaacattttcctgaaattgtcttcatactgttaatttattcagtcaagttaaacctccgctcttcctgtggcacaattatcaagaattcttgcacttatgtgttacactaaacagacagcctaatgaatacttatggctactgatttattctacaataaataacagtaaaagaattattattacaatgcaatgataaaaagacaaaacacccaattaaaaaatggcaaagggcctcacagacatttctccaaagaggaaatacaaatggctaacaggcacatgaaaaaatcctcaatataatttgccatctgggaaatgcaaatcaaaaccatcatgaaataccactccacactcactaggatggttagaaaataacttatgttggcaaggatttagataaattggaagcctcaaatactgctggtggtacaaaatgtgaagtggtgcagccacttcagaaaacaatcaggcagttcctctcaaaggttaaatgcagagttaccatatgaccaagcaattgcactttgaagcatatacccgaaagaaatgaaatatgaccacataaaaacttgtacacagattttcatagcagcattattcataatagccaagaagtggaaacaactgacgtttatcaactgatgaatgcataagtaaactgtggtatatccacacaatggaatattattctgcaattaacaggaaggaagcatggaaatgcaacaacatggatgaatcttatgttcagtgaaagaagtcagtcacagaggacacatatatgattccattgctatgaaaagcataggcaaatctatagacagaaggtagataagtgactgactgggcccagaggcaaggggagaattggaggttgacaacaaagggaagcgtgatttcttttcagggtaagaaaatgtcctaaaattaacggtggtgatagttgcacaactctgtgaatacgttaaaagccattgactcgtacgcttgaagtgggtgaattgtatagatttgaattatagctcaataaacctgttttaaaaaaggccagagtcactagttcattacctctgtaggaatttttggaagatgcgccgataggcatagccagctcttctcactcgaatgttctctttcagacccaaatattcgacttgatgctttaccctgtgcaaaggagaaaatggggcctggacattactggataatcctttcactcgtgttcttaccagccaacccccaagcccccagttccaagctgtagggaaacatattcagaagactacaatttatagtgttcaaacactgagctgacctctcagatgacataatgctaatttttaaatattgaaatacagcaattaggctgggcgcagtggctcacacctgtaattccagcactttgggagggtgaggcgggtagatcacctgaggtcaggagttcaagaccagcctggccaacatggtgaaaccctgtctctattaaaaataaaaaaattagccaggcatggtggcacgcacctgtagtcccagctactcgggaggctgaggcaggaaaatcgcttgaaccagggaggcagaggctgcagtgagctgagattgcaccactgcactccagcctgcatgacagagtgagactccgtctcagaaataaaataaatataaataaataaataaataaaaatacagcaattaaataacagggcattacatatctatttcaaagaataacagtaacacaaagacccatctatcacctagagtatgaacaaaaatattggttaatcagaaggctaaaggaaagaacttttaacttttgaattaaatgatgctaatgctggttttgttattgaacttaaattttaatattgattatgacttaatggaactacacttctaggcttttctaatacaagttacaaaagggcatttaaaactattaatttcaagtgtgtacattaaaaatggtctaaaatatatctaaattatagttttagttgatttcttctttcttacaagaatttttttttgatacagggtctcactttgtcatccaggctacattgtagtgatgtgatagctcactgcagccttgacctccccaggctcaggtgatcctcctatttcaggctcctgcgcagttgggactacaagcatgcaccaccacacctggctaatttttgtattttttggagagacagggtttcgccactttgcccaggctggtctcaaactcctgaactcaattatctgcctgctttagcctcccaaagttctgggattataggcatgagccactgtactcggcgtgtttcttcctttcctttcccttcactttcccttcccttttctttctttctttccctttccctttcctttctttctttcgagacagagtctcgctttgtcatccaggctggagtggagtggcaaactttctttcctttctttttcttttctttctttctttcttgagtcagagtctcactttgtcatccaggctggagtgcagtggcaaactttctttcttttctttctttcttgagacagagtcttgctttgtcatctaggctggagtgcagtggcaaaatctcggctctctgcaaactccgccttgtgggttcaagagattctcctgcctcagcatctcgaatagctggaattacaggcatgtgccaccatgcctgggtaattttttgtcttttttcgtagagacggggtttcgccatgttggccaggctggtctcgaactcctggcctcaggtgatccaccacgcctggcccatcctggtttcttaacagtaaaaatctagcaatgtcttttgaaaaaatggatgtaaagaactattaggttaatattctcacacatgaggattttcataccagaagatgccccatgccccacaccttggggatgctgatttagtaggcctgcaccttggggaggctattttagtacacctgctgggtctaaggtggagcacggacatgtgccttgtgaaaacccaccacttgctggaaaacacagtgctctggatgccgacagatcctgaaaacttgcttcagatcatccactctgggaagataaattgggcctgggctgcgtgctgcgcgagctggctgaaccagacacttggaaacatggtatttgaggcaaattagacataaaaagtaaggtctctctctttcgaagatggaatgtcaggattgtgctgcagtagggaggtaactcctcacactccctgtttggtacatttggggatatctgtgctgataacggggctaatgcgctcagcaaaatgggcctttcaggagctgctgagctgaaaagacaatcagaagcatcctcattccgatgtcacgcaggttcccaacagctgtcttcccagtaaggctctcacaaaaaccaccatttccaattaagtctcatacttgcggatgtctactgtgggccagtcacacacagtgcctattgcaacatgctagggtcaccaaaaaaggacaatgctatgattcctgctggagcccacacaggcagcacagtggttaggagccaggttctggtgctgcattcctgctgcgccactggccctgccacgatgcaacttctctgtgcctctcagtttcctcttctgtaaaaacaggaatggtggcataaattctttatttctagacgagtactttctatggaaagcacttagttcgtagcacgagcatgtaaagctgttattatcgtcatccattcccagctacaatatgtaaaccaggataggagaatagagaaggaagtggatttttcacagcacagggattctcaggagcactgtgatgtgcctgggcctggaggggcgagttgaatccatgaggtatacaggacaaggcagagggctgtgaaagcaaaggtacaagaataggaaaggccagtggcagggtgctgtgggacaggaggagggggacagatgaagctcgaagtgggggtgcaaccttggctgatgggaaggatgtcacaatgggagtggtgtttaagagtctccagtttgatgggtcttacagagccaagagccagaaatgttgattcctctaagattattaactttcagaaagcctctgtgtgcaaagagttaagccgggcatagtggctcacgcttgtaatcccagcactttgggaggccgaggcgggcaaatcatgaggtcaggagttcgagaccagcctggccaacacagtgaaaccccgtctgtactaaatatccacctttgcccatataagtcagacagacagagacagagagagagagagagagagagagagagagagagagaaagaaatgtcatgtcaattaaaaaggtaattaaattgaaaaataattaattttcctttctctcaccctccaaatctaaaactcgccactggccttttctctagtgagaaaaatgcatgaaaaatgcatttaaaggttctgctcattttaaagtacttttcataaacactggcttcacgccaagctttcgaggcagggaatgcatcacccattaattcaagcagaaacgttcctctcccatgaatcacataggaaggaatattcctcatgttaaaacattgtttcattcattataacttccaccatcaggaaattttctggtagaaatgagtctagcaagtcctgtaatgtttaaaatttgggggtcatcaaagcgacacaagttgatttttgcatattcctggagcactgtcacctcctcagtagtcgttgatcagacaatgcccagttgttccctaggctatgccaactccatcttgcagagggagtctttttccaagactgtccctggccgtttactcaaattgatcagggctagagaactctgcaaggcagcaattcagaatgcagggcaagcaaccttgccagaagccaaacaaaaacgcatttgcaacaggaaaagaaaaaccctacacctcataaacttgtggaatgagtaaccctctttaccaggagcttcaactgggtgtgtaatcccagccagtgaagcacactgccctttcacggaccctaacactcctgactcatggatggagtgaaaccatttgttacacaataaacccaaaccaggattaagggtggaatcccagaaagcggtcttactggaattataaatcaacgctcgaccaactaataccttgaacttcttaaaaccagtttatttgaatgcatgtcataaaattctttgctgcaattcaaaggggaatcatttaaaaaaaaaaaaaagaaaagagaaaataccatcctcatcctatgaggatttactgaataaaatgtaccactcatttaatttctccattttctgatattccaatgaattatgttggatttttacaaggaagtagcatcagggttggtgaacttccaagcagctattgcaaaatttctattttagaggggctttcagtagaactatctacgtggggtagaggagggtgtgctagggggcattgatcagacaatgcccagttgttccctaggctatgccaactccgtcttgcagagggagtctttttccaagactgtcaaaatgcatttgtagggcaagtgagatgttttcatttaagagtatttgctgggaagagcaggtggatagagtttgaaatgggggaaggtgggctaaggccccctttggcaatacctctgcttccaagactctcatggtttatttctaaggttgactaaagatttggttggagtaatcatattgggatattgatttaatatcactgttctgttgtgtgtgtgtacatgtggatgtatgtgtgggtgggtgtacaagtgtgggtatgtgtgagaggtgagtgtaaaagtgacagagacagaggcagactgacagccactgtctggaagccttcattctgtcagactgaaggagatcctattctagatggaccctcttaagaggaaggaactgagggctaaggagatgaagagtctcgctctaacaacttagtgataggtcagcaccgggacacagtctagttctttgctctagatcagtgattctcaaagtgcagtgcctgggccatcatcaccagcaccacctgcaagatttttaagatgcacattcatgggccccacctgagacccactgcatcagaaactcgggatggagcccagcaatctcagctttaacaaggcctcctggggatcctgaggcaggctcaagtatgggaaccaatgtaagagagcaaaacaagatgttttctgtatgattgattgattgattgacttggggtctcactctaacagctgggctggagtgcagtggctcaatcatggctctctgcagcctcaaactcctgggtgtaagcattttacatctttagaggagaagagatgacaatgctgctaccctcttagtctgaaaggagaagcggaactatacatttcagaaaagcagaggccaaattaagtacctccaagagaagggctaagatggggaatgcttatatttcatgtcctagagaaactgttgacggaactgagagggattaacctgtagaagagaagattcaagagaaacacgacggtcacctcgaactaacagaaaaggtgtccagtggcaaagtaatgagaatgattcttatcgcagattgaaaacctgggattaggataaaagtgacctagagaaggactgtacagcctcctaaagtaagaattgaccaaagaagagctggtcaccttagcaagtatgagctcctcatccgggcctgaatatcattaacggacaatattgtagaaggaatctgactacattaaattgaaaaatttcagagattcaatagaaaagatgccttaagcggtcaggggtggtggctcacacctgtaatcccagcactttgggaggccgaggcagttggatcacgaagtcaggagttcaaaaccagcctggtcaagatggtgaaaccccatctctactaaaaatatagaagtagccaggcatgatggtgggcacctgtaatctcaactactcaggaggctgaggcaggagaatcactggaaaccgggaggcagaggttgcagtgaaccaagatcatgccgctgcactccagcctgggtgacagagcgagactcttgtctccaaaaaaaaaaaaaatccttaagaatatgcatctatggatgagattattcagaacatagtggcctgaaaagatggcagctcttacatccaagcagcctggcttcttcagaggagagaacagacttagactgcatgccgaagtattcaatattaaatagaacgaactttcagacagtaaatgtttgacctacgtgtttttcttactatggatctgtttcctcctgtaaaggatcaggcatcatctatctgccatggtttaggatcttactggcaggaaggaaaatggacacacctgtccctcgcaggagataatcggcagctaggaattttagtccttgtcttcctgtggaagctaaacctggagttcttcactcgacacctaaaagagcctaccttcttttctccaagagagaagacaagaggtagcaattctggtaggctcccatcctgggactgatactaggtgacgatggctagggtcctctctgtagtttaagtctctccctccttcccatgcttctatggacagtgggatcaggcctctgaacaatgtgtgtctgggtctcccagcgggccacaaaattcataccctctagccaccaccttaacaggctcctcctcaatgccgccatttcttcctgcccaggccacttccctaaatcctagctgtgggaggaacagtgatgcaggcttcactggaagtcagggcagaaagggtttgctgaattcttgtgctctgcatttccctttgacatctttcctcccagagtcgttcttctcatcaatacggtgcttagggggaatgccagagcctccagcttgtccccagtgtcttcacgaggcacagcaaatgctggattgtatttccatcagctcttacgccctccactttccaccccaagctaagcattctaggccacatcctgtgggtcccgatcaggggctgggtggactaagaatgtctacacagaacctcaaactgattttaaaaccatcatgactctgcggtatgaggttatgttttgttttttttccatctgcccccagactagccaagatcaacattataaactgctaatgctgaaatgaatggcactgctaacattttagcaaatgacacggaggggaaacagtatacagcttttgtcctgaaaaagttaagatgcaagggcatgacaaagacatgtgcggacaactgacactgctcctgcctgtgatggaggacggctcatcttgagcagagggaaaaaggtcccggccccacctaagccggtttcccccgatacctgctttcctcccagtctctgggcttcttggtttcgtttggcttgatgcagcgaatgtagtggggcgtacatttcatcagggtgctcacaaggtcattggcttgtttctagaaaggaagaacagtatcagaatcatggaactttctctaaagaagaccaaatttcaaaggagacttgtaaaactctcttgtagaaatacatagctaggaattaatcttcatgacaatttgctcgttaagcataactcaggtctactaaactttccgaaagctttgccgacttttatgatgattttatcactcctaaatgggtttgaaattcaatcttcaaaagcaactaggcattttcagtacagttaataaaatagaacaacaacaaaaaacaaaaatcccaataaatcttcacatacaaaatgattttcaggtggtacagtgaagcatgtcagttaacaaactaagttcattttatgctgatagagcgcctttgaagatatattgttctcattaactttttttcccccaaaattatttgtaaggataaatcatcaaatcccctacactctcttttctggcaatccaactaatgaagaatcactttgctaaagtgatgaaaattcatagttaaagaatgggagattcataaaaatctgagaatttataaacttttgatattccatttcattcagtttcttcctcaatatggccatttaaaaacctgcagagtctgaacactttatctgtggctgccaacttacttctttgcaaatctagaatattctatataaaaccttctattaatgcctgtgcactgggtactcaaagtagaactggattcaagcagaaaaagccacataaagctgaaattgcttatgaagtattttaaaccctgagaatctcaaactttgtttgaagaaacaggagtagagctcacatcagcattcccaccccacagctgagcacaccctgtgggtccaaggatgtggcacacatgcgaactccacttccaagcaaagcagcctaaagagagaaaacctctaaaagaaaaaaagccaaaagggacctccaaagccagaaaaccattacagtcagcagaagagatttgcttgcaagacacaaccctgtctcaattaggacttttctgttttcatgggtttgggaaatctgaaacccttgagaaaaactattgagtatattcaaagcaagatattcattggtgaattaagttctctgtttagatgtgcaggaaatagcattctttgcgatgcttgaaattgaggacagacagggctgcagaggttgcatgatcaaagcaaagccctatgatgaaaaagtaaattgcctcttatgttctttgatgatgcagactgcacttgagaacaaatttgatgatttttgcaacacatcaggtggagccggagagggactgcagggttgaatatagcacagcttttttttgttcttaaaatccccaaattcttaattttttaaacttcatttttagattttagttttgtatttaattacgacttttttttttttttttttttttttgagatggagtctcactctgaggcccaggctggagtgcagtggcgtgatctctgctcattgcaacctctgcctcccgagttcaagcgattcgcctgcctccgcctcccgagtagctgggactacaggcgtatgccaccaggcccaactaatttttgtaattatagtagagatggggtttcaccatgttggtcaggctggtctcgagctcctgacctcaggtgatccacccgcctcagcctctcaaagtgctgggattacaggcgtgagccactgtgcccagcctacaacttttaatttccaagaataactttgcaaactcttttgtcctaagtatttaacagcattccttctttttcacctcagcataagaaaacatagagaggcaagtgtaacttaagtttataagtcacttgccatagtcctctccagctaaaatagtgacagataacatttactgagtttgcagtgcagattagatacatgtattatctcatttacgcctcacaacaacctgaagaggtggctactatttaatattattcctgttttttagatgagaaagctgggccttaaagaaacaaagtattgctcaagatgacacaatttgcatgaaagagaagtaaggcttgaacccacgcccatgggctaccaagcctgttctttggcaacaatcctatcctgccttgctgacaaagagatgggatcatttagtgtgatataaaaggaattaactggttgaggtaggattagacagaagccaccaggctgtgaataattaatttcagcaaacagaaatacatcttaaccatcaaaattatcctgtatttcaatagctatgggtcaactttatttacctatttttaatttttgaaacagggtcttgctctgttgtccaggctggagtagagtggcatgatcacagctcactggagccttggcctcccaagctcgagtgatccttccacctcagccctctgtgtagctgggactggaagcacatgccaccacacccagctaatttttgaaaaaaaatttttgtagaggtggggtctcactatatttcccaggctcgtctccaatcctggcctcaagcaatcttcccaccttggcctcccagagtgctgagattacaggtgtgagccactgtgcccaaccttgggtcaacttaagatgtctgctgaggtggttgtgaagcagtaactgaatttaatcctgattccagccaagaagggttcctgagttaggacagaaaagtaccaacagcacttgctcaacagaagcaggtgttaaaatacgcagacagcacagtgagaaacggctcagggtgaaagctcctcattctaccttcaacagagatgacagcaggcctgactgtgggtcctggcacttttatttgcaagttacatgactaatcactagatttctctggtcctcagttctctatctgtaaactaagtaggttgaactagaagacctctaatttaatctagagattgaaatacatattaaaaaacaaacaatcaggctgggtgcaacggctcactcctgtaatctcagcacttcgggaggctgaggcaggcggatcaattgaagtcaggagttcgagaccagcctggccaacatggtgaaacttcgtctctactaaaaaaaataccaaaaaattagctgagcatggtggtgccacctgtagtccagccacgtgggaggatgaggcaggaggatcgcttgaatctgggaggcagaggttgcagtgagccaagatcgcatcactgcccttcagcctgggtgacacagcaaggctccatctcaagaaaaaaaacaaaaaaaaaacaaaccaaaaaaacccccaaccaatccaatcacctgcatgatgcctgtacttcctctgtcatgtcccttatagctccagctgcactcagataaagctatagccagtctgcctttgccacctctgagcttggttctgtttctccgtagcatcaatctttggctctaatttaaatatgggatgagtatcccttatccgaaatgcttgggaagggaagtgtttcggattttggattttttcagattttggaatattggcattatactttattttttgagatggagtctcgctctgtcgcccaggctggagttcagtggcatgatctcggctcacttgcaacctccacctcctgggctcaaccaattctcctgcctcagcctcctgagtagctggcattacaggctcctgccaccatgcccagctaatttttgtatttttagtagagatggggtttcaccatgttggccagactgacctcaaatgatccagccacctcggtctcccaaagtgctaggataacagccatgagccactgtgcccggcctgcattatactttatagttgagtacccctaatctgaaaagctgaaatccaaaatgctccaaaatttgaaactttttgagcaccaacacgatgctcagaggaaatgctcattggagcatttcaggatttgagatgctcaacctgtacttgtcccttccagacacgacaatatcgaattaagtaaaacctcaaaatcaaatgctattaaatattactatatttatacttttatttataatcaatataataagagttcccatcaaatgaatattctattagttaaatcctacaaatcagtttaaatttttaaataattagaatataatgaaatctataacactacgatgaccttgaacacaagtttaatttttctttcaaggaactcagaatccttttaaacgcttacgcctcagggacatcgttaagatgacaatgatgtctgcaaattactgtagatatggaacgtatcagcgattgggccatggctatgtatctgtaagaggtactgggagagacttttattcctacgtggaggcagacagccaggcagacagaggtcacaacatccaccaaggagattgtgcctggaggtgggaaaacatgctgtactctctttaggtaaactgctgacttcagcttgacctccctagacaagggcctgagacttgtaaacctaaacattttggaaacatcccacaatggtggcactttgagccttcaaccagacaagcatacgaaggaaagaaaggggacaagtctttaaggaggaaaaagtgtccctacccttgctctcctttttatagacaataatccagaccacttgaaaatgagtcatcataacctggatgatctgggccccttggatctgaatgtgacagtcttatgactcgattttccagcccagagttaatccttatccaggactttgcagtaaaggcatgagtcagacacttcacgcagacattaatatctgggcctcatgagaatttcatttgttttctgccttcagcaatctgccccagtgagcctaacccagggactgtcctgaggctactaaatgtctctagttctttcaacatgatgttcttgacgctcagagggctctaccctacagctgaaagcccaggctggactcggtggcttgtgcctgtaatcctagcattttgggagtctgaggtggatcgcttgagcccaggagttcaagaccagcctaggtgacattgtgacaccccaactttacaaaaaagaaaaaaacaacaattaagcagagaccaacaacggcgatacaggaaaggggctaatgggaaagaatgtagtcagagcatacatatacatcttgtgttcagtatgcctcaggcactgcgttacatgcttccaatgaattatgaagctgaatcatcacagtaatctcttaagatagacactaatatcttaagatagactcttaagatagactccattttacagggaagcggtgagggcactgagagcgtaagtaacaccttggcaagcacacagcgaggaaaagccagagctgagattcgaacacaggcgagcaaactcaaagccctgctgtcactcaaccattcctttgattgtaaaactgaggaagtattcagctggtataatttttaaaaaaattattcttaaccagtatgattttaaaaaatagctcagtgagtatttcttagagttacatgattgtgtgtgacacaatgacaaaaactatttttttttttttttggagacagggtctcgttctgtcccccaggctggagcaatcatggctcactgcagctttgacttccttgactaaagcgatcctccttccttagcctcccaagtagctgagagcataagatgtgagccactacacctcatttttatttttagtagagatggggttctcattatatcgcacaggttggtctcgaactcctggggtcaagtaatcctccctcctcggcctccaaaagtgttgggattacaggccagagccactacatctggctgacacagattttttttttttttttttttgagatggagttttactcttgttgccgaggctggagtgcaatcgcgcaatcttggctcactgcaacctctgcctccagggttcaagtgattctcctgcctcagcctcctgagtagctgggattacactcacgtgccaccacgcctggctaattttgtatttttagtagagacagggtttctccatgttggtcaggctggtcttgaactcctgacctcaggtgatccacccgcctcagcctcccaaagtgctgggattacaggcgtgagccaccgcacccagcccacaaactcttaattcagtgtaattaagtgtaaactcttaattcagtgtaatggctcaggtaccacagaaccctgcctacttcctgagaaacactgtaagatttccttcagactttgagacaccatgtggctagatgtgtcttcaattcacagcaaggagaggcctgtaggacccagtgaggagggatgcataaattgcccctaaaagaccaagtagaatttctggcaagtaacgttccataactggcaggtttttgggcctggcctggtaaactgtcaacagtatccaaaacatggctccgaaccatatttctctgacagtttaacataaattcttccaggttctgtttaaagccatttcctcttagaaagtagctgattatcatctgctgactattaagctatgaggtacttaatatccatttaaggtttcggtacagccaagtcaaattcagcttgcatcctggaaccttgtaacaagcagcgatgttacttctgggcatcttctgtaaccacctcctcacgtctcactgacctcatcctggcccaggggtgcagttccttactcctagaaagcgctagcccttataagaatctataaacttcctaaaatagaactaacctttattttgcttccggcagtagttgggcgccctttcttgtcagcctgcagattttccggaaataaagactttatgaaaggcctggaaaaggagaaagagaatgaattaacaatctgtaagtacctctggggctgaaagcctgcctttctagaggatggggtgaagggccgtccccaggcacataaccttggctacagaaaagccatctgactcacagcgcgggccatcaagatgtgacttggggaaatgaacaacggacaaaagtcatgaagggaaagaattctaagatataagcaatttggaatcaaagactgcaaaataaattttaaaacaatgcctttccaacgtccctagtcacaggaattgaggtatatcttgacagaacataacagagggaggtcagtaggggattttaggtttttgttttgtttttgagacagggtctcgctctactgcccaggttggagcgcaggggttcaatcatggctcactgcagcctcgacctcccagactcaagccatcttcccacctccgcctcctgagtagctggcactatatataggcagacgccaccacgtccagctaattcttgtattttctttagagatggggtttcgccatgtttcccaggctggtctcaaacaactggactcaagaggtgctcctgcctcagcctcctgaagtgttgggactacaggcatgaggcactgcgcctggccagcatgtgtttgttaagacaagcaagatagaccagagctcagggaattatatgaaatgtctggattcagtgcagatgctgctttgctctagagcagagtttctgagtctgggcaccattggtatctgcggctgaataattctttgttgggggccgaggagggcgcctcttctacatattgtgggatatttagcagcatccatggtctctgctcaccagatgccagtagcacactgttcccagctctacacagaaaaccctgacaaactgcttttgagtatgagcaattttaagcggagcagtaacaaatcaccaggctctgccggctgaatatactttcttttttttttttttgagatggagtctcgctctgtcaccaggctggagtgcagtggcgcgatcttggctcgctgcaacctctgcctcccaggttcaagtgattctcctgcctcagcctcctgagtagctgggactacaagtgcgtgccaccacagctaatttttgtatcgttagtagagacggggtttcaacatgttggccacagtggtctcgatctcttgacctcgtgatccacccaccttggcctcccaaagtgctgtgattacaggcatgagccactgcacccagcctgaagatactttcattagtggtgctatttgagctgcatgtgtttatacgtctgcctcactagcaacagggcagggacaatgccttactcatcttagtgtccctggtgtctgaagcatagcatggtgcacagttggtccataatatgtatttgctgactgggtgaatgacgggatccatgtaaattagcaatctgacattcaaactcaaactcacttcctcctcaatgactttttgggcatcttgaattttccaggaagtctccccagcagtctacttttaacttgaccagatacaactacagattttgacatcaagtgtgtttacaaaataataggccatgtccgtatgacagcagtttatgtggaagcaataatagctcttaaacttggcaggaattttaataattttttaaaaacaatctctggaagcaagtctgcacctgactgccataaaacccacaagccaggacttgtggcttacctaaacatctcagagaagaacaaattgattatgtatgttttgaataaaaagaaatgcaaaatctcagaaatggtggtgtggctgcaaggaagcgcagggatggagagcagagggtgaggaggggtagggagctacagggagagaagtaaacggagcagaacagctgaccagggcctgaaaaggaaactcttgctttgctttcattgcagtcagccctttaataggaaattatcaggctcgctgctgttgatcagagaagctggccttgctattgtgacagcttaactaatagagagcaaaagggcagctcttacttgaaagaagctctagaaattgtaagatctggcatgcatgggccttgcctcgcaagcatgatggacttgctcatgtaaattacatcttatgtgttatccaggatcttgagaaccttttcagggaaaaggggaggaaggcagaggtggtcttgagagttctagcagcgtgcaagggggataccctccctcttctacccctacagctgaaacagggtcttgggagttaaaatggatctcttagtcactccttctttagttgtccctcccagagttctcaagccatttcttcagtacttcagggactctggttaatgtgggtcttgctaagccattaaccatctttaaaaattcaacgaccatgaagaagagctcaggggcaaagtatcatagaaccagactgttccactcttaaatagtcagaaatggccatcccaatccaaagccagtgggcttatttctccctgataatagtattgaaaggtagaaagcctgaggccctgaaggacctgtagatggcacttggaatttgggggcatgaagtgttagggacataaaagggagagactgatatagagaaaagaaagctattttgagaaaccaaatagattaaatgataatccagacccaatagcatgaaggaacaaaatgctaaccactaaacatcacaggtgttttgttttgtttttgtttttttctttattagagacacagtgttcctatgttgcctggctggagggcagtggctattgacaggagtgatcacagctcagtgcagcctcaaactcctaggatcaagtgatcctcctgccttagcctcctgagtagctgggactataggaacacaccaccacacccagctcataagtttgttttcatattgaaaatttcatcaaacctatatcccctgtcagctatggcaaaacatacttacagctcgctgctctgcataagctcgatgagatccataaaaagcacatcccggttcctttcacaaaagccatccatgtcataggatacctggccaagaatggaaagaaatcgaatttcattgaacaaaatgtaattaattgaacaaaatcatttattgaacaaaaaatctaatttcaccaaacaaaaaaccaaagctgtcatggctaccctcaccacaacatgtggatttccagatgttgcatttgggatttcattgtgcactgtcacaggaaggctgtgcacgtcttacttgttagctgacttagtggggaaggcctgcagatgctgatgagtatctggctgcctggatggcccagctgatccgtaatcagaactccagctctcaagtccccataccccttcttcagtggatccataggggtgtctaagtgacatactcaatacttttcctaaattttagctaagccagagcaaaagtgaagcccctcatgctcagtaattcactgcaatgagccatgtcatctgaggctttgcagtttctcccagaagtggtatcaaagttgcaccaatctggccagaaactcatgctcagatactctgtttaacaagagatcagctgggatgatggatgagaccaggggatttccatagcactaggaagtccccaagaccacgacctcaacttaacttttttatcatcagcagccccacacagcctggcatccagtaggcacccaatactgatgggctttataagaacaccaaaagtgcactctgggccttgatttatactaccagtaggcatggggagacaaggaatgccagtctgtgattccagcaagaggcaagacgaaaatccatttattcagcagctaatacatgtagcagggtgattcattttccaaaaatatgcagtagtatgctgagatttagtgctggagtgactcccagccggcccctaccctgctgaagccccagccgactgtcccagggtgggtcctggccaggactggcaccaaggcagtggaatcctttcaaaataggcctccagcgccatagaccagaaagcaggcgcccaattctgggacactgggagatggtgcaggcagccaccagtacgcaaagcatagagccctatccttcctggcagggtcacggttcagaaaacgtaaccttattttcatctgtagttaacagaagcatgtttcctcagcattcatattaaaaataaaaaactagtaattccagggatctcggttagcctcttaagcatgtcaactattgataatactcttagcaaaactaactccagaaatcacttgctagagaagcagcccttcactgccttagtctgagcacccacggaaagcacgtgtcggagactctggcaaggcccgcgcagccgcagtagagggccagggggcggggcacgcgcacctgccgtagagtgctgaaggtcctgccaacggctctcttggcgtctcaacgttcggatcagcagcttttttccattctctctctccacttcttcagtgagcagccatgagttggactgtgcctgttgtgcgggccagccagagagtgagctcggtgggagcgaatttcctatgcctggggatggccctgtgtccgcgtcaagcaacgcgcatcccgctcaacggcacctggctcttcacccccgtgagcaagatggcgactgtgaagagtgagcttattgagcgtttcacttccgagaagcccgttcatcacagtaaggtctccatcataggaactggatcggtgggcatggcctgcgctatcagcatcttattaaaaggcttgagtgatgaacttgcccttgtggatcttgatgaagacaaactgaagggtgagacgatggatcttcaacatggcagccctttcacgaaaatgccaaatattgtttgtagcaaagattactttgtcacagcaaactccaacctagtgattatcacagcaggtgcacgccaagaaaagggagaaacgcgccttaatttagtccagcgaaatgtggccatcttcaagttaatgatttccagtattgtccagtacagcccccactgcaaactgattattgtttccaatccagtggatatcttaacttatgtagcttggaagttgagtgcatttcccaaaaaccgtattattggaagcggctgtaatctggatactgctcgttttcgtttcttgattggacaaaagcttggtatccattctgaaagctgccatggatggatcctcggagagcatggagactcaagtgttcctgtgtggagtggagtgaacatagctggtgtccctttgaaggatctgaactctgatataggaactgataaagatcctgagcaatggaaaaatgtccacaaagaagtgactgcaactgcctatgagattattaaaatgaaaggttatacttcttgggccattggcctatctgtggccgatttaacagaaagtattttgaagaatcttaggagaatacatccagtttccaccataattaagggcctctatggaatagatgaagaagtattcctcagtattccttgtatcctgggagagaacggtattaccaaccttataaagataaagctgacccctgaagaagaggcccatctgaaaaaaagtgcaaaaacactctgggaaattcagaataagcttaagctttaaagttgcctaaaactaccattccgaaattattgaagagatcatagatacaggattatataacgaaattttgaataaacttgaattcctaaaagatggaaacaggaaagtaggtagagtgattttcctatttatttagtcctccagctcttttattgagcatccacgtgctggacgatacttatttacaattcctaagtatttttggtacctctgatgtagcagcacttgccatgttatatatatgtagttggcatttggttcccaaaaagtaggatgtaggtatttattgtgttctagaaattccgactcttttcattagatatatgctatttctttcattcttgctggtttatacctatgttcatttatatgctgtaaaaaagtagtagcttcttctacaatgtaaaaataaatgtacatacaaaaaaatgcagtagtatatacaatcttttgttttgcttcctttgatagttaataaattccgtttgttgaatcaataaaatacggcgagccatatgatttgcttcatgagaaaccagatcacaaacccaaaggcttaaaacagatagacattaaaatggatattggccataccttcccagcataatgatgaatgatgaagccttggttccaactgttgaagtgctcatgactcccaatctgcatctgaagtttctggagcagcgtctgatctgccccctcacccaccgcatgcatcgtggcgcacacgtcatccaggatgctcatgatgccaggagggttctgatgggagcaagaaggcaaggccctagtcactgacctctccaaaacagacaatgcttatcaggtcctttcttaggcaaggaaacagctccccagacttaagataccatcttgaaagtcagtattccccttcaggcaagaatgcaattaatagtcccaaatagggagtcaccacttagatctaaagagggaggaaactccactttccaaaaagctgtttaactccctgaagttttatccaagagtcatgcacagatcattatctgctcactcatagtcatgccaaattgacttgcttaagaatccaaaagtaaaaacattttcctttgacctaatctatttcttaatgttctctttcagcgtgttacccatataggcatcatttcggtagttatttagtgtacacattctataatgcatttcctttttcacatagcactattttataagcattcctcatgttttacacattcttcacacttactattttaatggctatacttctctgttctgatatgctatagtttgtttaataactaagttgtctggccgggcatggtggctcatgcctgtaatcccagcaatttaggaggccgaggggggtggatcacgaggtcaggagttcaagaccagcctggccaacatggtgaaaccccctctctactaaaaatacaaaaattagccaggtgtggtggtgggcgcctgtaatcccagctactcaggaggctgagacaggagaatcgcttgaacccgggaggtggaggttacagtgagccaagatggcgccactgcactctagcctgggcaaccgagcgagacgtctctcaaaataaataaataaacatgtaaataaataaataaataagttgtctacggatgtttttactgtttccagtttttggcttttatatatataaaaaaatcctatagagatatttgttctgtatcacttttattttgaatcaccttttttttttttttttttttttttttttttttgagacatggtcttgccttgctctgtcacccaggctagagtgcagtggcacaatctcagctcaccacatcctcaacctcccaggctcaagcgatcctcccacctcagcctccagagtagctgggactacaggtgcgtgccaccatgcctggctaatttttgtatttagctaatacaatttttgtattagctaaattttgtgtttagaaatagggtttcaccatgttgctggggctggtcttgaacccctgtgctcaagcgatccacctgcctcagcctcccaaagtactgggattacaggcacgagccaccatgaccagcctgaatcagtcattaaggctaaagtcctagaagttggactagaacacagggccaattttatggctctttccatgctaagtcatcatgtgatcctgtcttctcttagaattcaataacaacttccatttgtacattgacattttactcatatccacatgttcatatttactgccagaataaagccgtactgttctcttttcacacatacagaaaactagtacaattgctcaaattctctgcaaatcagagttgtcactttgcctgttctaaaacaatgacacagagaataaaaactcacttaatgtaaacctgtgagcagtgaaaagacatactaaatgaacacttaccactttgttctctatgaggtcacatacgattttattattaaagtactcaatgggtgtccatcttattccctcttgaacatattcttcctgtaacacagagacaaggaactcacattatttcccagatagcaagagctctgcacggacagaccctgaatggacaaaaattcccataaaagagaaaaacctgaatgtcctgcaacaaagaccagggactttaatttttattttctaagaggtaacaggaaaggaacattttatgacttggtgatttttatgtttagtttgaaccctatgaaattattgccacacaactgtttctggccaaagaaaactacaatttagtagcaccgaactgataaatccagttacaaaaaaatcacaaaactcttaaaatttaacataggactgggcgcggtggctcacatctgtaatcccagcactttgggaggccgaggtgggcggatcacaaggtcaggagttcgagaccatcgtgaccaacatggtgaaaccctgtctctactaaaaatacaaaaagaagctgagtgtggtggggcgcgcctgtaatcccggctacttgggaggctgaggcaggagaattgcttgaacccagaaggtggaggttgaagtgagctgagattgtgccactgcacttcagcctggatgacagagcgaaactccaactcaaaaaaaaaaaaaaaaattgaatataggacaggagtacagattagcatccaggtacttaatgggaaggttcttcagtctatgagttgctcatttaacttgaacaccacaacaccatcctggttttttcctctttcctcactggtttcactttgtcagcttcctttgccaggtctttcttatttccagacctttatatgtggtagagtctcagggctcaatctttcagctttctcattttctcagccctccttctctaggtgatttcaatcaatcccatggctttaaataccacctacaggctaatgacccctgaatttatttctctagtctatacctcgccacggggttccagactcaaatccattctacagattggaatcttcacttggatgtatgataggcctctcccacttaacctgtttagaggaactctgattccatatttcccgtgacctccaaacaacccctcttctaatcttaccctccagtaaacagtgtcaccatcggccctgttatccagggtataaagctaagaatcacccgtgattgctctttctttcttggctattgctaattattttgagcaagtcccattctctcactctccagatactccccctccccacctacactgctaccatggccgtctaagtctctaccatgtctagcgcagtctcctgcagtatccccctcactggtttttaaacttccattctagtttgctttcccctgactcatcccactctataagtctatagagccagagtgaccctttcaaaaacacaacaaatcacatcatgtcactcctccctcaaaattcttcagtgggtcctcattccacttactgtaacacccaaagtctcagccatgccctgcaagttcccatacaatctagcccctgcctcccctctcccatctcactggctattgcactcttacttggttgttttgctctggctactctaagggttggggaaggctagaggttcacaggaaacccatatggaaactaccaaaccagttaggagactactgcaggagactgggctagacgtggtagggacttagatggcaatgggagcaatgggtttcatgtgaacctctagcctaccccaccccttagagtagctacagcaaaacaaccaagggcaggttccagggcagaaggtcacgtgaaaccccctggtatggtgtttcctaagcagaggcataaacacttccataactaaatgaccccaaacagcctttgatgtgtgtaatggcttgaatagtatccccccaaatttcacatccacctggaacctctcagaatgtgaggtttggaaataaggtctttgtaaatgtaattcactaaggatctcacaataagtcatcctgggtttagagtgaacttgaaatccaaaacaatggtgtctttcttttctttttctttttttttacagttcactctccatagagactgtcaaaaattgtcaatgctgactgtatttccagtcatcatggcagggtattgtgaaaagttttcaattagcaataatcatgcctcagatgaacagccctggctaaaatattgccattgcgcaaagctaaaatggtgtcttcatgaaagagacggagatttggatatagacacagagggacattgaaaaaggctacgtgaagacacaggcagagactggagtcaaactgccataagccaagaaatgccaggagccaccagaaactagaagaggaaggattctcccctctatcctgaggaggaggaggagtgtggccctgaggacttcttgacttcagactctgggctccacaactgggagggaagaaactgctactgttttaagtcactcagtttgtggtgctttgttatggtggccccaggaatcctaaacaatatgctatcaggaaacaatggaaactgcactgaactatttatttattattattattattattattattattattattattattattattattttgagacgaagtctcgctctgtcgccaaggctggagtgcagtggcacgatctcagctcactgcaacctctgcctcctgggttcaagcgattctcctgcctcagccccctgagtagctgggtctacaggcacacaccatcacgcccagctaatttttgtatttttagtagagacggggtttcatcatgttggccaggctggtctcgaattcctgacctcaagtgatctgcccgtctcggcctcccaaagtgcagggattacaggcatgagccactgcgcctggctattatttatttttgagatagagtcttgctctgttgcctaggatggagtgcagtggtgtgatgatataagcctcgacctcctgggctcaagcaatcctttcacctcagcctccagagtagctgggactataggcttatgccaccacgtccagctaattattttattttttttgtatggatggggtctcattttgtcccgcaggctggtcttgaactcccgggctcaagcaattctcccgactcggcctcccaaagtgctaggattacaggcacgagccacagcacccagcctgcagtgaactttagaagaaactataccaaggcatgttacctcaggtaagtattcaaataccagctttgttaaaaatgcacgtattgttagggaagattgaaaatggcgtagatctgaggaaaccaagtcttttatttggaacacaatatttgccacagacagtcggggctggaactaggctcccatttcccacgtgctcaatgagtcagtagagtaaaagcagccagtcttacctccaacatcacagcatcatttgcttaaagaagaaggcaaatgctgcagacggtatttatatttcatagattaaaatgccacaatggcatatggtttttctgcctgactttattagatgcatttcctaatataagactggaaccgaaatctattaacaaaagacagaaatctataccctcttaaacaaaataaattataaatagaataggatgaaggaagagggactgcttacctgttctgcctttaatgtcagttcaataaaaatctgctgcagtttttcattaacaaaattgatacaaaactgttcaaagccatttttctggaaaaaaaaagttattcacatgtaattctttcacaaaatcatttaaaagtcatttctggagtgatttattgaaatgtcttcatgtgaaaagctttaatagaaatgttggatgcatcaaaagaaataagtttatatttaggagaaactaatttggtaaaggcacatgaagaactcacaaaggcaaaaatgagcctgagttgttttttttgttgttgtggtttgttttctgtttttttgtttttgcattgcctagaattatttcttgcaggccagatgaaatacgtcaccctcctcaacccctagttattaaaactggccttacctggaatatttcaaagccatagatgtctaggacgccaatgttgtattcttcatggtctttctccatggctttattgatggactagagaaagtaaacagcatggcagtgaactcctttccattcatactaaaaacgggcatgcactggggaaagggaagctggattctacacggcaaacactactgcttgcaggaaacagaggacaagtgaaggcaggagacttgctgctttaacaatctctcagtccaaagtcaagtactttggaaaaccaccaggattcagaaaagcgagtacagtagaaacaaaaaatgtttgtttaatgatgataaccattaatttctgtccaagtaagctttttcaggaagtcttaacaattagaaaaaaatgtcatcttggatgatcgaagtaaaacctatttcacacaaagaacccacactaaaggatctgtaattgtcatttccagtgtcttccattcaccagtcatttaatgatgacccaacacaatatgccagggatgctaaggacaagacaacccttgttcctaggcgcttatagagagggtgagctatctgcagatagtaacaatagtcattatttttgaattgataatagaagcagcttacgtctattaaacattcacctttgccagggtttgctaagtgctctcaatgtgttgtttcacttaattcccatttcagttctcaaaatggcagtgataccattattttcccaattttccacatggatacaccaaggcttgcttaaggttgttctatgtaagaagcagggtctgggactaaatttaagcagtatgatgcctaaatctgtgttcttaatcaccgtgagaagaggccaagcaattcatgggaacagatgtaatgacagcaagggaggtttggatagagcggttggtgggggatgcagtgggggaggaatgtaagcgaacaattctttgaggtgatgaatacctggacgaattctgaagtaccagaggtgttttccaggcaaacaaaatgaaatatcatcttttgtgagcgaatgagtaatcatacacaacacacagtcagtgcccagtaaatcccacctcaaattaggatcacttatatgagtattcatgtactggtactattcacaaaaaaaactgacaggtgacaggtagaaaggtaggtaggaagcccagcgctggaaggtgctctgaacaaagagaaaagagatatggattctagtcccaggctgcaccacccccttgctgaccagccttgggcaaaaccaccattgctcaggcctgaagttcccttctcagtaaaatgaggggtctggacaacctaactgcatgacttctgtttagtatgaccctgaccttcccaagcaatgttatcctttaaatagccactaaagtacctagaatagttctcctaccctgtcctgcctgaccctactctaaccacactaaccataccttaagccgtataaatgttagtgcctggaatcaaatacagatcttttggattgaatggcccccactgttgtcccttgactagggtccttctagcttgaatatataaacgtcaaagaaacaaactagctaggaatctagggcctcctagatcactcacataataacagagtgaccttgggcaaattccttaatcgatctatgcctcccttagtttatctgtaaagcagagataataatacctaagtcacagggttgttgtaagaattaagtgagggttttttctctttaaaatactcagaacagtatctgggcactaacatagttagttctatataagtgcctgctattattattttaccatttagaggctacagtgattaacagagattgttactggcagctctacactgctgaaagactaattgtcagaatatatatgtgatatacatatataaatatatattcatatataagagtttatgtgtgtgtgtgtgtgtatctatctatctatctatctatctatcttttggatcgaagggcccccagtgtgtgtgtgtgtgtgtatgtgtatatatatatatatatatacacatacacacacacacacacacacacacacacacacataattatgccataaccaaaaatatctaatagtttcaaaatacatgcaaaaagtttttgatattccttcctctaaaaggtggagcctcattcccctccccttaagtgtgatctttgcttagtgacttgcttctaataaacagaatgtggcaaagtgacaatacctgagtccaagattaggacataaaaaactggcttcttgctcattctctctttcagatcactcgctctggggaaaaccaaccattatgttatgaggatattcaaggagaggtccatgcagcaaggggctgagacctcctgccaacagccacatgggcaatccatctttcagccagatcctccaaccctaggcaagccttcagacaaccacagttccaatcagcttcctgactgcaacctcgtctttgagtcagaaccaccaagctcagccgatcccaaatatctcaccctcagaaactgagaaaataagtgcttatggtttcaagccgctaggttttgggttaatttgtaacatagaaatatgtgaaaaacatattcctaaatctttaggtccaaaagtcaagaaaggcccatgaacgtggctctcctctttttctggtctctagtcctagctttactaaatattttgtccagaagaaacttgttaccacattagatttagctaaggtatcttggtgggcagttctagaaggaaaagcaggattcagtaatcacagagtgagagaaagtgaagtaaggtaatgggtgaaaggaaggagccagaacaggaacacaaaaccctcagtcgttttaccttttttttttttttttttttttgggagataggatctcactctaacccccaggctggagtgcagtggcgtaatctcggctcactgcagccttgacctcccaggctcaagtgatcttaaccacctcagcctcctgagtagctgggaccacaggcacatgccaccacacctggctaatttttgtgtttttttgtagagacagggtctcaccatgttgcagaggctggtctcaaactcctgggctgcagtgatcctcccaccttggcctctcaaagtactgggattacaggtgtgagccaccgcacccagcctactagttttactctttatagctaagatatgaagcatcaccagcatcaacttctgttacttacatctaccaagaaatcaaagacccgggcgtgcagggccttggcgagcgcatcccgggtgtaacaggcctgctctacgttgagggtcacgtggatggattcggatttgcctccccacttgctatccatctgccggcttgttagcttttctttcaaccggtcctggtttatccctagcagatatgcaggaaaagctaaaactgtagaacataaaacaaaacatgacaatctttcagaattgtgacacttccaagtcatctcacaaacatatggaggcacttatgtgcacatgcacgtgtgtgtgcatagaaggcacaatcacgggccccaagagcttacgttctagtgaaggctgcttatcagtaatcccatacacatccatctcctttgtttttcccaattgttttatgacatgagtcaattcctatgatgactgagacttccaataatacaaatcagggattcaagaaggatggcaaacctatccctcctactgagatcacagtcaaatgcctaaaatggacatctctccaagcttccagcacgacagccaggaaggaactcaatcaagaaacatttctttggctccaaatattgttttcttcctttttagtacaatgttttcatagcatcatttttgaagcacctgatattactgaactaataattacaaccaatcccatgtttattgagtatttagcatgtgtagggttactaaagagagaggaaaagatagaaaatatgtaagaaatcttgaatgcaatctagatgaggcaaaaatagtttgccaaataaagaacccttggaaaagctgaatatgtaacacagacagacaagatctggagaaattagaacaggaagatattactacttgctggggtagtcaagagatttgagctgggtgtaaaggatgaatacgatttgtgcagatgcagagaggagaagggagtgtaccaaggggaggaagcagaagtgtgggagacatgatcaagacgagacggtctacagtgtgtggactagcactggctacaggtgaaagttcaggtcagatttaaaaggttaggacagattccaatgctgggggtccttgaatggtatgatatatttgggctggaggcaaaagggggcctgatggctaataaagaggggcattataagaagattcctctgagggtagcatatggagtgaaatgaaggggatggtattgttcatatcctgccctaatgtcacatggtatggcagtctgtggtctttggatagaaaaacggagacttccatagctcaacatcttgtttcagaccatgaaacttaccaaggagggctagtgatataaatggggttttcttgatttctgggcagaacgttctcatataaataaatgacaccattctttgacatgaaagaatgctcagatttttccaatatgaatgaaagatttttatagatgcaatgcaaattttgaacttggctgagttttctttttctgcataatgctttaccaaaattatctgataaaagaattttgttaaaggccttatgataatgctaaaaaatcacaagcctcccaataaaggataatctgtttgaatttcacagatggtgttagaatataacgggctgacatttctcagtatacaccttccaatgagattaagtcagtgaatacattttgaaaaagtataatgccagaacaagacatttatcctctatatgagtgtttcacaaaaatgctttgagcaatagaagggcttccttttagaaaggacatgtaaacaaaatcaaatgcactgatctgaaaatggccattatccttagtttagttttactgttaacacatgtctaggaatctggatatgtcttccagtgaactaaacgtgcattcatctcacagagttgaacatttcttttgattgagcagttctgaaacactctttttgtagaatctgcaagtggatatttggagcactttgaggcctgttgtggaaaaggaaatatcttcacagaagaactaaacagaagcattctgagaaacttctttgcgatgtgtgcattcatctcacagagttgcactcctgtgcacagagtaaggacagatgacattcataaatcagactggacccatgtcgggttgttgtgagaatcaagagacattcaccaacatatccaactaagaagggatttcttagtttgtttagcttcacagcaacgtaaaggtttgaccagggaaatgctacatttccattagtctaaggtcaggtaaaaaaaacaaagcttgtttggccaggtgtggtggctcacgcctctaattactgcactttgggaggcccaggcaggcatatcatctgaggtcaggagtttgagactagcctggtcaacgtggcaaaaccccatctctactaaaaatacaaaagttagccaggcgtggtggtgcgcacctgtaatcccagctacttgggaggctgagacaggagaactgcttgaacccaggaggtggaggttgcagtgagccgagatagcgccactgcgctccagcctgggtgacacagaaagactctgtctcaaaacaaaaacaaaaaacaaaataaaacaaaaaagcttgctgttattaatggctattttgctttagtaggccagttctgatgaaaatcttaccatttttttccattttttttctgcactgcaagagcaagagaaagtctgcttttttccattataaaggcatggactaccacttccctctacaaatttattccatagatatactaaaatatgagaaagatgatagaaaccaaggctattcctttcagtagtgttcattcagtcttgtaacagcagaagatcagaaaccatattaatgtccaacaacagataaataaagtgtagccaatgaatggaatgctatgcagctacaaaaaggacagccaggtgcagtggctcaatcctcgattcccagcacttccggaggccaaggcgggaggatgacttaaggccagaaattcgagaccagccctggcaactaagcaagaccccatctcttaaaaaaaaaaaaaaaaaaaaaagataaagctccttaggaattgatatagcatcatctcacattatatatataattatatatataatatatatataaaatttatatatatattatatatatatacacacacataattttttttccctttttgagatggagactcgctcgttgcccagggttcaaacgattctcctgcctcagcctccagagtagctggaattacaggtgcgcaccaccaccaaacctggctaatgtttgtatttttagtagagacaggatttcaccatgttggccaggctggtttcaaactcctgacctcaggtgatcacctgcctcagcctcctgaagtgctgggattacaggcatgagccaccatgcctggcctaagacacatgttaagtgaaaaagcaactgtagaacattgcagtataagcccccaatattgcacaaaagtgagaaaaaggagtggttgtgtgtagttgttttggaacacacatcctttaaagggaacacaagagactgagaatcttggttacctctgacgaggggaacaagtggactagaaaaggtatagaagggagaactttcactgcataccccctcaagccacgttaatgtattaccaaatgaacaaaaccccaaatcaaaggaaattattggtagggggaggcccatttcctggacctctctggcttccatctcagccttttccaatctccatgcctccatcgcctctagtcagggaatttcatgggcagttgccagtgctcggccttacccatctggctgagaagactactaactctggacatcaatgtgcaataaaacacttcttgtttcaaacatctagggaagtgtttgctgtttcagtgtcatgattttgttttcaagcataaagaggcagtaaattattttactatccaagaaggcaaaaaaaatccagtctacttcaacagaaactaccaccaaaccaacactgttacaattaaaaggccaagtgttaatgatcctactggaaatatatgtgcatttgttaaatgtcaaggataatgtacacaaagtttagaaacatagttatccttattatgattattaggtcatgtttttagactttatggacaccctgtatatttattgttttctactcccttccctggtaaacataattcatctttttctttatcagatagacatcagaagttagcagaacttccctcttttatcagaaaagaaaacaaaaacataaaaaaagaaccttatttggaatggaaatatccccactgcattgtcagcaatgagtgggatgctatttattactaagcatctaaatttatcatccttaaagaatgctgagaaaggaagaatgtcttcctgggtggttaaaggatgtgtgggttctgagagcagcctgcaagctgttgatgcctaagaggctaaagtcatgtgccgctgtatttatggtagattttgggcacatgtaaccagcagcacctctctgtaggaagaaccctgattttttttctcaaagagtaaaaacgaccatttaggtgttgaggctccaggtatacagatgtgatcattaaaagtgatcatcagaaatgtcaacacaacagtcaatgtccatctttttctgtgttcagaaatccaatgtaatccaatccatggaacaaactgtgaagctgtgagcttcccatatttacatatattatattgcttgctctttaaaacctgtaagtgaatttagatcctaaagaccagttactgaaaaggttttgataaagacaataaatcttttgcattaagccattactctaatccccattaaagagatcactttatctttaaaccaaggtgtgaaatcctcccagctttccccaggttaatgataaattgaaacgattccattaataatcgatggtgtgggacttggaaaggctgggggtaaggacagggacaggtgcatagaagaggtctggtctctcgtgaagccattctgtttgccacagaggacatgtagatttatcacttcttcccaatattcccatttgagatctaagcaaaggaaagtgctaggttacttctaatcagagctagccacccctcattcaatggccacatgccagggctacgcacactcttcactctccacagccgcgtagttgccaacttctttgaagctgatgtttcccaggtggagaatacccgccactatctgcaacaccagcgtttgctcttctgcaaagatcccaatcacattcatggcgtgctggaagagaaaagagaaactatccagagaagctggtcaccagctttaaaagcaccttaggaagaagccaaggcacagcagctgctctaaataaggatgtgacaagtacagacgagttacaaagaaaaaaaaaaaaaaaagccaaaacataagattgggttgtgcagtcacatgtggcttagcttgtgatgacagcaggacgttcttgtacaacatggtcactgcccaatgcacacattcttctcacgtctcaaagtcatgctggaagggcacttctgtctctaagcatagcatgccatcctccaggaataagagaatactccaggaggaaagagactcggaagagtggtagttgtacacaaagtctccaagtcctgtcttcatcctttgatgtgttcttgttgccagcttcccctcgaaggtcgctgctgacctttccacctactcaaagtggactcgagatctttcccttcatcaggagggataagaatatattgtacttgcaaaaggatcttaatgaaaaatctccaggaaatccaataaaagcatcatttaaaagtccagtttctgaggtcccttaaatgcaataaataccgctaaaatgtctaaatcttaagagaaacatctcctaagaaaactacactctaggaccagtgtgcagactccttattggcacttttccccgcagctgctttgaggccatgtgacctgttgataccattttgtttcctggcacccaggacacagtctgtttgaactttctgtccctttcaaccacaaatgtactgaacccacgctgctcattcagagtctactgctcagttctggatctgggttgaggaatagtccccagcttgaaacagactcaaagggcagtgggtggcaatgaaggcctttgaggccaagtgggtgttcagcctacctccagaaagttctacattattgcccccaggatggaacccctccataatctacctagtttcacagcttggaccataacatacatgcaatgtgaagggcatggcacagaaaaagggtcctctgccctaaacaatacagaggggaagagagtcttcaaaaccagaaaagaaataagagaaaagactaaagacgttccaaaatgtctaaacctattcagtccatagacgtgcggtttgcttagcttttctaaggaaatagctcacgaatagagtaggccatcagcaaacaggtatgctcaacgtatgaatcatttttgcctatttatcagagctcctgcagggtgataatgatgaattcatttctttttacccatctcaaatcattaagtggtcctcaggcaactggcacatggctgtttaaggatactgaaacatgtatgagcatacagagtgctcacagagaaagaggcggacatttcatgcagctctttgctttattaaccttcactgcccttttggccacaggaaatggccagttgggagagcagatcctgcctggccctgcgccagcacttaccagagtttcctgaaactcccgcctgtcgtcaatgtcatcaaccttgtatgagcccgagaggctcaggtagtaataatagtccatgctggtgatgccaaggctgtgtttctgctctgcagaggcgccctcgatgagctggagcaagagaacacaggttgagccatgatgtggaccacaaggcacccgaagtcactcctgcatcctgcagccaccatccctaaggactttctatctctgctttctaaaattacaggcagtcctggcccccaaatatgtacttgtagtagccccaggtcatctctgcaaattttgattcctaactctggaaagacctgcaagagctgaggattttccattgtccactgaaaggaactggactgccaccctcggaagagtggaaagcaaaacagattttaattacttagttcctgcccaacttgctatggctttttaagctggcttttccatgtttctcactgcagggtgcatgttaaaaaactgccatgcagcttcctgctctctggtactctttgccttctttagaagcttttccttgactgtgaacttctccaagctgcaggatctacttccttgccatgacataaccacttgcattctagcttctcccctcaccactctggcggaacccttgcatggctatttttcagtgcctaaatccaacagccttttttttggcccccacaccccagctcgtcccttttgcccaagagctctgaccatttgatcctgtcgatgtcgccctgaggcttccctggcttggtgacactgcaggatcctggctttcctccttatccttcaactacttccctgctggctcttcaatgcctcccgatcctacatatctagaaagtcccctggtcctgtgtggcaggattttctccccacatccactcccaagtatttcgtagcttcaagaatttctttttctttcttttcttttcttttttttttttttgagacggagtctcactctgtcgcccaggctggagtgcactggtgcgatctccgctccctgcaagctccgcctcccaggttcacgccattctcctgcctcagcctcctgagtagctgggactacaggcgcccaccaccacggccagctaattttttgtatttttagtagagacagggtttcactgtgttagccaggatggtctcgatctcctgacctcgtgattcacccaccttggcatcccaaagtgctgggattacaggcgtgagccaccgcacccagccaagaattactttcatgtcagaatcttgaacccctgcgcccatcagttcccagcctctattctggtggtttctgacttaagggcagagaactcctgggggagggttggggcttgcatttatttaaagaagtcctgacatccattatacacttccatctagcactgggtattatttatgtgaaatatataattatttttcacttatctatatatgttgctttaatacaattttaaaaatgactgaattcacagaagttttaatcatttatatactttttcaaccaacaggtacaaactaaaagaattatttggcattgcctaagatgtgtgtgtaattgaaaagattgaatgtgagctacttccacagtttaatgtccttctaatccagtgatccacaaactaaacacgaaatgaaacaaaacaaaacaaaaaacagtgaccaggtctttcttcgaagaaagtctaatgtggatcttcaatataaaatactaataagtaaatagaacataaaaaatttggttattaacatcattatattttttaagtacttaaaaaccttttacaaaagtacctgaatcagggccaggtgcaatggctcacgcctgtaatcctagcactttgggaggctgaggtgggtgggtcacttgagtccgagagttagagaccaacctgggtaacatggtgaaaccccacctctacgaaaaatacaaaaattagccaggtgtggtggcatgtgcctatagtcccagctacttgggagggtgaggcagggggatcatttgagcccaggatgcagaggttgcagtgagccaagattgtgccactgcactccagcctgggcaagagagcaagacactgtctcaaataaaaaaataaataaaataaaagtagctgactcagatgactgctgaagcctgtaacataatcaaaaagcaccctgcaagctgctctggccccaaactctccatgacttctgagggtctaggtggcaacttttcaatttggcattaaagatcccaaacctatctcaaatctttcctccggtagctcacgttctggagacgcctgccctgcaggcaggctgaggccgggctccctgactggctttccctctcccacctccactgctttggtgcaggtcacctgtcttccctcatcaatcccctccactttccatccgggctctacctccttcacacctctcctactatccggccaaacctgcccacctgaattcctttggcaaagactccaacactcctcgttttgttttgaagttacatcaatactttcttgatgatttagctttggaggaatttctgtcttatcactccaattagaactcactctccttgagggcaggacattctcacaattctgcacattgacttgtacatggtatcatcatcagtcctccctggcttcctagactatagtctatgcctgaagtctgagaaatattttaatgtagagaagggacaggaagtgggtaggaaaaaagtaaacaggaaaacctggtaaaatatgtgaaaactccgctctcctgggttcctcatcaccaccctagatttttccagaaggaagttggagatctttccaccatctggttccccacctggactgaactggatttcaaagtattttccctgcaagaaagttagggatttccttcaatggttggtgaacaaaacatgatgtcccaaacaggctttgaatacagtatataattcaaggaaattcattaataaaatacacattctgaattactcctaatttgagtctagacttccttagttttcaatcagacaataacccgtgcttttgtccagccacacgattctgttagagagagcacctatcattccagcatgactaaataaggatatgctctattccttgctcattttcccccagtaggtgcctgtctgctcaaccagaaggtgtaaatcatgaggcagaaaaatggcatggcaccctttcagaggaagagcactcttgctctgtcaggcttcatctcatggctttgagcaaaaacactcaatctctcttacctacggagcatctaaaatgtttatctagaacggaaacactttattaaaagtaaagttctttctagctactgacgggcctagggatttttgtcactgtcattgttatgaaaattcctctttaaatgactgctaatagggaacaaaggagaataaaaacctagactgtagttgaaaaggtatctaggttgttatattaattatatatagccaggcgcggtggctcacgcctgtaatcccagcactttgaaggctgaggcaggtggatcactggaggtcaggagttcgcaaccagcctggtcaacatggtgaaaccccatctctgctaaaaatacaaaaaattagctgggcatggtggcgggtgcctgcagtcccagcgaggcaggagaatcgcttgaacctgggaggtggaggatgcagtgagccgagatcatgccactgaactccagcctgggccagagagcgagactctgtccaaaaaccaaaataaaatgaatcaaaattatatatataattattataacaattattatatatatttcatatgtatatttaaattggtttttttttctcactagaacttaatttgtctcctgtgcttagaaacttaagcaccctcagaggccagaagggtaaatacggataaaggaaaagagggagtggtgtggtctatggtcaaactggagaagatgcccagcctcatcgcattcacatttaataacataaaaatgtgtatgctgactaaatccacccatctcagggatgaattcagctgggttttatgtctgtgactggagctgtaaactcattaagggcaagaaaagtactgtgcacactgcaaatgtgtgagtacatgccgtgttcctgttcgtaattattctaggtgtcaagaaagaccaccgaaggcggccagcctctaactgtctatgtgtcttaatctgatgattcttttcctccaggcaaaaaacaaaaacacccagcagcaccaggcacagagaaccaccagccatcgctctgcggaatgtcagtggcacctgagaaaagctcactgaaagagagctcccgtgcttcctttggcggccaccttcaccaccctttccttttggcatgtgatagagggaatacttcagtgcctgtcccccattcctcaacagttgagggaaaatgaaaccaaacagaacatctgacccaggaagggcaggtgttggacaggcaagctcccaagtcctcctagcagcagtgctcaaccttggatgccccttagaaacacctggggagcctttccaacatgctgtcagcccaggccacgcacatcagactctaggaccagggcccggagctgtgtggttttcaaaaagcacccagctgatttttatgtgtggtcaaggttgagaaccactgctctaacataataaaatgcatatgcatggctcataattgtcatataaaagttaaaatttctaacaaaaggttaacatatttaggactgctgtatagcagcctgggggggatgacaggaaattttataaagggaataaaaggttgcatttgcattttgataatgaaatgaaaagaagtttcacctcgactcttggtaatgatttatttcctaagctgggtgccagatacatagatgttcattgcattgtttttaaatcgtgtttgaagtatttcgtaatacattctttaacttgaaaagatttgtaagtgttaaatatatacattcttatgcttcataatacctgtgcattttttaaagtgaaattactcataattctaccctgatgccacttcttcattctcttgctaaataattactgtcatagatgtcaaactttgatttacatacctcttagttacctttcatataatgtgcacattaaaaaaaaacaagaacatattgtaaatattgttctgtaatctgtttttttaatttaacaatatattatgaatatcttttaaaataagtagttatttaagcaggaagcttatgtaatttattctaaaagtattgttgggcaaagataatgaacgattaaaattttaataacaattgcccaatcactttcctggaagaatgtgtcagttctcaaccaatagcgtgttttctcgattattatcaatcaacttaatgtttgcccatttgagagacagaaaattatatgtggttttcatttacatttctctcatccatgatggtgaatagtgagagagagagagacagtgtgtgtttgtgtgtgtgtgtgtgtgtgtgtgtgtgtgcaggtgaatgtgtgtctgaattgtctcttccaatctttctatcagggttgtataaaattttgcaattagaaaaataataaatgttgagtgtttttgttatttacagaaactgatatatcctccaaatataatgaataatttatattgcaaaaatcaatgaaaatatcaatttaattgttttttttttctggtctccaaggaatccaagacaggggaaaaggtaaataaagagttaaatttggtcaagtccatttttataagatttagattgaaaattaattcaagtggaaaatttgtttaattcttctttcctattttattatctggaaaacttcttcaggataacacaactcaggcattgggcccaaatatgagagacaaacaaatgagtagtttgaataatattggaaagcaaagaaagtaagggcaagtctaacagatagaacccaccagggaacttgacagttattatatgagcacatagtaaaaattctcttggaaatagaagcttctttccaaaatagacagtggaaaagaaaattgtttttctccaaaattcccacttatttattttaaaacgttccagaatcagcctcacagatggctccgtgaatgctttagtgccagacatgatctatggttgaaataagatgcaaaatctatataaatcaaggttactggataaacatttgtttctttgtaaatgtggcttttgtcaaggggaacatattcatattcagccttgccagctttcctatttaccccctctggagacacccagacagaaacatgactaaatgagcattcataacaatgcacttggttgacattttcattaccagttaggtaagccagttaagaggcaacctgtgaggccaggtccagtcactttgggatgtcgttaggttacatgagtagggcataagacagatgcacaaagccagagggctgcggtgggcaggcagctcgctctgagggatggagaggaggaagtttctctccaaggtgccagatcagtctaactctgtgcacccttcagagtctatggaccaagttctaagaagcaaaaccactgccagtgggaaatgatacctgggatacccctctactctagttatttcttggtctgggaaagaaggtcttttctctagggcataaagacaactcctccaaggccaaagctgccactttcatcatttattttccttagtaaggcaactgatgtggaaaatgattttcaaaattatcttgtttgtatccccggggcgcaaaaaaaggcaaactgcagcttggcggcatgctgctatagaaaatgaaggaaagatcgaagaggtggcctcctgatgatatgtgaaaggctcccatttcctgtgggatactagacttcagtcagaagcatcaacatcatcaatcaagcgacactctctgaaacagggaagggacttacaaatcggctggagttgttgttccggacggtcttggcgttcccgaaggcctccagcagcgggttggactgcaggataatgtccttcacgtgctgtcccagcaaatagaccggaggttaggaaggtgtgaacacctaccacacagtgtacgccaaactttctctaaggacctggtttctgaatgcattaaggtgaggggccccacacccgtgtgtcactggtggggtttctggaggatttattctttcaccatgacagacctcaacctgtttgtgtatttgggtcttccaattcccatggcttgatgcagagtccccaggagccagggccccactgtcaatcaggaactattcatacaaacgttctcagtgtccaaattgattgctgcaacttcaccaaaagtgaagtggtacctgaaggggcgtgtccttgctgttctggccagggtctttcttctcactaccccttcccaactactctaccaacccatctcatcccatctccacctgcttcactgcaagttaccttaaggaaaattaatccacttctcctccccaaacaaggttatggaaatatagcctggtgtttctcaaactttaatattcatgaatcacctggggatcttgtcaaaatgcagatgtggacttagtaggttggggtaggcccaagaatctgcatttgtagccagctccctggtgttgctggttttgccagcactgatacacactttaagcagcaagggtcaacagtggatcgtgtggaacgagtcctggcctggggggaaggatttgtttttcaaacatcccagttctatgcagaagtgtgcaaaacacaccatagacatgagacagctcaatagatagaatttgatgttggagaagtctttcaacaagtgagtcattccttgtacttctaattattcacatgctatggttaaacatgttccagaaataacaagtcttctggcttgtgctctttagctactgactaattccaagccaagggctctgtatcattgtcctcataggaaaacaggaagagaaaaatcaacattaactgtctgcagtctggctactaggtcgtaggggtgtagcaaagaggagtaaattaatgaactactaactgactatgtaacagccaaagtgttacaaagggtgtaacaggcaccctcctgaacattcagaagagaaactgccatgagaaatgagaactgggctttcattgtgacgagggaatcatccttagccatggcaccaagggcaattctgggtggtcctttcatgggtcagtttcaaagcttagaaacatactcccaacctgcctactctcttttaaaaactcatggatttatataaactctgcttttctttgtaaaatctattttgagtttgtggatcttcattaactctttctatctttttttttgctggccagacatgcccataccacttaacaaaactcagcttctctcaggaagagaacaaaagccagaatcttcttctatcttttccctttttaaattacagtgtttaaaatgagaatctttatgtatccattcatccatccatccgtccgtccatatgtattcatcaacaatcggtgatgttcaacagaattttgtggcatgtggcgggcatattagggaaaagagaaagagcaaactgaggtaaaagagtagcccatcggccgggcgcggtggctcacgcctgtaatcccagcactttgggaagccaaggcgggcggatcatgaggtcaacagatcaagaccatcctggccagcatggtgaaaccccatctctactaaaaatacaaaaattagctgggcatagtggtgcacgcctgtagtcccagctactcgggaggctgaggcaggagaatcgcttgaacccagaagacagaggttgcagtgagctgagatcgcaccactgcactccagcctggcgacagagcgagactccgtctaaaaaaaaaaaaaaaaaaaaaaaaggcagcaaaacagcatcctggattcttgtctccatgtcaaccctctcaggatccagtacaatcacaggaatagagaaaagcaagtggactgaaccacatgaacctaggttctatagctgcccttactgtccaatagggaagccataagctaccccaactgaggtgtaactgtagaatacacactgtatttcaaagacttagtaccaaaaaaaaaaaatctcattaattttgttatattaattatataataaaatctttttttacatattgggttaaataatactgttttaaaaagtaatttcctttttctctttttacttcttttaacatggctactagaaaatttagaattacacatatggcttgcttcatctttctactgcacagagctgctctccatcttcctttcattcagagaaagaggccactttaaggacccttcactctgcaaccttagtttgctctttctcttttccctgatatgctcaccacatgccacaaaattctgttggacatcactgatcactgatggatggatggatggatggatggatggatgggtgcatggatggatgggtgcatggatggatggatgcacggatggatggatggatggatccataaatattctcagttttaaagtctgtaattaaagaagggaagagatagagaagattctgtcctttgttctctccctgacagaagctgtcgttaaatggtataggcacgtctggcccgcaaacaaaagatagaaagagttgatccacaaactcaaaggaggaatgtttggctctaccttaagctttctgatctaccagtacatgatagaacactatttaattaatagaaaggggccagacatggtggctcatgcctgtaatcccagctctttgggaggcccaggtgggtggatcgcttcagctcaggagtttgagaccagcctgggcaatgtggtgaaaccctgtccctaccaaaaacaaacaaaaattagccaggcatggtggcacacacctgtggtcccagctacttgggaggttgaggtggaagggaatgcataagcccaggagcaggaggctacagtgagctgagatcatgccactgcacttcagcctgggtgacagagtgagaccccatctcaaaaaaaaaaaaaaaaaaaagggaaccacaataaagagaattttatgtgtcttttgaaagtctacagctgaccatggcaataacattacataattctgatttaaaaaactaatctttggaaggaattctgtcaccagcggtgcatactggtgatgagcgccaagcttgggctgccccttatggaccttagctcgccatcaccctcatccatggctctggggagcaggctttactcattcctgccaatgctgattttaattttcacctcttgagtatcctcattctctggatcttttctctttcccaacactcctttacactctttaatctctcttttttccttctcttaaatcctttctctgtctacgtcctttaaaatttttataagtttcttgaattggcaagtggttcacatagctcaaaccatgcaagtttctaaagggtatacaggaagggtaggcccttctcccaacctcccagctcccctccctcaagacaaccattgttgacagtttcttgtgtatacttcgagggatatgtgataacatacccaaacaaatacaaatgtgcactctcttttgatccctcaaatggcagcatatattacaaacaatgttctgaaccttgtcttttgtaattaatgatacatcttggagaccattctctatcagtacaatcggtacatgaagcctcatttttattgctgtataatattctattatataaagaaccacaaattatttcaccagttgcctagtgatgaacacttaagttgtttccagtcttttgcattaccaaaattgacagaaataactttatacatgtattattttgtatacatttcagcatatctaaagaataaattcttttcagcagaactgctgagtcgaatggcatacatgtgtaagtttaacagattttgctgaaatgttcttcattaaaatgtactagttcatctcctaccagcaatgtatgagaacaactgtgtccctacttcctaccaatcaagcgtttaaaacatggtaagattctggccaatctgataggcaaaaaatagttttctaatgcagttttaatttgcatttttcttcttatcatgatggtgaacatactttcatgttttgtgagtaatttatatttccttttctatgagttgtctttcatgtcctttgtttattttccttttgggctgctgatctttttattgatttgtaggagttcattatatattaggcacatctaccttaaaatatgctattccttaatcccagcactttgggaggccgaggagggcagatcacctgaggtcaggagttcgagaccagactggccaacatagtgaaacccccgtctctactaaaaatacaaaaattagctgggcatggtggggcacacctgtaatcccagctactcaggaggctgaggcaggagaatctcttgaacccgggaggcagaggttgtggtgagccgagatcgcgccactgcactactccagcctgggcaacagagcaagactctgtctcaaaaaagaaaaaaaaaaaatatatacacacacacacacacacacacacacacacacacacacacacacacacacaaacacacatacatatgctattcctttccattccagatttcaagtttcacagttatagaagaaccagtgtcttttctgtggaagaaaaattcttttctaacagcaaatggagcctcttacatttcccataacataaggtatcataatgggccactgcccactcacctggactttggtccctcctccagacactctggagatgtagctcatgatatatttggcagccactgtttttccagcaccactttcaccactaaagaaagacagacaaagaatccacctgagaagtggattgcgaccagctcccttccttgtctcccccatcacacaaaacaaacaaacaaacaaaaaaacaaaaaaaacaggcagaaaagaatttttttttttaagtacaataccagtagagaaaggcaagttacagcaggattaggtcgcccatgtgacccgtgtgagccggattaacatggtgtggataattaccactgtgcacaccactgaccattaagcattttacatgcccaataatgggggatatgattaggaaaattatggagtatcacaagggtggaattctacataaattacaactgacatgaagactgtaaacacaggaaacaagcaaatgaaatcatgttaagtgaaataagtcattcaagttatatacaaaacatgattacaatttttttttcttaaaaaaaagactggaactaccacaaaatattaacaaaggctttggtcaagccagagactagagaaacttgttttaattcattagttttcaaacattttataatgcatatgctatttttgtaatttaaaaaaagaaaagaaaaagtgggcactctgaggtttcaaaccatgtgccttgaattgatgcaagcttccttattttagaagttctaaaattaaaccttgaagcaatattaatcacatccggagtaacaaaggccaccttccgctgggtagccttcctgcatggggagagccttttgttaataatatatagtctgctcttcaaaatccccattcttcctacaaaatccccctgaattgataatgacctcaattcaaaacatgcttaagtcagtcagatttttcatctttctattggtaccctttgtgttaccaggatagaattaaagaaccccatatcatataaaatgatggtgggagttagtatgaaaaatgcagactgctacaagttcataggacaatatttttgttcgcgcttcgcgataaaaaattttagggcgcagagcaaatgttcttctatgaatatccagcccaaattaattgttatcgattgctgagttactcaaggaaagagaaaacatttgcttggggaacaaccaagcaaggtgacactcctattcccaaaaggaaactgaaatttgaaataattttacatttcaaaacaaaacaaaagaaacaaatgaacagagaattgagctggccatatagcgaaactcagaactttgctgaatttccttgaactaataatacggttttaaagaaattatggggaggcgggaaccatcctctgttcagagctcatgacctgcaaaagtctgaacccacctatgcaagtcactcaccatcctagtgctatgctcctggcttcctggtcacatgaataagaaaaccaaactgaaatttcgtaagctacagtagcaagtagaaaaccagcaagcctgggacgaggtgtcacactcttccagaggacatgcttactcacaggcagcaactaggtcgggcaaattcaactccatggggaaattatcttttcaaatggttgacatactcagatgatgtatttactagatccagggtcaacacacacactctctcattggaattacacggtttggcaacaatgaaactccattttagaagttgtaaacaatgtaaacattcaagaatattggaaagtccaagcttacaatggcacaaccacccaatataatactgcacaggcatttgaagtacttacaaagagtatgtagcaacataaagataatgcagcctaagttaagtggtaatgtgaatagaagatactatatttataacaagtttacaactatgtgaaaataatgtatgggcaaaaacaaattgacaaggaaaaagaaatattccttacttgttaggaggctggtataggaatggtttttttgaaatggagtctcactttgtcacccaggctggagtgcagtggcacaatcttggctcactgcaatctctacctcctaggttcaaatgattctcctgcctcagcctcccaagtatctgggattacaggtgtgcaccaccatgcctagctaattttttaatttttagtagagacggggtttcaccatgttagccagactggtcccaactcctgaccccaggtgatccgcctgccttggcctcccaaagtgctgggattacaggtgtgagccacgacacctggctctttttccttttcatgtgctttctcataattttctattttttttagatttttatgccgggtacaatggctcgtgcctgtaatcctagcactttgggaggccaaggtggacggatcatttgaggtcaggagttcgagaccagcctggccaacatggtgaatccccgtctctactaaaaatacaaaaactagctgggcgtgatggcaggtgcctgtaatcccagctactcaggaggctgaggcaggagaatctcttgaacccgggaggcagaggttgcattgagccaagattgtgccactgcactccatcctgggcaacaagaatgaaactgtgtcaaaaaatatatatatatatattttttttattttttaaaatttgtgtatttcagattttttaaaacagcttttccagagaaaagggagggatcacacctcacaataatcaccactgatcaatttcattacattattattattcaacttcctacatatcaccataagtatgtatattttccttaagtttacactgtcacatttaaactttactagaacaagctgggaaagagagagagagcaagcgtgagcaaaccctataagaattataaaataatatatataaaggggaatttattaaatttaaaaaagaattataaaaggacagtaatcccagtaatcctcccactgtgtctttggttaatactgtattcagacatgaaatattttgtctcttttgttggaaacaaaagcaagtaataataatggaaagtagctcttttaatatatcaaaataagtataccagttccaaaaataggatatctgcattctcagcaactatgatcttttccagcagacttaaaataattagttctcactaaacattgatcggaattttcattacttggtttcaatttacagacacttaagaagaatttttattgatcagaggctggtgagttggtcaaaatatggtacaataatggaatgttacagaatgacttgaaacctacagtatatgcaaccataattatgctggcctgtttgggatgagaacatattgtttcttctccggcactaaaacccaagttaaaagaaagtgaaggtcttagacaaaataatatatcccaaattatttactttgcatctcacagcagttattgtacagcaatttgctttgtttacgcttccaggcagcccgtcctaatttaattgacttataaaatggacacacacacacaaatactctagaaattaggaaaatatcccagtggttcccaaatctggcagtctatcagaatcgtcagagtactttttaattgcccatgtctgggcccgtcttctgacctgctggatcccagtctccagggacagagtctaggaataggaatttctaacaaactccctagttcttgtatagccagctgggaacaagccaagcaattttaaatcaaagtcataacagactttataggaaatattaattcaaataggaagtattgtagagtgtgtgtctgtgtgtggggggggtctgtgtactaactatagaaatggaaacatacggtaaaatatcaacgaaatggaaagaatgttctggggaaaaaaagccatttacaatggtataatccaaggaccataattatttttctgagaaaggttattcctcacttaaaagtcaatagtattttctattcacttcaacttattcagcaaatgtaaaaatatttcagttcttttttattttgattttttgagatattccctaaaataagtaggatccgctgttaccactgttggacgactcaccaatgcacccccatcccccatttctgatctaaaaatctctctcctggctctgtaccacaggaactggtgttcccttgtaactggctgaatcaacgtaattgaaatatcacttttccaactttttgtttgtggtttaaaaaggacaaacacttaaaacaaaaatgatgtctacttttgttcatgcaacacacactgtctaacaaccccctctgccccagtgtgttaagccgaaggccagaatgagatgtggctcctgtcagagaagagctcactcactgtcttacagggaagtcgagtatacaaaggctattaataacacagtggagatgtgggtatggctttagggatttgggggtggcagctatccctgatcagaagattactaaacgaagtcacaactagttacatctcaataaggacaatcaaatcagccaggtgtgttgcgtgtgtgtatgtgtacttgtgtgtatacatgtcaggggctgggatgaagcctgagccatacataagaggcaaaaattctgtggggtacacatgaagggaaccatgggtagttaaacaggacttgaggagacagtggctcacacctgtaatctcagcaatgtgggaggccacgggagttggagaaccagccttagcaaacagcaagatctcgtttcttaaaaagaacaaaaacaaaaccccaaaacacaaaagaaacaacaactataataataaaacaaataaaaataaaaacaattggctgggtgcagtggctcacgcctataatcccagcactttgggaggccaaggcgggtggatcaccttaagtcaggagttcaagagcagcaagagcagcctggccgacatggtaaaaccccgtctctactaaaaacacaaaaaaattagccaggtgtggtggcatgcgcctgtagtcccagctgctcaagagatccgaggcaggagaatcacttgaacctaggggacagaggttgcagtgagctgagactgcacgactgcactccagcctcggtgacagagcaagactccatctcaaaaataaatagataaataaataaaaataaaaataaaaatttttaaataaaaacaattaaaaataattagctgggtgtggtagtgtgctcctgtggtcctagttactttggaggctgaggtgggaggattgtttgagtccaggaggttgaggctgcagtgagctattgttgagctactgcactccagcctgggtaacaaagtgagatcctgtctctaaaaaataaaataaaataaaataaaataaacaagtaaataaataataggccttgactgtgatgtgggaagctgggaggggtagggagtggagctggaaggcagtgcagagatccaagacagtgaccttgggttcaggtttggggatgcaccaagggttctggcctgtgccatttcgtgctacattttatatagactctagacttccattttctcaaggcagcataccgacaaacttgcctttacctatacagaacaactgatatattatttacttagttttcaaaattgacacactttttgttggtctctgaatactattcttcaataaaaagaacaagggctgctttgggaaatgaccaatgccagggctggagtggggaaaattcaaactgggcgtggaacatataactgtgccaaaaggtaaggaaatgtacagtgactggtgtggacgtgtcaagcatataagagccagctggaaggggttcccactggccaaatcaaaataagtaatgataataatggattacgatcctttgaataaaataggaagccataattccatagtgccatacgaaagtaaacgagtcaatcagtaaataggagagaaaggaaagctcttcctcacagtggaataccaactaataaatgtggaaggaatgatggaaacagatatatcaccatttggcagccatcatacaggtgtccaggagtcattaatggatgctaaggctggtaggtggaggtttggatgtggagaaggatgttgtcatgatctgagaatatatccccacaaaatacacatcctaaaagaaaataaaattaatttaatgagaagaaacctagcagatgcctacagaaccaggtgatcaagagccctgcattgtttctatggtagtccagcctagaatgcatgacctgagcctggtcacgaggaaatgggtagactcagcctgaagtcatcccacaaaatttaatgcctgaactctttaaagctgtaaagggcaaaaaacatggcaaacacagagaacaagatagaaaagtcagagaggtacacagagaagcaggaagatgcatgtggcttcatgggggccaacggagttgggattaaccatgtcaatgtgtcagggagataaacaagacagtggaaattcccactggacttatttaattagaccctgcttttttttttttttttcaaatatagagagatatagtattgaacacaactcttatttcaaaaggtataacccaaggattaaaaatatagtgatagtttttaaaaaccaatttttgtaattctagagttataaaagatgaacgcagttgttcatctattaaaacatagtctagacgatgagaaataacatcaattccaaaggaggcttgaaaggaacacactgaaatattgtggctatgataattggaggtacgatgtgttcattgtgtgtatcatgcatgtcagagactgttataagtgctttacatgtgtcaatcacttggtccacataagagtcctgtgtggtaggtgcttttataatctccattatttgaagtgagaaaaggtaagaaacttgctgaaggacacttagctagtgagtggaagagctagaaaaggaggtgagagagtctgtgtcaggggcaagagctctactgctcagaggacggtaaacctttaagaccctcatatgggttgactagtcaataaaaatcaacaaggtttcacaaaggaaccccatgaacagcacagttcatagtatcagcaaacttttagctactcctgagtctttactgatacacacccatttaagcaagccttctgccaacaacatttattacctcacgcagagttggaactaacaaataataaatagcctacatcactgtgatcataagacaaagtaattctgcgagaatgagaaaccacatcaaagaaggtcctggacagtcttctccaatggctcaattcacagactccgcttcctggcagccctactagatctggaacagaaacaagtcggaggtgaagcacatctgggaggttccagggtcatggagagaggggtcctccatcggactttagaattacactaaaaaactaattctcaaatacatgccatggctaatggtataaaagacaaaaacaaacagccatgctgaaaccactggctaaataagacaaattcattccttaacagattgaggaaagtgtgaataagaccaacagctgttatttcttcccaaccccagacaaatatctagttaattggtgttgtcaagcaaacaaaattttcacctactctgccaagaatatggatggccccatggcaatgctcatcttggcccagcctgatgcagtcagaggaacccaatgttgagtatgaagaccaagtttgagtcccagcccagctacttcccagctctgaaattcctttgaatgttactagcagatcttttacattactctttaagagttaaaaaatgttttccatgtatatttcctcattacactttctttatattcctttaaggtataaattcccaatttatagatgaagtaactgaggcttgcaggggtcacacgccttagacagagagaatagagtctaccctatgactcaccccagaggtctttccactgcacctcatgactgaaagtggtaatggattattaaccagttaacctaacacctgctggctcaaagcagcagagaaaagtataaagactgctgtatcggaggcgggcagctctggctgggagcacaactttgtcacatttcaaatgcaagattttaacagtttcattacctctttgagactcagtttcttgatctgcaaaagtaggggacagcaatacctagtttgctaggctgacgtaaagatgaaaaatgatacaattaaaaggatgcaaagcaagtactcgaaaaagagttgctgttatgtttatgggtaatatattaattaggcagccctcctgaatagcactccttggctgatgataaaggaattttagcaaccagactagaatgtaagatttgcagaaagcttggggaacagggtcaatctaggcccttgctcttcagatttacagccagcggcagccccatgcaaccccgtcatagtcagaggtatgggctgacagggcctcccaaagccaggccagggggatggcgaggtcaaaggccggtgctgctgggataaacaagaaattgggtggacccacagcaactcaggagagccctgaaaagcgtccccatgctaataataaaaggttcctgaaatacatcaaaggcaggaagatagcttgagaatccggagacacctgatggtgccacagcaaagagcacgagagacccacgagccaaatatgagcggcactgggaatttttcccttttatctttactactgcaaaaattacatatttcaaatctaaaatatatgttgaagcacacgggtcagaaatcttagctccagtgatgactactatctccttttcctctatgaaaactctcttactcaatcagtcagcaaatcccactgatgtaccttcaaaatatctctcgcctctatttattatttaaaaaagtatttatttagcttctatgcaggatgcacctgacaaagactttgcaaactggtattggatatatttaggacagatggtctactcaccagaaaacaactgcgtcaggatacttcaaataaaaaaagtagaaacagcaccaaatgggatgctttccaattgacatcatattttttaaacagcctaaggtgcaagagctgatttaggccaaaagtgataagaattcacttttgatggcagcaataaaactgccacataaatgttctccaaggcccgatgattctccatgggtcagttggcaagggcttcagaaatgcctctggccacattgtcaagatcttgtctggtgatggagagatggtagagatcatgaacaaagcttgccagttcttcctttaccacatcatgacctttttgttaaacagatttgcagagatgtctcttgacatccaaaggtatcacatatgtggttttaatgcacaaatccaaattctggattttggagaacagattaatgagctaagcagatatgggtggctcatttactgggctcacaggtacctaccaagccttcaggtgctcattatcattctttttttaaattttttaaatttttaatctttttttattttttgagatagagtcttgctctgtcatccaggctggagtgcagtggtgccatcttggctcactgcaacctctgcctcctgggttcaagtgattctcctgcctcagctttccaagtagctgggattacaggtgcctgccaccacacccagctaatttttatatttttagtagagatggggtttcaccatgttggccaggctggtctcgaactcctgacctcaggtgatctgcccacctgctgggattacaggcgtgagccaccatgcccagcttcactatcattcttaatgatgctaatgtagctattgctgttgcatttttctgttggcactgcccagagtctaccttcacacttgcccattcctttatttctttacaggcttactgaaagtcatacgtcggcttcctcctcgcctttctaactcaggtcaggccctcactgctgcaatagatttccatattccctcaacatcccatctcttttctaccaataaccttatctttttgaaccaggtgtcagtgctatcatgtctctgctcagaggcctgctataatatagaaataggccatagagaaccatgaaaagaaggggaagactgagctctggcccccagacaaatccactggataacaagtcaggtaaaatacagaaactgcccaggtatggccatttggtgtataaatgcatcttcacctcttggtaagaaatcaaagctaatgtgtcaataaggtcatgttcttctgttaactaagtctgtgcgtcatttatcctccgttgatgacaagcccaatcatcatcctcctgggtatgcagagagcatcacggccaacaatgacaaagggttagttttaaaaagcacctgagtccagcctgggcaacataagaagaccctgtcgctacaaaaaatttaaaaattagccaggcatgatggtgcgcatctgtggtcccagctactcgcgaggctgaggtgggaggatcgcttgagcctgagaggcggaggttgcagtgtgttgaaattgtgccactgcactccagcctaggtgacagagcgagactctttttcaaaaactaaaataaaaaagcacctgtatttgtggggacagagtgagagactttaatcctaggagctcaagtccaggggtaactaacctggcgaacctgtcctgacctctgtcctatggtatatggtagctattacatctccattaaaatatgggaaatttgagacctagagagacatcactgctaataggtataaagaaagtgcataaggtttgaagtcagacagggctaaattcaaatagaggctctgccatctactagttttggatcttggaattctcttaagcctcattttttagatgcagcttcaaaaaacaatgccaacagagtggtaaggattaagagacaacctatacgaaagcaaccagcagagggcaggcactcaggaagtctatcttgcggggtctgatggtgctaacagcaagaggtgacctgaaatcaggatttcaagagccttagccctggcttttaagcagagtgagctgggggagcttgaaaaaaggtattaatgctccaaggccaccacaaatcagttgaaacagaatctctggaggtggagcctacatatctgtagagccactgaactagtaaggcaattcaggaatcagaaatacttatccctagaaagttaaattggtgaacctaggccagccatggcagctcacgcctataatcagagcactttgggaggctgaggcaggcagatcacttgaggtcaggggttcaagaccagcctggccaacagggcgaaaccccttctatactaaaaaatacaaacaaaaaattagccaggtgtcatggcacacccctgtaatcccagctactcagaaggctgaggcaagagaatcacttgaacccaggaagcacaggttgtggtgagccaagagtgtgccactgcactccagcttgggtgacagaatgagactccgtctcaaaaaaaaaaaaaaaaaaaaaaaaaaagataaattagtgaacacaaggcatggtagataaaattagcatctataggccgggtgcggtggctcataactgtaatcctagcattttgggcggccaaggcaggtggatcacttgaggtctggagctcataaccagcctggccaacatggtgaaaccctgtctctactaaaaatacaaaaaaattagccaggcaaggtggtgggcgcctgtagtcccagctacttgggatgctgaggcaggagaatcgcttgaacccggggggatggaggttgcagtgagccgagatcacaccactgaactccagcctgaacgacagggtgagactccatctcaaaaaaaaaaaaaaaaaaaaaaaagttagcatccatagaagccactcttcctgatttgtctgccagtgggctgaggaggaaggcataggaaatatccaaggtcaaccccaggtgtttattccttactagaagttggcctaatagacatcagggcttggcaggagagagtgtaggttaatgaaagggggttgacttacagcagagtcaggacaggaaagtaaacagcagagatggggggttttctccaagtaaaaagactgttctgcagactagagcaacacccttagttcatgtgttcacatcttcagatagaggtgactgctgtgagctgatttagcaaatacgatcatcccttcgctcagaattcacccctctatccagcgttctcgtggtaatctagctcccttcgtggactgtgttccagggcacataatcggctgtccacaggcagaattctgcctatgcaataatgaattggggtctgattcacacttccttgtgagtttgcttggcaagtcagtctacccaaggctgctcaactccagctgttttgacaaatcaagtttgtagatggacctaggcttccatggagccctgtgcttgagaaagcagcacgtctccttccttgatttatttctttcaaaatccactttgtggccaggcgcggtggctcacgcctgtaatcccagcactttgggaggctgaggcgggtggatcacgagatcaagagatcaagaccaccctggccaacatggtgaaacccagtctctactaaaaatacaaaaaaaattagctgggtgtggtggcaggtgcctgtagtcccagctactcagaaggctgaggcaagaaaatcacttgtacctgggaggcagaggttgcagtgagctgagatcacgccattgcactccagcctggtgacagagcaagactctgtctcaaaaaaaaaaaaaaaatccgatttgttacactcatttctagtcttgaaatggtcaggtgcctgtccatcctgtcaccgtatccactgcgttggaaaatatgagtaagactgacaggaaactagaaacgccgcctttatgggctgcattatgccatctaaagtgtcatttagacaaagtcacaccagggaaactgggaggtggaagtctaaaacaccaccatagaaattaggtcatcgctcactttttatttcctaattaaatgacactaaagattcctagtctttccagccatgccagaatcccttagcatgaggagcaggcttctcttccagcctccaagaaaatggttttttcgtttgttttctgctcacaaacacattttaaaaggcaccattcaactcggcccctaacagatggagcacctgccccatccagtgtcaggggctacaaacttggcctttccacccagaacaggatttccctgcctttcctcctctccaacattatttggaaggaagagttccaaaaccagttccttcacaggtgaaaaagccaaggcccagacaggtgtgaggcgtgctgcccagggtcaggtgagcatgaaccacggcatgccagaggtttccaatttgctttctcaaagcagacaaaccacagccctggtgcagaagagaattaactcaagggctcaggcttttgccctcggtgactgggcggtgatgtctatgcccctggaatgtcctacctaagaggagtgcttttcctttcttgggggctttgaccataggagagtctgacgatatgatttatgtcgggggctttgggacataccatcgcaattctgacctccaactggaaactaaaggcatttgcacaagccttcgagagcagctggaaactgaaggtgggccaggcaggcggtgcgtgatcgaggccaaacatcagaggctcaggtgatgttttctggtcggcaatactgtgagtattgtcacacctcataccggtaggaggtagcgctgtccatgactccacagggagaggaaaaccagaaactccacctcgggaccctcccagacctcgccctcaacctcttttgtttggctttaatttgtatcctccttttgccagaacgaaactgtaatcctaagtgtagggcttttctgagttttgtgagttgttctagtgaactactgaacctggcgggggcggggggtagtgggaacccctgaattgatgagggtggcctggggagccctgaacatgcagctgatgtctgcagggtgggcagtctaccgaggaggcctgtgtccttaacctggagtttggcccaactccaggtagctcctaaattaaagcacatctcctaaatgaaaacacagccactgcaacagaaatccttgggagcaggtccttgaaatctctgccacctgaacagctggaaacaaggatctgaagtgggcatcatcccgcttcagtgcaggtggaccttgcagtgcaggtggagggagacacgtgggctgcagaagactgagggggcctccagactagcaagctcatgtaagaagaccattcccatcccactcgttttggcacacacccagaagagggaaaatgtgaggaaagagaaagggcagaggactctatcagaaaactcatcctggaccctcattaaattccagctaggaaaatacctcctgcctctctagtagtcggtgacctccgcttagtatcaaacagaagcatttcctattaagcaaccaaattcaacatgacccaggtgttcctcctcataaaatttaacttgcacctgcatctgatcaagtcattagatataaccttaaacttgtagaaaatccaactgaaggaataagtatagtgagaccaggaagaagcaattagacaaatgtaaatgatgtctgtaggaaaactagttttggtctcttcaaaaagtcagtgtcatgaaaaaaaacagcagtaatagggcaattgtggtaggataaaaataaatttatgattcataaccaaatgcagtcagcgttacttgatttgcataaaccagcagaaaaggacgtttgcgactattagagaagtttgaagtttttagatgatgttgaaaatgtactattaattactgagttatgataatggtcttcggatcagtaagaaaatgtttcaatttctcagagatgcatgtggaaatatttaggggtaaaatgtcatgaagtctatatttacctccaaatacttcagatatgtatttaccttgaaatgcttcagtgctcatgttttgcagtactgacttgggaaccatgtaaatgttttgcataattataaaaacaaaattacatttaaaaatgcaaaacaactgaaattgtaaatgaaataaatgaacccaactgtaggtcaggttgacatagaaaaggattattttaagtgacttttatgaaacccagtattttgactgcaaatattggatatttggacaaaaaccagaaaagaaattttaaaatgaattcagtattgctactaataatattggtattgttactttaacagcattaacaaacttattctatctgtctaaaacgcatacaatgcaatgcaaataattgctaatgtaatcaggaactaagattgttcagcataagataaatgggatacaaaaattaaaatcaaagaaataaaaactctgaaatcttaaaaattaattgaaaacagttaatttttcaacttcatttttctcttaaaaagctcatattccctagctttgtacttttaaagaactataggcactgaaaacacagggcagtgagcactcttggtgtctagtttagtggtctcttaatgccatttcccattaaaatgaaccaaggcctagcggggtgcggtgcctcgtgcctgtaatcccagcactttcggaagctgaggtaggcagataacttgaggtcaggagttcaagaccagcctggctaacatggtgaaaccctgtctactaaaaatgcaaaagaggctgggtgcagtggctcatgcctgtaatcctagcaatttgggaggctaagacaggcggattacctgaggtcaggagtttgagaccagcctggccaacatggggaaaccccgtctctactgaaaatacaaaaattagccagatgtggtggcgtgtgcctgtaatcccagctactcgggaggctgaggcaggagaactgcttgaacccaggaggcggaggttgcaatgagccaagatcgtgccactgcactccagcctgggcgacagagtgagactctgtctcaaaaaaaaaaaaaagcgaaagaattagccaggcatggtggtgcatgccttaaccccagccactcaggaggctgaggcaggagaatcgcttgaacccaggaggcggaggttgcggtgagctgagatcacaccactgcactccagcctggatgacagaatgagacttggtctcaaaagaaaaggaaaagcaaaggaaaaagaaaagaaccaaggcccctgaagagactgtggattctacgcaggaaatatacaagatgagctagaagatcttaaagaaggaaaccaacagagcctactgcggtcatgtccaaaggacataagagctaagaaaaaagagtgtcactgttcaacaacaggatcatttcagccttgaaaagtataactgcaatgtaaacaggtacaatattaaaagtccactagtttgagtaatactgaaaataaaacacatcaccttgggagactgctagggcaacaattaattgttttgaaaataggtgagtaatggcagtgaatccagtgttttgtctaattttcccacatagtttttatttgaaggtgaccaagcaaaagaactaataactgcagaaaaataatagaattagaaaacaacgatttttcaaccactaattaaacaatggctctgaaatgatttataacagacgggttcactgacaatctggacacacgaagagagagcaacaggcatgaagtgcacagcatcactgatgaagtttcctttgccaaaaacggaatctgagtctgatcgagtttttttttttttttttttgagacagagtctcactctgtcgccaggcttgagtgcagtggcgcaatctcagctcactgaaaactctgcttcctgggttcaagcgatttccctgcctcagcctcccaagtagctgggactacaggcatgcgccgccatgcccggctaattttttgtattttagtagagatggggtttcaccatgttggccaggatggtcttgatctcctgacctcgtaatctgcccacccaagagtgctgggatcacaggtgtgaaccaccactcccggcgtctaatgaagtttttagatataactattaatttacagaaaatgtaggggacaatggaatacttaagcaacatcataggatacaattaggcaatgccagactgtatagtaagatctacaggacaaacaaccttttttttttttttttaacaaagccaagaaaacaaaaaggggaagggaaaattgttaaagaccgagacacctaagagacacagcaaccaggtgcggtgtgtaggccttgtttggatcctaaataaaaataaaccaactataaaaaagaatttataggaaaatcatggaattggaatactgatattagatactataaaagaattcttcctgtttaaggtgtgataagaatgatttcttagaggcacatactaattattgaggaataaaggggatctttgggtttgctttattaaaaaaacaaaacaaaacaaaacaccatctctgtcgcctggctagagtgcagtggttcaagcacagctcactgtaatctcaaactcctgagctcaagcgatctccctgcctcagcctccctagtagctagggctacaggtgtgcaccaccacacccagctaattaaaaaaacttttttatggagacagggtttgctatgttgtccgggctgatctccaattcctggcctcaagtgatcctcctgccccctggcttcccaaagtgctagtattacatatactcttttcttgaccttggaaatgaatctactgccatgccctgccagatttgctttaagtaatcaagtgggacagaatgggaggaccaaataaaacagaattggccatatactgacaacagtgcaaaatggataatagatatacagggacacattctactattctttctcattttgtgtatatttgtaattatccacaataaaaggttttttttttcccaaaaatgtctcagaaaaattaactaaaaaagatgaacacaaatacgtatgataagattgtgaactgtcaaattctaggtgatgagaatatggatgcttatactttctagtgtttgaaaatattcacaatagtaagcagagcttttttttttcttgatatggagtctcagtctgtcgcccaggctggactgcagtggcgtgatcttggctcactgcagcttccgcctcctgggttcaagtgattctcctgcctcagcctcctgagtatctgggactacaggcatgtaccaccacacctggctaatttttgtatttttagtagagacagggtttccccatgttgccaaggctggtcttgaactcctgacttcaagtgatctgcctgtctcagcctccactaaggtataagcctttttttttggtttggtttggtttggtttttttgagacagggtcttgctctgttacccaggctggaatgcaatggcacaatctcagctcaatgcagccttgacttccctggctcaagtgatcctccccactcagcctcctcagtagctgggactacagacaaatgacaccagacgcctggctaatttttatatttttttgtagagatggggtttcgccatgttgcccaggctggtctcaaactctgcggcttacaggtgtgagccaccccaactggagttagtaagcagaattttattttattattttttttcaagatggagtctcactctgtcactcaggctggagtacagtggcacgatctcagctcactgcaacctcctcatcccaggctcaagcgattctcccacctcagtctccctagtatctgggattagaggcgtgcgccaccatgcccagctaatttttgtaaataagcagaattttaaaagcacttaaggcaggagtatccaatcttttggcttccctgggccacactggaagaagaagaattgtcttgggccacacataaaatacactaacacaaacgatagctgaagagcttaaaaaaaattgcaaaaaaatctcataatgttttaagaaagtttacgaatttgctttgggccacactgaaagctgtcctaggccgcatgtggcccatggcctgcagcccacaggttggacaagcttgacttaaacccagccaggattcagagccatgtcagactagagggattatgaaatgtggctacagacacctaatgctggcaattaccagtaatcttcccccaaattcaatgcaaatgacaaagttcaccaaaaatgttcaaacatgaactactaaattatgaagggaatgaaaaaatagggacctacagaaaaggaattcatctgactaaacagtgaaaacatgtttattatacttactgcaatcccatggaagctcaaaagttttatgatatggagctctattatatagagttataaataaagcaagataaagcagctaacctgcttgctactcagacacattaaccaggctgtgacatcagtagctgttgcaaaaccactgcttatcgaccgaaatccataaccacagcatagtctcatatcttccacgcccactgataaggatcttcttcatacctgataatgacgcactggttctctctgtcaatgatcatgtttctgtacatattatctgcaagggcatagatatgtggtgggttttcatactgtgcctagaaaagcaaaaaataataatacataaataataataaaaatttaaaaataaaaacaaaatcatggtcagataggcaatacactcaatttcttttcctgaatttggaaacgaatcgtgcactatagttccaatgcctatcattacatcttaaaggttgcatgatacaagaattcataaaacttcctaggtcatcaaggttacaccctcacaaaattaagacggaatttggaagcagtctcccgtaggcatatccatgattcagccttccggatgtgccccgtgtctttagacactccaacaccccacccttccacccatacacgcctctgcaggtgacagtccatttctaaatgtttctgtagacacttgggcaacaggtctttggagaggcctgccaaacacctagatctgacttctaccagaattctaaactcttacataattttttctaagaggccacgttgtagattctggggcctcagagggaattaggtgagattatctatggatcagaaaaaatacttaaatctttccataagaagagggcaagaaggtgtggttctttaaagggataagctagtttggccagtttgtttcatctctattggaaaaaaaaatcctaccacgctaagatattctcctgggtttgtgatttcatcttatgggatatcttagctatgcacaaatatcaaactaaatacattttccatgcttaataaattatcaggctgacttcagccctgctttatacaatttcttgacacctacctttaccacaacctcaaaaattactaaaaagagaaatactttgttgagtatatatggagaaagaacactcctagcctgtaatcactccaagctacttggtaggctgaggcagaagagttgtttaaccctaggacttggagtctagtctccacacacacacacaaatttaattagctgggtgtggtagcacatgcctgcagtcctagctacttgggaggctgaggtgggaggacagcttgagtccaggagttggaggacgcagtgagctacaattgtgggaataatagcgtccaagctgcaagtctcacagtgtaaatgacggatgggaaagcaatttgaaaagacagagtgatatacaaaggtgaagcttaacgtacttaatccatctttggattaatttacttaatccatttcattgtgcagtgacttactgtagaaaagggggcctggctgagaagttgctgctcactgccatgctctggaagatgagagtttggtggggaggggttaggatgagggggctttgtatccgatacccagtgttcttcccatgctgtaggcagggggctcatagggggagctacccagtgagggctgcaagctatgcctaggactggtcacctaaagaaccctatgcaggaaccagaatatgtgatctctgccttaaccttatggttaggagtggatacctggataggacctcaggatatggttttaaatggacttctagtccacaataagattgtgcaggattattataattattattttaatttaacagagtttaactgagcaaagaatgcttcgtgaataaggccgccctggaacaagaatagattcacagagcctccagtgctgccatatgccataagatttttgggcagaaaaaggaaagtgatatacagaaaatggaagtgagggctggccctggctcaggcctgtaatctcagcactttgggaggctgaggtgggaggatcacttgaggtcaggagtccgagaccagtctggccaacgtggcaaaacccagtatctactaaaaacacaaaaattagccaggcgtgttggcagatgcctgtaatcccagctactcaggaggctgaggcaggagaattgcttgaatccaggaggtggaggttgcagtgagctgagattgcagtattgcactccagtctggtgaagagcgagactccgtctcaaaacaaaacaaacaaacaaaaaaatatatatctagaaaatggaagtgaggtacagaaacagccagattagttacagattagtttagaatttgccttatttgaacacagtttgaatagttggccacctttgattggccaaaactcagtgactggcagaaaagtaggttatagtttgtttatacatctggttaggctacagttcactgtgcacagagaaacatttagcgctgggtgtgatggctaatgcctgtaatcccagcactttctgaggcaaggccagaggatcactcgaacccagcagttccagatcaacctgggcaacatagtgagacctcctctctacaaaaaagaaacaaaattagctggacatggtggtgtgtgcctgtagtcccagctatttgcttgggaagctgcggtcgggggatcgcttgagtcctggaggtggaggttcctgtgagccaagatcacagcactgcgcttcagcatgggtgacagagtgagactttgtttcaaaagaaaaaaaaaaaagaagaaaacatttagatccaacttaaaatatgtaaggaggcagctttaggctaaacttaatttaacaattcccctctcttgtttttttttgtttttgtttttaaatagagacagggtctcaccatgttgcccaggctggtcttgaactcctgggctccagtgatcctcccaccttggcttcccaatgtgctgggattataggcatgagccaccatgcccagtccaatttccctcttttggtcatcctctcaattttgagacactgaccaaaactttaggcactgatgtcactctgtcaccattgtaaaaatgtacttacttgttctcaaatatcattgagaaataacagaacagtagggtttgtaagattggaacaaagactctaggttactttttgtaagggttagagtagagcggacctcctcctgctggcatctcctggtctgtttctttaaagtttcgattatgtcacatgtaacatgagtgattccatgttggtttggtttggtctggtctgttaggggctactgcatgagatcagtccaaaacaatggactctcataattttgtttaaaaattcccctctttaggtcaggttctcacttaggtgagagtgtcaccaaaacttagcccttagcacccctctcagttaccctcattttgggtttctggtctcaagtgcacaaacaacattaatgactctttgaaaatgagaaagtagaggactgtaagaaagacacgaagatggaaaatggaaggaaatggagtgaaaagcaagctatgggcagtgggggaaagtcattgcccagtaaggcttcaacgctgctgaactgtcatacttgacctttgcatgtcactctatattttccaaactcgtttcctatctgtggtcttactgaacctctcagctatctgtgacaaaactatagagtgggcatttcctttacctgattcttccctcccctgagactctcaaagtcattaggacctgacttcaactcctagctccatcactcagtagattttagtacttcatctctctgagcctcagtttcctcatctgtgaaatggagatagatgttatgacacagccagcatccagggctgttttattattgctgcaagtataacatagtacatggcactcagtaaataccagttttacaataatctgttactattagcagtaaaattgagcatattttttagaaattctacatttccttaaagagaacacttcaaaagataaatggtctaaaagggatgtgtatacagcaacccttttcagaaaactggagagaaacacacatgcacagcactaccatctacagcgccttggctgtcattgaggacgccaagccagctctgtgcgcctgctgatcagggcactagggcagggccagcctctgctgacagtgtttcccttgtgctgggctcccataaaggcagcattatcaaaggtctttcgcgtggcagcctccttcggctccagctaccagcaccattcatctggcaacaatggggtgggctcttgctctgggtaaattgccttccacttcaactgatgaatttgtgtgggctctcttttgtttgctttttaggggtcaggattaatgaatactcttgtgcttctgctgcagtgggaaggaaaaggaaaggaaaaagatgcagagatggggaggcctggggaagtgatgaaccacagaataaaatatattaaggagaattacagcttccatttttactatacaactgaaatggctatggagctgattatgaataggaaccagggtcaaattaataaatgaagtaatacaagattcatttttcatgttgaagtcatagtcatagtttaacaatggttctgattctgcaaatcagtacccattgctctatttttttacccataactgatttttattccttagatttttgtggcatatatggaagcaggaagatccctaagctgtaggtcctacatcctatttaactaattttctatgcaaataaggctcaaatattagacagtcctaagcttttttgagctctgctctaaaaagcagatcattggccaggcgtggtggctcaccagcactttgggaggctgaggcaggtggatcacctgaggtcaggcgttcaagactagcctgaccaacatggtgaaataccgtctctactaaaaatacaaaattagccaggtgtggtggtgcatgcctgtaatctcagctacttgggaggctgaggcaggagaattgtttgaacccggaaggcggaggttgcagtgagcggagatcatgcccagcctgggcaacaagagcaaaattctgtctcaaaaaaaataataataataaaataaaaataaaataataaaaattaaaaaataaaaataaaaagcagatcattaaaaatcaaacaatgtcactcaagtttctccaataaaaaattcataatagaaaagtgcaaaagtactgctaacttcaagaaaaaccatgtctgcatcataaaagccctaaataaggcagtaatttatgtgacacgtaacttaccgctccttggtacatttcaatttccttttccccaaaatatggcatctgcttgaaagggttgactgagattaatacagatcctatatatgtctgaatttaactcagttaaggtccatcattaatattcatagctacacatttttcaaattaagtaaccagatgttatcaagaattcacaatgactgtccaagtggaaagtttgtgtacttgttttctaaaagattacaagtaaagacgaaagcaatcatccaactagcacaggctttattcctcctaaggaagagtaataaattaccaaggtgctacaaaatgaaatcattattttaaatgaactaaagcacattctttcaagatgggtgacacgtacagcaaggagaaaagaaaacaaaggaaaaatggccaaagagtgaaaaaagcagttatcagtcctcccctcaaatgatatgcattttttcctttgaactttcgtatccgttaggtacactaaaaacatattcatcagccgggcgtgatggctcatgcctgtaatcccagcactttgggaggctgaggtggggagatcatttgaggtcaggagctcgagactagcctggccgacatggtgaaactccgtctctactaaaaatacaaaaattagccagctgtggtggcacacgcctgtagtccctgctactgtactcaggaggctgaggcaggagaatcgtctgaacccatgaggcggaggttgcagtgagccaagatcatgtcactgcactccagcctgggcaacatagtgagactcttgtctccaaaaaaaaaataaaaaaaaatattcatctacttatttaacaaatacagggatacaagatgaactaacagctctgttctccagaagcttagaggaattaaaaggcatcaatgaggtaattttctggccaggtgcagtggctcatgcctgtctgtactcccagcatgttagaaggccaagggggtggatcgctttaggccaggagtttgaggccggcctgggcaacatagcaaaactccatctctaaaaaaacaaaaacaaaaacaaaaacattagccaggcatgggggcgtgtgcctgcagtcccagctactgggcaggctgaggcgggaggattgcttgaggccaggagtcggaggttgcagtgagcccagatcagaggttacagcaagccaagatcacgtcaccgcattccagcctgggtgacagaaagagaccttgtctcaaaataacagtaataatcataaataaggtagttttcagagaagaaaattataaacccacctacatcaggtttagggaaagaaggtattatttctgcttggggaatacaagatggcctctcagagaggctatgcttatgctgggccttaaaaattttacacattttaatatatgaaaataaatgaagacttatgatcacatgaaaaatatttccaattattcattcaacaatcaactaatttgaattgggtgcttacttaacatgccaggcactgttttagatgctcgggatatgacagtgaacaaaataaatagaatatatataacttcttgacttcatggagagaataaatataacttcttgacttcatggagaaaaaaaatctaaacaacacacagagacattcaaaactgtttctttcaatgatcaatttcaaggtgtttagaaattttacaaataaattgttaaacagaaagttatttacaaatatatagttttagataaagacttaaaactatgagatttcctcccacaggagaacatttttatatttacatattaagacctgtgtaccatgaaaaccagcccaggtgttcagtcagattggctggtgctgatggagataaaataggacctacctgatagtctcattttacttaaataaaataattatagaacactcagcactgtgagcacagcacatagtaatggcttttccttaattaatatcctctaaggcacatgttttatcatgtaatatctcaaatcatgatgcatgtttcaagtgtggcttaacatgccaggtgctgttttagaggcaatggtttgttagtttctattagacacagtgttattactacttaatacaaatcaatgtgagatggatcatataatcatataatttttttaaagataatattttagattattgtgcatatacaaaggtaagcatgcagaatgacatgattatgcttttacttctctttgtcactgaccagaaagatcttcatacttgaaggggtggaacatgaattgctattagggaagatgaagtggttttaagaccacttcagcagtgcccagttctggtctaagggcaggccatagtgctaagagaaaatgctgatgagacagtgattgagccataactgaaaattactgaagagttatggaagaagggccatggaaaatgtattcccaattgccaaagtcagatgaggccaatgatagattagtgaaaatttaggacacatacatgtactgttaaaattatcaagcaggtaagacgtccatgatgccgtagccaagactcaataaggcgtcataaaattaattaaacacatatacatttacatcttagcaccaaataacaacctatttgacttcaggttgactgtcccttatccaaaatgctttttgcagattgtgctttttttcatattttggaacgtttgcattacactcaccaccagttcagcatccctaacccaaaaatccaaaatcgaaatgctctgaagagcatcgtgtcgattatcaaaacatttcaaactttgcagcatttcaaatttggaattttcagattaaggatactcagcctgtacagggaaactgaggcacggagaaatttttaaaagttgcttaaggtcacacactataagtggcagagctaggattcaaactcaggcagtctggatcccacgcccatactcttaatcaaaagctagaatgtctaagataagcaggtactgttgcgttaatattattactggtagccagatttagcaaataaaaacacagaaaactagttaaattggaaagtcattcaaacaagaatttttttaagtatgttccaaataagtatgttccccagtaatatttggtacatacttatagtaaaaagtaacttgttgtttatctgaaattcaaacttaaccagcagtcctgaattttatctggcaaccctaaattggcagcctcttctaacttagattctctgatgctttgcatactcgaaaacctaattcccttaggtggatttttaaagtatcttttctaattggtaaggacctaatcaaaattgaatgaacgagcaggttgtggtggctcaagcctgtagtcctagcacttcgggagaataaggtgggtggaccccttgagctcaggagttcgaaaccagcctgggcaatctagtgagacctcatctctacaaaaaatttttttaaaattagccaagcatgttggttggtacgtgcctgtagttcctgctgaggtgggaggattgcttaagccaagcaggtcgaggttgcagtgagccatgatcatgccactgcactccagcctgggcaacagagccagaccctggctcccaaaaaagaaaacaaacaaacaattaatgaatgaagtaataatgattcttatggtaaacccaattttaaagaaacacagcactgctagaaccatcttcacttcagaagaggaagatgtttatttcatgtctacatctatccccagggaaaaacaaacaggcaaataagctccttccatggaggagggtacttgttcccttagttgtaaagggaatgtggttactgccgccttgtcctagacaaattgatcactgcacacaaagaataaagggctgccctcaggacaacagacaaaggtaccacctccccaccaatcccttggttactcaataaatatgaattcagttgcatatgagctcctaaagtgaccaacattttaaaaactgttaatttgctatataaagagatatctcattaagtcttgatttttcaccaagtagattacataaattctgattagggcctggttaaggagatattcaggaaaaaaaacaaaaacaaaaatttattttggactattctaggccaatcgtgaatcaatgactcaggtcagaatgaaatgaagagggaaatttgtacctgctccctaaatttatcagtagggttcttggggataatactatttgggaagacacctaaaaaataaagtttggtttaaaatggctgtttctggttgggtgctataatcacaacactgtgggaggacaagtgggatgattgcttgagtccaggagttcgagaccagcctgggcaatatactgagaccccatctccttaaaaaaaaaaaaaaaaaaaaaaaaaattgccaggcatggtggtcttcacatgtagtcccagctacttgggaggctgaggtgggaggatcacttaggcctgggaaggcaaggctgcagcgaactgtgatcacaccattgctctccagcttaggtgacagagcaaataaaataaaataaaaaatttaaaaaaaagtctcaaaaaataaaatggctgtttctacagaaaaactaaggagaatttaattgatttaaagaaaataaacatatcgtagttatttccggtgagagtttggaataattgtttatctaaacaattctcaccttttccaccttgctatgtctgcagagaccttagctattttccggacacctgtgctctcctgctgctttgggaactccaggtaattccaacaatgctcactcccactcctgttgcataattcaggtgtgcctctgggaaaagccgttcggatcattgtctttacccacataatccttggtggtgaaggtgtggcctaaggttaattttcaaactgcataaagatatgaagctatgataccaaaaaacagaaggaaaaaaatgccaattatttaaaagactctgggagacagaagaaacccaagatatctttaactgatgggttcccaaatgcctgcccgtggatctatcagttttcattgacctgcagcaagaatgacaaaaaaacaaacaatgcactgaatttttcataaagcttaatttattcaaaataaagaaactgtcctttattcttagattatgtccttcctacgtttttggtgtaaaaatattttcttttatgaaatgtgatggcagtacaactttcaaattttgttttttgttttgctgttctttttttttttttttttgagacggagtctcagtctgtcacccggatggagtgcagtggtgtgatattggctcattgcaagctccgcctcccaggttcacaccattctcctgcctcagcctgcggagtagctgggactacaggcacccgccaccacgcccggctaattttttacatttttagtagagacggagtttcaccttgttagccaggatgatctcgatctcctgaccttgtgatccgcccgccttggcctcccaaagtgctaggattacaggcgtgagccaccgtgcccagcctcaaatgtttgtttttaatagtcttattaggcaatgctaagagttgaacttttaaaatctttttttttttttttttttttttttgaggtggagtcttgctctgtcaccaggccggagtgcagtggtgcaatctcggctcactgcaacctccgcctcccgggttcaagcaattctcctgcctcagcctcccgagtagccgggactacaggcatgcgccactacgcccggctaatttttgtatttatagtagagacggggttttcaccatgttggccaagatggtctcaatctcctgacctcatgatccacctgcctcagcctcccaaagtgctgggattacaggcatgagccactgtgcccagccggttaaaatctatttgaatagtcagtgaatttcccaaaaccacctacgctggtcgagtggacttccttgggttcatccctgaggtggcacagggaggtgagttgacttccccagagtcacgtggagagtgggtggcctggaactcgaagctttggctccagcccggcatctgtcttgctatatagcatgctgcccctccagtgaactggatgccaagggccagacctcactcggaacaactacgctgctttgaaatctagtgggtctggcacgaaaatctggactcctaattcaaggattaaaaatgccaaacacacctgagtgtggtctttgagtaaaaacaagtttggagaaagttggaccgaatgagcacagagtgctttgcgcaggaactcttttcgtcggccaagtggtcagaagtgctctctccctatgcacaatagacaacactgtaatgttttcctcatagatcttacaatgtaattgtaaaaagtgtggcaacattgatgacaaacagatggcaaattaaaccttgtcataggacaaataactcaaaaatagggagttttattggtaaacgatgtcagcattttctaagtggatttttttttcctaatgtagaagaaatgtgcattcagcctgaatgcattaacaatcgatcgccccaaatgctgactttcaacacaagacaatgtgcaggaattagatatagaagggataaagtgagcaattttataactcaatgtgaaatcaagtctcttctcgtcttaacaattaaacataggagaggaaaaaacccaactcttacttacagtaatgccattctattataatattcccttaacattgaagtgttaaaggatgcttttaccacttagcagaggaagacttgcagcagagcccctgtattatttcacaaacatccatcaagctccctcaaagctgaaagctactctgtgctaatgatagaaagcacatttatgctgggcttcccatatattcagtgggtagagatttctaaaacataaagtcattagtggtcaagtaactcatttccttggtagaacacacgattagtcagtcatcgattcaaaggcattaattcaaaggcgcataaacagccctctctgtgtgagtcatttaaaaattctgttgtctgaatttaaaaagcaagtcttaacagtcaacaaattgtcaatgaatacttaatacaatgcaccatgccaaaaattatgcagaaaaccaagaaatacatgaggcaggatgatgccatttttgttaaaattaacaagaaagcacacatatatgcatggccatatgtggttaaactgaaagctctacaccaagagattaataagaactaacctttggtgatgggttctgggtgactttggtatttttttttttttttttttttgcttcactgcatggtatgagccatgttaaatgaacctacattgctctaaagggtttttatatgctgctttttgaagaagatatataagacatagtccctgcttctggtgttttgggagtaaacaatcgtgattgggaggagtgaggccgcctggagttatgaaggactgactacggacatcatttgtttgtttttatactcagcttaccaaaaaaccgtatttccatctttataatgcagtaagtccagcccacattccaagaacatttcaaaatataatttgtacaactactacattcagcggaaatgaagacttctatgggcttgtcaatactccatttataacggtttctgtggcaaaatgcattttaatttccaataaacaagtttacagtggaatttttggaaaataactcggaaatatgggaagcacttacacacctgcatggtaataatgactcatacttactgtttacttgctgcattctttatttggtttcaccctacaacagccttatgtgggagattttattattactcccattttacaggtacggaaagcaaggcacagaggtcacaaaacgtttcggtcaccaaatctatgcagagcaaggtttgaagccagacagtccagatccacatcctgccacccagctccttctaatcaattaactgccagttttcatgtgctgtgggtgctgcacgtaaaagtgattaacattttttgacggtgttaagtccggataaagtaagcatatttcagtattttgaccaaataaaataaaaacctgcaactgaacataactgtttttgtacaattcaattaaatgaagctgctgggcgcagtggctcacgcctgtaatcccagcactttgggaggctgaggtggacagatcatgaggtgaagagattgagaccatcccggccaacatggtgaatgaaaccccacctctactaaaaatacaaaaattagctgggcgtggtggtgcacacctgtagtcccagctactcgggaggctgaggaaggagtgaatctgggaggcgaaggttgcagtgagccaagatttcgccaactgcacttcagcctggcgagagagcaagactccatctcaaaaaaaaaaaaggaagccctgcacaggtatctggagcagaagtcagcaaatttttttctgcaaagggccagaaagtaaatatttgagactttgcagagagtctgttacaactacttagctctgccaccatagtgtgaaaacaaccctaaacaataactaaacaaatgagcatggctgtgttccaacaaaactgctgtccaaaaaatggtggtaagtaagattttgtctgtcagccataggtcaccaccctgatccagaagttatataagtaaataataacgtaatgtatatttcaaaattgtggagtatagattttaaatgtttgcaccacacacaataagtatgtgaagtgatggatatgttaattagcttgattttattattccaaaatgtatatacatattaaaacatcacattgccaggcgcagtggctcatacgtgtagtcctagcactttggaaggccgaggcaggtgggttgcttgagctcaagagtttgagaccagcctgggcaacatggtgaaaccctacctctacaaaaaatcagccaggcatcgtggtgtctgcctgtagtccagctacttgggaggctgaggtgggaagatcacctgagccggggaggcggaggttgcagtgagctgggatcgtgccactgcactccagcctgggtgacagagggagaccctgtcttaaaaaaaaaaaaaaaaagaaaagaaaaaagaaaaaaaaatcacattatatcccacaactatatacaattactatttgtcatttaaaaatacaataaattcactttttttttttggagacagagtcttgctctgtcacccaggctgaagtgcagtggtgcgattttggcttgctgcaatctctgcctcccaaacttaagcaattctcctgcctcaacctcccaagttacaagttatgccttgtaactgggattacaaggcatatgccaccataccccgctaattttgcatttttagtagaggtagggtttcaccatgttggccagcctggtctcaaactcctgacctcaagtgatccacccgcctctgcctcccaaagtgctataaaaagaaaataaatgttttaaatgatgcaattataatgtagccaataaatccaactatatctgttaatccttgaaaacagaggttcagaggtttaactacagatattggtaaaattcccttatagtaaataagaaacagcagagtactggtcagaatggtccaaatgccttggaataatgctgttaattatttaacagtattgtttgttaaatacctgataagttgaacccgaccccccacgacttaccagtgatgggataggcagccgctgcaaaagttattactgcaaaggttcccgtgcttttagctaatagtcaaaaaaccagtttaagtaatcataataagccactgatgtgaaaactattcttccccaagctttttgggtaaaaatctaagatgtatattacatcagaagcaaagactccactttttaataagtcatccatgataccatactttcagaaggcactattggcatcaaagttaaactttttggtactattatatagatttgacacagagttttgcatgtccatgactaactctcacaatagttccaccaggatatctttacatagttgcatcaaacaaaattcctatagaacttaagcaaatatcacagttccctgttgataatgaagtcaacccatatttgaatcaaatttccattctgcattttttaaagccccataaaaaatggcatccggcaagctaaaattgaaacataaagaacaactgaagaacgtcaagcattttcaatagtccatcttcacttctcacatttcctttagtaaacattaaaatgcagaaaaactggcaacatttttaagtcttttaagtgcagactcaaatgtctctgctttgcagtcaggatgcattattgatagaactctttgcaaaccaggacttcctctaggaagagcagaggtttcagataccacgtgcatgactagagcatgtcaaagggacgatattatagattaaagtagatgaatactggctgcatctttactttgtgaaatgccaggagaataaccgggcatcatctttgccctttgcacagcctgaaccaagtgatataaacatacaaaacctcattctgaaacggtgaaaacaatgtgagcacacagcatctgttcggactttcagatagctcttctcaagccaggaataaagccacaagttcagtttttatttttattttttataatagagatggggtctccctgtgttgccaggatggtctggaactcctgccttagccttccaaagtgctgggattacacacgtgagccactgcacccagcataaagccacaatttaactgtggacactgtaatatcacttagaaatgtccaaagcagccaataaaggatacaaaaatgtagtcatccatgtatctcttcttcagattctccacgatggagttctctgtgatcttggacagtagcaccatgtcgtccacaccactgtgcttgacattgtggctttgccagtggtactggtagacacctttgcttccctgggaacataaaacatacaattactaggatagtttgttttcccctgtagtaacaaagacaaaatgctgttaatttcccaaatattcttaaaataaaatgtagcagaaagagcagtgcagagaaagattctgcaatcaataagatgaggattcaagttccagctttgctacctacagactaagttaagtggggaaaagctacctaagctcatgtgtccctgaagtgacacaaagtgacttctcttttctcatttgtaaaatgggagacagacccatttcacaacgctgctgtaaggattaaataaaataatatgtgtgaagtgctaaacagtgtcaggaatacagcacaacacacggttgacagtctcggatgagactatccttcaaccatactgttgtgttgaatttgtcggtgaaaataagcaacgacatagaaactttctagtcttgttttgcaaactacatgacagaatccagaaatggaaagaatatgtatcacacaaaggctatgtcacacggtcataatttctcaagtcatctaaattactttcccttcataaacttatcactgtcatacgtgtaatactggctttccatattcaaaagataggctacatttttatgactgatcactgctccaataacgaggatgtggacaggacagacgaaacgagatcacggaacatgcccaggaggggaaggcctcatccccgcatggcccccttgggtagatgaagctgtggccctcatctacgtctgggatttttcagcttcacaccaggggcggcctctgaacactctgtgggctgcagggcttcctttcatttggcatttctgtagtggggtcccccatgtgttcagctacgtgacaagttcttatggcacacttggggagcttaaagtcctatgaagacacctagataatgatggaacaaagtgactcatgagcacttggggagctgagcacttgggcagttcaaagtcccttgaaggacacctagataatgatggaataaagtgattcatgcgtcaataacagtcaacataaacacacacaaaatgggtgttccaggagtggaggttaggccactttgtcctgggagaggcagaagaaatgacttcccagaaaaggagccatttgaagtaggtctaagatatttagaatttgccggaggagaccagaggaggaaggacattcattataatctatgccggaggagaccagaggaggaaggacattcattataatctacacttatcagcaaaaaagctaataaatatgaagtaatggcaaatattacatgacaatattggaagatcctcccttaccttcaaatgcttgcattctactgggagtgtcgccagtgggtaagtgcagtgggcactgcactgggtgagactcgcccctgccccctccctgctcactgctcgggggacttcgaatgaagaagagaaaaattctaaataagggtatctagaaaggccaactgctcagacatcaaaactaggatgaaaaaagggaaaaggaggctttttgagaggagaagatgacaagaaacaagatggaagccattccaaattttattttaaaaatttattaaatggtttacttttttttcgatgggaaacacagatcctttgctaagagcaagttctaagaagctctgggaaaagccatcttttaaaatcagccaagaaggagctaccacaggaaaagtgtacagtgtcatgggctcctgctctggaaagggattctggaaggcctgccacccatgctgtcttgcagaaggaaactctctatatctggcattctcagaaccacatacagcatcaattctacaaaattacctcagacctcaccactccttcttcctcttgtggcaaagcagaaagagaaaaaagcactggccacagcatgactcactagatttccattgaatgcccatggtctacttccagccagataattcccagtgattcctcctctcctcacctccccaccttttccagctttctgggcacccacggttactctgcacagaaaactagggtcccagagtaaccaacctgcagattggttggttggtttttaacccccatagacatctaaaaatggaagcagagttgaataaaacacaagggctgttaataagtacttattcaacttctataaaggacaagaaacagagaagctctgtgtcatggtgcgtatgtttgtattgatccgaagaaactgccttcctagcgtaacccaagtttgtctcagtatcaaacccattggtctttctctgtctcactgcacagagacacattcctgactgccccacctcagaggctgtttcctcctttttctcatggtagttatttcctagcagaaaagcactcacggtagagttcattgattctcatagttccaagtatcactcgatactgaagattcctagccccagtctctaatgctcaaagaggactcattttccagtctgctgtctatataacaaggtgacagtggttacaatatgcaaaggaattagttatttgatttgtggagggtgttctacttactactgcaagcaatcctaggagagaggggttaacattcccatgccatataggaggaaactgagatctcccgactagtaagtagcaaaagccaagatgtgaaccgaagattcgatgactatggacgcatccaaacgtggtttcttcacagtctcatacatgaatgactgacttattggatatttctacccgttaagtttaacatgacaatggaatgacagactgtctccaaaaccaaatgtatcattaaaaagacatacaatttttattcatgaccacctcctcttagcattagagactaaaacaccaaagttatttttgatttgatacgttttttatatccaataggtcacatatcagtttctgtatctctctctccctctccctctctctcttccgccctccctccctgtctcccttccctgtctctccctccctctgccaggcaattatagttacatatgtgaactcattcaaccttcacaaccatccccccatactatgtattactatctctattttactgctgaaaaaactgtaaactgcccaaggttttctaatggtaacttctgtctttagtgaccactcctcactatgcatttattctccccactcccctaaaaacccacccagatgaggcaaagggagagagtaaagaacctggaggtgggagcaactcagagcctttgggagaacctgacctgcccagatcgtcaaggacaaggtggatcaatgaaagctgggaagctttagcagagggtgatatggttatcagcaaagctggaaaccaaacatggatgtgcagaccctcagcccagccagggaagctgaaaagttccccacagtgaaacaaaaaccattttctgttgctgggtaggggacaacagaatttgctactagtgtgacttgtccagaggcacacagcctctgcacacagccgctgaatgccaggagttacatgggcggtgtggtggggcattgttaccacgcactatcctacgctctagggagcagaggctgaaagttgttctaagacacaaactaccgccctagaattgtgagaatatgcaatagggctctggggcaactaacccttcgcacccgttttgcccctcatttcttcctctacccctgctgagaggcaggggcaggtttggctgccatgtgtgctgggagaggggcagcagagatggttcctcatcagtgtgagggcagccattctcttcagagggcaaaggcattgtttattgggctactacttcatgactctcaggcgagcttcatttttgagtaattcccttttgctccccccactaaaaatggtaccattttaaacaggtggatactcagcaaggtattgcattttacagcagctcctggtgagcgcagcacactgtacaaagggaggagggcagtggcgggcgtgccagctacgacatgaacgtaataataacaataatgaaaagttactcttatccctgacacttcctacaaattatgacggagaaatttccattagatagagattgagtgcagacactctcagatccacattccgtttctaaggatgacgtagtttattaaaaagcagttgattcatgtgcaagttctggaaagtagggtacgcccctatccacataatagcctggtttgttgctaacatttaagaggtggaacccaaacaccagagtccctcacacacaggaagaactcggccttgaggctgggaacctcagatgggtgattccctgactgattttttcaaaggtggaacctcactgactggtgtctgtttaccagggtggggaccaggaagagcaaaggtgagtcagcatacacaggaaggattattctctcctgaaagtccaccttcattgcccaggagacagccccagggtaggcctggccccacgcggcagcggttctgcaaacacttcattagtgtcccagggagcactgttctttgatgcatctgggagaaaggaggagttacccatatacttggtaaccactatcttcaaatgccttcaaatgcccagaaaagggagacaattaagtgtgttgtgtaaatacaacaaggtcccccaccccgtacagggcagtggggaggaggtgaccatcaatactcttacaaacttctacaaagagtaaactgcacagtatttttaggtagcaatttagaaatcggtattgaaattttagacacacagaccaatatataaacatagttaactaaataaaaatcaaagtctgggccaggcgcggtggctcatacctgtaattccagaactttgggaggccaaggtgggcggatcacaagctcaagagatcaagaccatcccagccaacatagtgaaaccctgtttctactaaaaatacaaaatttagctgggcatggtggcatgagcttgtagtcccggctactcgggaggctgaggcaggagaattgcttgaacccaggaggcggaggttgcagtgagctgagatcgggccactgcactccagcctggcaacagagcaagactccatccccccacaaaaaaaaaaaaaaaaaaaaaaaaacatcaaagcctcatcctctttgagccagcaactgtattttttaggaaactacctcaagatacacctgcaaaagatacatgtgcaaggttgttcactgtagcaaagtttgtaatagggaaacagaagcatcattaagggactgattagaatacagaatgctctgcaaaggagtactttgcagtcattaaaggaacttgcatgtcctgatatggaaagagcttgaagatactgtttcattgaaagagtagtcaatatgtggaatacatatggaattactgaatttgtgtaatttttttaaaacggcatgtttgctataattgttttgttggtacttttggggagaagacctggagttttaggagaaatgtaacctttattttccattttagacctttctgtacagtttacattttttaatcatatgcatgtgttagtaaaatcttaaaataaatagaaacatcaatataattgagcattttctgggttgctgttgggcactgaccaggctctcaaagtcaaaagccaggactgtcctaagactggattctatgctaagtccaggtttgaaaggtgattggaagacgctgtgtggacagtaagatagtatcatgtctgagccatttagttggcccatgagcacaacaggacagcagatttgatttcagaaaacctgggactagaatgcccccagtgttataagtagatcaccctgagaagcagataaaccatattcttacggtgaacaatggacaatgggtaacactctggcctgcagtcaaactgagcttgttttgtaatgggatttttctgtctccgtgagtaataacaggaaagggactacctattttaattttaagacattctggaattccaccttttacatttctgccattttactggactgaaacatttacttccactgcaaatgatgaaaaatcaaccaaaaatatttgtctgtctgctacatacaaggcactgggcttgcaaactggtctacaaaccagcattgggcttgcactttatttcaactttatgaaatttaaacccctaatattttggtgatgggaagatgtgtctctgaagcaagtatgtgtgtgctggacttcagtgcacagagtacaatatgaggaaaaagtgttcctgaaacagtgcatgggggacagggtagtcagtagccaacaacccactctcaaccccttacactcctagataattggaacatttactgaaaccagaaatacgtgccaatgctttttacataattatctcatttaattctcacaacacttgcaagacacaagtattataatttctgcactattttacaaatggagaaactgaagcttggggtcataatgtaccatgttgcctctgcttggagtgggtggaaaagtgcactgagggggtggcacgtgaggctcggggaagggaatactcaatgaatatggagtatgtgcttattcataaagtttcatccatttaaatatatgtgaccataccacagattcattatttgtgtagcattttcacatacacgtggtctcctttcatccctgagacctgacacagggatttctgacttccttttctctgctctttctgcgataccaaagctcacttccaatatcatcgttaagtccaagtgtagacacaggctccaggtctactgtgggtccagtgatctcttagtcagtggtgcctggaatcaaccttcctagaagagctggcccccggtggagaagtgttccaccactagagcaaacatataatgtatcattcagcccgggacacttttgatgcagaagagagtgttgttaatgataaagctggaggaaggcacataaactgggactgtctcaggctgctaggttgcatctgtgaccaacttgatctcaaaaaagccaaggacaactctcaaagactagccctcccagccaagaccctgtgccacttagccatagggtgtcacacaaatcagtcaacctcttggagcctgtcccctcctcagcaaaaaggggttcataacactacactcccccctgggccactgggaagatcaaataagactgaccatcaaaccacccccaatccttttaggggtagagctggttttacatgatgacatgatccagtgcatggaaggtgcacaccaagccagcaacattggctgagtgggttagaagggggagggaaaaaaaggtttgttgaaaataacaagggatggtaaggagccccaattttgttttgattgaacgtatgatagtatttatatgcactatctctgtacaaaaatacagttgttaaaatgttgtggttgtttatctcagtgtactttctgcactgttttatttttctgagtatgtatatataaaatatacacacacagagctgttttcattgtgaaaaaagttagatcaaataagataatggatgtgaaagtcttgctaagcagaatgaaatatataaatgtctgacactgttttccatattttttattatttcatgtcaactcagtctccaattctttttgtttattccagcttgcagatatagcaaactttttttaacaataggctcccagaaagaagagacacgacagctttcttttactttctctgcctgaaatgtcaatctcaaaaggatcattttctatatcaatgaacagttcaaagataagatgttgtaaatgaacagttaatgtattccatcaactctaagatgcattctttttcacattttcacattttgaaattaggatgtcttataatcaactggacgcagcagctcatgcctgtaatcccagcactttgggaagccaaggtgggcagatcacttgaggtcaggagttcaagaccagcctggtcaacattgtgaaaccccgtccctgctaaaaatacaaaattagcctcgtggtggtgcactcctgtaatcccagctactccagaggctgagtcaggagaattgcttaaacctgggaggcagaggttgcagtgagctgagatcgcgccattgcactccagcctgggcaacaagagcgaaagtccatctcaaaaaaaaaaaaaaaaggatgtcttataatcaatgatgtgttatagcttaactggcagtttttttttatttttcaatactgtaaataaaataatgatgctccttttataaccagtagcatcttaggtgtgatatattctggcgcatgacatttactaagggccaggtactcttcaaatatcactgtttaatatcatcacagatgaaaaaatattataaaaattttgattactctggaagcattgtaccaaatactaatctcacgtcaggaactgtgtagtggctttactggtgaggctgatgatcacccagttttagaggctttgttgcagaaatttttgtagctgccaccccctcccccatcctcacctccaacccactagaggatgaggacaagggtcctggatgacaagctgcccaagagaagccacccatcaccagaccacagctcgcaaagcaaggtctttacgtaatttcctcttcgctttgtaaagacatgttcaagtttgtatctctttcagcctacaggttctttcaatattaacaccatttgaagcagaaaggtgtcccaccctccatgcgatatgtctgccctgggattactatgatgtctgactttccccatgacttttccttttcttttctttttcttttctttctttttttttttctgagaaagagtcttgctctgtcacctaggctggagtgtaatggcatgatcttggctcactgcaacctccacctccctggttcaagtgattctcctgcctcagtctcccgaatagctgggactacaggcgtgcactaccacaccaagcttatttttgtatttttagtagagacgggttttcactatgttgcccaggctggtctcaaactcctgacctcaggtgatctgcccgcctcggcctccgagagggttaggattacaggcgtgagccaccgcgcccggcccccatgacttttctgacatacaccacaccatattgcaatctttcctaaacctcagtcattttcaactattttaacaagtttcctataaccacattccacagcacttgcttcaaatttttctataaatggtccttaataattttgattaaacctacacaacaatcttcataaaatccaccagtttggtgtgctagttttgtttcttcaacatgtaaaaatagctacgaagacaaatgttgtaagccggtcgcggtggctcatgcctgtaatcccagggctttgggaagcaaaggtgaaaggattgcttgagcccaggagttcaaggctgcagtaagctatgattgcaccactgcactccagcctggtgacaaagcaagaccctgttcaaaaaaaaaaaaggaaaagaaaaagagaaatattgtaaaatacaccagtgtggggttgtacataccgatgttaaggtctaccctggtgccatgttccacacctggggacacactggcattccctattgggccttttcttgtcaatttcaagtccagccatagggaatttaaataacttctgttcgatttcccaaatgcattttactctgctgtggaaaatctcacatggtaagaccagatttcccttttagtttgcaggcgagagtctaggttgtgttctcacaagtagaacctaccctatgtttgtgttctgaattccctgcactttccatcagggctcccaagccccctgctctgtctagacctcccacctcagaaaaccctcccagccacaggtgggacatgtcagtagtccccagggtcagggcttgtcttgaggctgagcaggaaattctcttgggtaactgctttttattctttctctctcaggaagtgcttcccgtaagcattaccaaaacggttctgtcctctttccctcacaaactccaggaaccctagaatggtggctcctatctctgatcctcaccaaaagtccctttgaagaccaggtgtggtggctcatgcctataatcccagcactttgggaggccaaggagggaggactgcttgagcccgggagttagaggccagcctggacaacatagcgagaccccatctctacacaaaatcaaaacattagctggacgtggtggcacatgcctgtggtccaggctactctcgagagccggaggcaggaggatcgcttaagctcaggaggtcaaggctgcagtgagccgtgactgcgttactgcactacagcctgcgtaacagagcaagacaaagaaagagaagggaaggaaagggaagggggagtgggagagggaggggaggggggagggggggaggggggagggggagggggagggggagggggagggggagggggaggggggagaggggaggggaaaggggaaaggggaaaggggaaaggggaaagggaaaggcctgggcagcccaggctctctgagatgctcagggcatccatcctccagggcacaaaaagggctctggttgccctcatcccagggagacgggcggtcagaggacagtggctgccttcacaagcctggtctggaacccctcaaggtagctgcgcatgcatttgaagtgcaaatcttagcgaggcttccctgacctgtccttgtccatctctaacccctgctttctccgttttgaggttcccaccacaccattttctgtgcataccatgctgtgctttgtttctgtttttccacagtgtgtgtgtgaggtgggatcttcagtacctacattcccactgtcccccagcttagggtattcttctatgaactcctccctacctcaacccaactctatgcctactaaactctcacccagcacaggtcaggcatcatcttgctaagaagcctgctctaacagcattacctgagtgcctggctccctgattaaactgacccctaggaccaagtcttattcaccattctgccccaagacctagtagagtgccatgatgcatggcatgggcagcccccaagtatttgttgaatgaatgaaatacattattattattctcacgtaacagctaattcttattacataccaagcactgctctaagcattttacatataacttatctaatccttacaacttcacgaggcaggaaactgagtgaagcacagagaagttaagtaacttgctcagctcccacagctgggcttcaaacccaggcagtctgcttcagatctttgcccttaaacattgtacctactgcctctcataataaagtaacagcagttggaaacagcaataattctaaagttcatagtaactgctttattgcatgtttactatgtgtcacgtatcaacttctttcatctgcccaatgacaccaccaagtacttgtattatccttttttttacagaagaaaaagaagtaccacgtggtaaacagaatacctggtacaaagccctgcaagctaggagctcacggagcagcctggctctgcacagccttgcataatgcagaggaagttccgtgccctggagtcagccttgggatgatgtctgccccctgccatgtccccaccagggtggtgcctggggcatgggagtgcccaatctttactagctgggtgaataaattccaggctacactgactcacctcacaacatgtttgctgtaggtacacggcagcactgtggcagcagctatcgtggggcaaataggagtcctgggcccagagtctgctccaaggaagaaataagtttccaaggcgttcctatttgcccccaactcaggagatcaaagggaagagatattgcccctaaacacagttctccttctcttaaccatgtaagtagtccagttaagagtaacagatatttgaggttggatgattactattttatttttatttttatttttttgagacagggtctcactttgtcacccaggctggagtgctgtggcgcaaacatagctcactgaggcctcaacctccagggctcaattaatcctccctcctcagcttccctagtagccagggctacaggtgtgcaccaccatacctggctgtgtttctctaccaaaaaaaaaaaaaattttttttttttttgtagagacagggtcccactgtgttgcccaggctagtctcaaactcttgggcttgagcaatcctcctgcctcagcctcccaaagtgctgggattataggtgtaagccaccgtgcccagcctggatgattaactttttaaacagaataacaggcaattaatcttcaccacatcattagtgaggtaaggacatttcaagctacagaataatatgaatcaaatgcttgagattccttaatatgacaaatgctcatttcacttctgctctgattatattttaatcaaacaagtgacaagagagtcacactgatgttagtccctgtcttttcagctgtggctctgctagcatgtcacatacatcaagcacttaacagtcccttaagagagctcccacatcaccactcttgtttttaagtgcaaagctcttagacattcggtaatacgattcaggaatgtaacttttcttcctaatctagcaaactgattaaaatcaacagacttgggtacaagctctacctctcacatgcctctgtgccttgggcaaggccagtttcacagaattttattatttacagttttaaagcaatcttgcaaggtgtggcggttcatgtccttcatctcagtggaggctgagacagaaagatcacgtaaggccaggagtttgagaacagcctgggcaacacgcaagacactgtctctttttttttttttttttttttttttgagacggagtctggctctgtcgcccaggctggagtgcagtggcacaatcttggctcactataacctctgccccccggcttcacgccattctcctgcctcagccccccgagtggctgggcttacagaaggtgcccaccgccacgcccagctaattcttttttgtgtgtgtttttagtagagaactcctgatcttgaactcctgacgtcaagtgatccacccaccttggcctcctcaagtgctgggattacaggcgtgagccaccacgcccgactagacactgtctttaaaaaaaataataaaatcaattaattaattagctgaaatgaattttaaaaataaaagtgaaaaaaatttttaagaaaaagaaaagaaaaaattaagtcagcctattaaatgcataccaaattagtgtgtgcatgtccattaagatttttattaatcatacaggtcggcacaaaagtaattgcggtttttgccattaatggcaccggcctaatagattcataagtcaaaaatcctaccagactctgtgtcctaatttgtggtttgaaaatgatagtctctgaagtagtagctgctcaatacctttttctaattcaattacacagccaaggtaatgaggcaggaagactagctagaaacaccagcagctgtgcatataaataaagacagggaggtaactgaacaatttcttgtgacataatatgaactatcaccctgtaccatggaacaaagaaactctaatttaaatgctattctgagaaaaagaacagtatgcaaagagttatcagcaggctgtggcagagttgatatcaacctgccaaaaagtcaggacttcctatccttggaagaatctctcctatactgcttgcaaaatacgcattatttataagtcatgcaaaatgctggaggtatgctgacatgagttaaccaactactcacatgttatggttttctcagattgccctatttttctgaaaaatgtttggggcatatctgaataagaactcaatttttaaaagttttataaggttgatgaaattattttctcatctctgtcttttaaaagccaacgtggaaactccacaagagtataaagagttggattttaaggagcggtgacacaggtaaggtgttggtgtgtcatctctcacttaggggtactgtgtctggacgtgctaagcgggggaagggtctggatgtgatcaggggtgtcttgatgtgggcacagcctttgttgtgggtttgctatagggatacggagtccagggaaacaagccaagctcaggggcaaggagcattccctgaacaaccactagccaacgctgaaccaaatgcagaagtgaggaatgcctgtttctggcatggttacttctggacccttggcttgcctgatctgctctgatctatggcacagtggcaccatgtccctcttggggcaaaatgtaaccataagggcattggtctaggggcctttagggtatcaatgacacatgtttacaaacagagatctcagaccacagctggttgatgggtggcagagatgagagtcccgtgggcacatctcagggagaagccacaagagcagccactaatccacatggcagatcagtgtcgccaagggtcctgcaggctcagggccgctcaatgtgtgatcacaaacaagttcatcctctcactcccttccaccacctgacagaggatgcagggctatcttgctgtttcttctgatccataccttggactttaggagtgggcttggggaacttagaaggggtggggaaaattaagaacaagcttgataattcaactaaaagccctaggatagacatgaagggaggcactgtcttctaatgggcctgctaggggcttgtctctcggaacccacacccaaatcgcaagcccagtttgcagaaggcaagcactgcagcatgcagagacgggagccttatcttctattgatgtgtccttcccgacagactttctgagggctacctgcagttgctgccacctccccagccccaagttcaatcagcaagctctagaatgaatttgcaataaaaaccaatttggaagatcagcacggcttcactgatcttaccaggaccctcactgttgtatgcttctagggtggccacaaataggtagattctgccttcctttgatcagcttagatctttattaaaggttcaacagcaagccaatagagcaggtcctcggatgacgccattttgtgataaagataatgaggaagaaaaatggattcctggtccagccagtgaggagtctgcatgtttttcccatgtctgtgagggtttcctcccacatgccaaagacatgcacattgagtacattggggtgttgacatggtctcagtctgagtgaatgtgggggattgtgtgagcaccctaagataggatggcctcctgtccaggcctggttcctgccatgctccctgagctgccgggatagactctggccacctgcaaccctcaactagaaggagtggatcagaaaatgcgtgaatgaatgattataagttattgtcaaatgaaaacttttaaagtagatgatagtcatacaaatacatgacaatcaacaatgtgcagcgaaggcgctcagcgagcctgccatgttcctgatgggttttgaactgcgtggtgcacagaggcactccttacagttctcactttgcaaacaattattccttaactcaaaccccactactactaccactgtcactcaccgactcaccaaatattgggcaaataattctattactttttttaaattaatctttcttttcttttcttttttgagacagggtctcactctgtcacccaggctagagtgcagtggtgtgatcacagctcactgcagcctgggcctcctgggctcaagtgattcttctgcctcggcctaccgagtagctgggactacaggtgtgtgccaccatgtctggctaatttctttagtttttgtagggatgggggtctcactatgttgcccaggatggtctcgaactcctgggttcaagcgatcttcctgccttggcctcccaaagtgttgggattacaggtgtgagctgtcatacccagccccgttcagtgcttttgagtacattaaaagagataacgcacagagatttcatattacccaagctcacagtaccagatgagtaaagttttgcattggttattaataagtgaactgggatactactagccactaatatagctctgattggatgtatgatatttcaagaaagagactgggtactgtcatctcatctggctaataagataataggagggacaggattcaaataaaaaatatagaacttttaaagtttcatgatgctcaagtgatgtataactggacactataaatgtgagtcaatttgaatatgggattctgagaatagggatccgccacagaaaagaagacgacagacagtagctgcagagaagatacatagggagttcagcaggctaaccaaaatggaagccagtgacaaagaccatttgagcaacagactgatgccttgtaggcaaaaaattaaggtgtttaaacaaacaacaaagtggcagggataaggaaggggcagaatacttacatatttacattcagaaccctaaaatattgtagctggaaggggcctggcctatcgattaagcagtgcaaaacttttactttacagatgagggacctgagggccagagaggtgaaaggatgtgtccacggggccatcctggactggaaccaggactagaactcgggtcctctgactcccagcccagcactgtgcagctctctgcttccagtccctcctgagcaaatctgtaccaaaagttttttgtttctgggaagaaaaataaggcactattttggatgcttaccataaaataatcagctgaatccaggcatttatataatttgaatttctcaaataataagtaataccatttgtgagccctgaccctctggcaatcaaactgcatgaggagactggggtccatccaaatattatatatgggagcagctcaatttcatcttagtttttaatgtaaagataaatacaaattaggttttaatattttctttccagtgagtttccttgcacataaaagtgcatagaccccactttggagatctctttcccagaaccccttgtcatccacccaagacacaggtgtctgcttatgggaagaaagtaagagttaaggcattggcttgaaatctagaaacaagacagacagaaaggaaaaaggcaatctccagaagatgaggggcaatgccagcagaaattagaaagctgtcatctagttagagatctctggctgtagcatttcaaggtgttccttctgccagtaactctctcctgccagaatcactaaaactgaaagcaaaacacaaactgaccatgtctgatgtgattatggacatggttgggtcacaccagtttaaaactcacaactccctagaaaatccaaggaaatttttgcatttccttctccaagaatacttacttctcattgtatctgtgaaatataatatggcatcaaaagggcaacccacatcaagaagtgtgccccacaatgtttggggatcggggaacgggcatcacttttcttgagcaccaaccatgttcccaatgctacgttaggtgctttgcgtacattgtttcatttggtttcaaaagaattctagaaacagggaggtactgtgatccccatttaacagatgaaaaacttggtgacagagtgtgtgtgtccatggaatccagatttgtactggtttggtggctttagaaacctggcagcttctattaaggctacggtagaagacagaagaaatggattccccactcggtgaaaatatctcacgggagatgtcctctgagagccaggtttcatatgcaacccttgaagctgcctttagatcccacagtggtaaactggatgaagtgttaccttggctacggaacagagctaccctttctaaacagagggacattttgggtaccttgaatgactgactcttagaaagatcacgggcacaggagatgcctcagcaaagctgagatcagagctttggagccaccctgcgacatctttgggcctctgccttgtctccttgaaagcatgcctcgtagccagcttcaaagtcagactccccatgcctggtgttcagtaacagcgggcttctcattcaaaaattttgcagaggtaatagactgtgactttcttttgtgacaacggtgcctcagcacaatcagacaacttgaatatgtttaaaataaccttgcagaaatcctcagaaaaagtaggcaagatagacatcaattgccaaaacagtcccagctagggatccactggaggaatttttaacatagtttccaaagtcaaacagcatgccactctcaaccctgcaaagtcagagctggtagtaaatgctgggttcccttgctgtactgacaggaatgagagtcaaaggtgctgagataaacacacaaattatctcaaagcagtaatagtaaaaatcattttatgcaaggaatggagaccaactgatacccactctccgcattaggtagaaaagagtgtgctcacacaattaaagtacaagacggcatgctcgatttggggcaggacagtgaatagaaaacagaagtcaacatcaccacctcaaacagagcgttgtgctcacaaactgccagcaagaccacaagcatatctgcaaaaacatttgcatggtttctggttgcaaaaatgctgaaaggatttgtacgatactctgttcccaagtgcacaaaagtctctttctacctgagcccagcgacccaaaatatgaagaaaagcagcaccagtactcctgatattctttgctggtctgtgaccccttcctttccttggagttggaccaaaaacacagtattacctcctaatcaaataaccaacacccaaagatacctgggtgtgactacatgtcaattcaagttcaccggagttaaaaggaaaaggtttcaccgattgtttgttggtgtttgttggaggctggtgtgtttaagatacagaagtagctgctagctttgcactaaaacaaacaaacaaaagcacatttcaattattttttatttattttttaaatttagtgcagcaaaaagagaacaaaggtggccaggcgtggtggctcacacctgtaatcccagcactttgggaggtcaaggcgtgcggatcacctgagatcaggagtttgagattagcctggccaacatggtgaaatcccgtctctactaaaaatactaaaaaaaaaaaaaaaaaaaaaaaaaaaaaagagagagagagagagaaaacaaagattaacaaaaagagaaatagcttgagatgccgaggaagataaaaagcaaatgatttaaattaaacatgagggaaacattaaagaagggaaggaaataaaacaaccctagggatctaaatagacaacaaagaaaagttgtttgatcacagggcaagcagtatgaataaatcaaataccataaatgctctaaaggaaaaaaaaattttaaaaagtttccttccaactctcattctaaggaaaccacagctcttttgcttagtataactatagttcacatgctaaatagctaaattcagctttttaaaatctacccaacactctctagatttaaaaatgtaagtaaaccgttcagatcctattgttaagtaaattttgtttggtgagtggatttgttttgagtggctgtggataaaggcaaggggtgattttattttactggtcatttaaagattacattctttttaaagaaaaaaatctatgatagttttacaggatttcaaggcaaattcatcagttttgtttcaaacacacccaatgggtgtttcccttgtctccaaatgaaaagccttaatccaccttttcctacatgtgtttctacagcatcttctggctgtgagtttgtacaccactacagaattattattactatttcaactcccatgaaatgtactacgactggcaggcatatgagttctgaaatttaaagtgcgttactagagaaactaaaactcatgttggccgcaaggatggacaacaatacgaaatgctacagatggcaatgggaggcctaaaacaatgtgcagttcctttctattctggtttgccccattgtgttctgaatagactgaatcactgcccagcttcagggccagcctctgaaaggccccattgtaagggctatgctttccagagcagagttaaggttgctgtagtaaccttcactatgaatttcctgaccagtgtgatgaaaatctcaactgaactgcgacagtactacagctacaaacaagaccgcgaaatgagcgtgggtctacccatttagggggtctttcttatctgaacatagcccactatctactacttcaggcatccacattgccaaagaagggactaaatttctacaagccagagcttgagaggtgaccttgttgtataaagtctcagggggatctatcccataggatttgaggtggcaggcaaatgggagtttgtagacaaaggggaggcctcggctcataaactgtttaagctgtcctgtgtgctgggctggggaagccacttttctggagttgcacagggaggcatgggggtaccattggtccaaacaccacaggtaaggaataagtctgcactgagtgggagaaaacagtttagaattcagcaaggcaccctttttattctgctaggaaaagaagggcaacggacaatcacccccatctaccagatggaaggcacactggcttagaatgaaaccccctcccagttaagtttattgagggttccctatctgccaagcaacattctaagcactttacttatactaactcattcaattgtcccaacagtccataatgctggcatgattattaacttgaggtcaggagtttgagaccagcctggccaacatggtgaaaccccatctctactaaaaatacaaaaattagccaggcgtggtggcaggcacctgtaatcccagctacttgggagaccaaggcaggagaatcgcttgaacctgggaggtggaggttgcagtgagccaagatcacaccactgcactccagcctgggtgacagagtgagactccctctaaaaaaaaaaacaaaataaaataaataatttttgtgaaattaaaaaatatgtataaagctaatgaaattcagctgaatctaaaatattaagcccctaacatatgtacagtgttgttttaggcatcacagtgaattcagaaaaggtaaatgaagccctcaaaagttttttcatctgatgtagcaaaaacaaaacaaaacaaaaaaccctgatatatgggccagctgtggtggctcacgcctgtaatcccagcactttgagaggttgaagtgggtggatcacttgagcctaggagtttgagactagcctgggaaacatggtgaaaccctgtctctactaaaaatgcaaaagttagccaggcatggtggcgcatgcctgtggtccctgctacttgggaagctgaggtggagaaatgcttgagcctgagaagtcaaagctgcagtgagccatgattgtaccactgcattccagcctgggcaacagagcaagaccctgtctcaaacaaaacaaaataacaacagaaaccctgacatatatacagaactgatactcagttcccactggaaagagcgtctggctggcttccaccctgattgttcggtattcatgttgctaactatttaaacattttatatcacccctgcttatgttaaccaactagacaaactgtaacagtctgagatggtttggtgtgagttctatctcatgatcgtgccccttagaggtctctcggattttcctgggccagctgcttcaaaggcagatatccctcattctctgaggtccaaaatcaggaactaaatagatctgtataaaatttttgataaatcacctcttatctggaatctcactacttcctattccaaatagatttggacaaaggagcattccttattcccaaatgtcctacccaaaccccattgaacttggaaataaacagctttggatagtgagagatagctgtgcttggtcacgtcatgccatataccacaaaatgtcctggaaatgccagtatctttgccctcccgctttcaattgtcaatggcagccacaggaactcaagggagaacacaggccttcttggctcccttgcccctgtcgtttcagcccccacaggacgggggtttgactcttcctaacagccagggtttctcttgccctcaggggagctcctccctaccagtcagtgaggttcaaattccttagcctagctcatagcccactctccttgccagtgctatttcccacaatgcctcatgctcctgccaccagtctgcctggggctctttgcatggaacatctgacctctgcatcttagtccatgatgttctcaccacctggaccaaatatcctgcatgttcaatctagtccatccttgaagaccccatgcaaatgctacctctttaaagcctgcaagttcccagattatcggtaatcttgtctgtcctctgacccccactgttggcttatttatatctcctctccctccctttctcaactgtaagtgacctgaggatggggcatgcctcatctctgaactctccttgtcctaataaagagccatgcacataagtggctttataaatgcctgttcaatgaagtaatgaatgagacaaaatcactaaaagttgagtcatcctaggaggcttcagggagatcagatttgagttaggactgaaaaaagcttaagcactgaattgggagagaggaggaaaaaaaaggcattcctgagagggaaacaaggagagtaaaggcatggacgagggtaacaacatcgcttgtgtttgcactgagcttttcaccacgtgaaaaccccctaaaaagaccaactggactagaaaggcggatttgtgttgaggaaacggtagcctcggttaagtaggaaaatagagctgaccgaaggagggccaggaaggcaaggctgagtacttggcactacagacaggaaacaggcagccaagatggaatctccatcagagggtgcagcccaggtcatgcagaaaaactgtcttctttccagagggaaagggaccaactactgtagtcagatccccatccagcgagagaaaataatgccacctcgcatttgctcccagtgtttcacaacttagccgttaatcatcccaggagagtcctaaaacaactctgccaggagggcggagagcaggtataattatctcggtgttacagcgtggaaaggctggcaaaattcccctcctgctttggaggaccccaaaggagtggaagagacggggaaggactgatgtgcaaatttccggtccagctcatctgctttggagaacttacctctgtgtatctgtctagtgtaacaatggctatgtcacttactgcggggttattattaagctgagctgtgagtccctctgtgtgctcaatctcgcctacttagacctaaagagggggcaggaggagggaaccagaaccagcagtggagctagactgcttttaacccagagacagagaaaaaacaaacagctctttaaaaacacaatttctaagcatactaaaaggtagcaattccagcctaaaagcctgtcagcttagcaatgcaccaccctaaagaaagggcaaaattatcaaggcatagaaaagcaagagacatcacgctgtggataaaggaccctgctctatgccaacttctaagtaagacgaggaattacagtaatccagcccacagcaatttcccattttaactgatgcttcctgttttctatgctgggcatcataaggatattcagaaccaaacacagcgttcacaggctgtcccttcactggggtacattcttttctgttcactcaccaaattgtgtgcaacattacaaaccaaaacagatctgttttcctactgacctcaatttgcggccaccattactgttgctgagaaaattcttggctctgcatggcagagcgggggctcctaccaacacaggccagcatgaaggcctagggagaacagctcatttgcccagcagttccctgggcttaattgcccttgaaacacagtcgggacgtgctggtaggtgtctctctgcaggcactgtccacatcaactggagtgacttgattttggaggaagggtgaggggcagaggggatggagacctcttccagtccttttagtgattgctgatccatcccagagtaaagcagacaactgggttttctgtttgttttgtgtttgagtgcaggacaatgaaggtagggctgtttaaaccatctatttttaaattcaatacaacagttacacaaatatacaaagaattcacatacttttttcttttttttttttttttttgagatggaatctcgctctgtcgcccaggctgaagtgcagtggcatgatgtcggctcactgcaagctccgcctcccgggttcacgccattcttctgcctcagcctcccgagtaggtgggactacaggcgcccgctaccacgcccggctaatcgcccggctaattttttgtgtttttttgtagagacagagtttcactgtgttagccaggatggtctcgatctcctgacctcatgatccactcgcctcggcctcccaaagtgttgggattacgggcgcgagccaccgcacccggccaggaaatttaacatcgatagaatactttttatacaagtcaatattctaattttattatcccaatcatgtcctttattacttattttttcccctggtgcaggatcatgtaccacatttgtcagaatttttttttttttagagacagggtcttactctgtcacccaggctggaatgcagtggcacgatttcagctcactgcaacctccgcctcctggttcaaatgattctcctgcctcagcctcctgagtagctgggatttcaggtacgcaccaccacacccagctaattttttttttttttttttttttttagtagggatggggtttttgccatgttggccaggccagtctcaaactcctgacctcaggtgatctgcctgcctcagcctcccaaagtgctgggataaaaagccaccatgtctggcttttaaaatttttataattttttgagacagggtcgtgctcttgtggcctgggctggagtacagtggtgcgatgagggctcactgccacctcgacctcctgggctcaagtgatcctcccacctcagccctggagtagctgggactacaggtgtgcactaccatgcttggctaatttttttgaattttagtacagatgaggtctcactatgttgcccgggttggtcttgaactcctaagctcgagtgatcctcccaccgtgggctttgaaagtgctgggattacaggcatgagttttcctttgtcttttatgatggtgacattttaaacagttcaggcaagttattttatagaatttccctccatttgagtttgcctgatatttgtcatacttagattcatctttcacatttttgactagaattctaggcaaataattttgtgtccttctgagggcatgatgtccagaggtacatgatatttgtaggtgatattcactttcatcatttggttaagtattttccaacttccccactgcgtaatttttcctattacaaatgcaaagtgatttgtggtgagatactttgcgactatgtaaatatcctgttcctcatcaaaccttaagaactgactgaaaaaatttacatttacaaatctagttatttggtaccctgggggaatgtattaaactccgaaactgagtttttcagacagtcaagggccatggagtatgtgtttgggcttcttagatacatgacttcctcacagcccgctgagttccagagaggctgaggttgcccgatagctgtgccctgatcagtgatactgcgttctacctccacaaggtgtgaaatcatgcattcctagaagctgaactgaaaaccagaactatgagtcaaggtgattcttaatggcccagacagcactgtgggaagaggcatagaaggaaatcaggtctgtccatatgcaaagctgctatgtgtgggatgttcacgtctggtttcctccctcggggtgcctgtgaacctcacccctgctccaatcctgttccccctctcttccttgactacagtggcattaaataagaacctatttaaagggtagaaatggaaggagttctttcagaccagatcgcttaaatccaggtgaggactgggggtaaaggacaacatgagtgaaaaggatggagtccaatcattcagttcaaagaggttgccaacatctgtccttgaatcacaaagaggaaagttcttctctatgcccaacctttgattcccgccattcttgtttccacaagggaatctgctgccacctgggataaccattaaacattttctttttgctaaaaattattgtgtggaaatattacctcagatgactttgttatacaagaaccaccacttccacaactacagtgactgggatagatcctcagaaaaaaagcctggtctctatggcaaattatcacagacatgaaggccagtgagcttattcagaggccaaagattcttgctctgccaatattacggccacatgttttacaagcctggagtccatttcttaaaggtatgtgtgtaggttcgtgattttaatattaatagctactgctgacacatcactggaaaaacacaggttttccattttgacggtaaaaggtttacatttaggattcatttatccctcccttagcttgagtaatgagatacaaattactggtagtgccctccaaaattcctcaggcttcataaacacaaacaggaattggcaataacagtaattacagggatggcattttttaaatagccgccgcactcttgtggttttctttcctgaactgcatcctatatttttcatttattcaatcattcactgattcaatcatttcacctagtcaacaaaacttatgttaggccttggggataggatgatgttttaaaaagatacaaaggtttacaaattaattacttaagtctgcatttatagttccactgtgaagaaatgggctttgttgccataagattcaattctttcatcttctaaaaatcctgagtgagctatgaagaaaaagaatataaatgcaattcactccgaagtgtgaaatattacccctggctaccaggtaagctgagaagactgtgagttcacacaaatcattgatctttcttgacaactgaatcctaacctgatgaccccatttaaagaaactctgtagtttcattttagaaacaccagcccaaattctgacgataattagctctaatcatcatttatgccatttaaattaagttgattagattttccctaacaattttccactcagaagttgctattttaaaaatctcaatgcccagctgtgagacgcacaaatttggtgtgaggtatgtgataccatctcctatctggcaaaggttttaaatatcctaactggaacccctaaatctttaatgtaatgtaagatctccgtgagatatactttgtcaccactgagaagctaaaagggcatttgagcaactgttcaccacaaaccagtcagctactttataatttatcatctggtgaaatcctaagagcctgggctttgggtcctcttgaatctcttctagatgaaaatcttgggcagttcttcccaaccagcatgcctggcaatgaatgccagtccctaggaaaaggctgaagggggtgctgggttttcctgttcccatggctctgcctgcccagcacgcgcacacacacacacacacagacacacacacacacgcacggtcatttctggtgcacacaggcacacacacacggccatttctggtgtgcacacacacccccattcccatttctgagtctttattggcaaagatacttctagaggcttagaaccactggacactcccacaaacatcttcagacaccaccctccccacccactgctatttccccactctgcccgctcattctcagacctaagcacaagaggaagtgagtctacccatgatgcggtcacactttttgaaacctggaagtgggccacatgttgtaaaaggaagctgaacgctggtgcactgatctagaaacctgtgatcgccttctagctataaatcttccggggttcccattaaaaaagaaattcccaaactgcccctcttttgttggagctatgattatgaaaaatcctgacaggctttcttgaaggtctcacaggctagctctaagaagctagccaaacgataaaatcacaatcataacaaactcttggaggagggagcttattgtatatctttctttttttccttttttttctttttttttttttttttttgagacagagtattgctctgttgcccaggctagagtgcactggcaccatgccagctcattgcaacctctgcctcccatgttcaagagattctcctgcctcagcctctggagtagctgggattacaggcacatgccaccatacctggctaatttttgtacttttagtagacatggtgcttcaccatgttggccaggctggtcttgaaatcctgacttcaggtgatacgtctgcctcgacctcctaaagtgctaggtgtgagccaccgcacctggcacatttgttttcctttttaaattttatcagtggcagcctctgaatcctcaagatgtattaaaaatgtcttcctaattaatgtctccactctcttttgaggaaaatatggattcaacaataagaatgtatctttacatctgagcatttaaaaatagattaattctcccatttatactatagcaacttgtagtcaacaaaatttcccttctcttttcctcagaaatgccctcattcccaggaaattttaccccagtctgctgggagcaggaacatctctgtgcaatcctgaaagccagccttcttttgagatgccctcatcccctcaccgactcaacagccctgccttaagtgaaagcacctaggaccctcaactgtgtctcctgggctaatgcccgaaggctataatgtttaattgaagagatcttcttggatgctgagaggaataaagtcagtcagtaacaaccactctcctcggtccttgaggcagctttattgtggctaagtccatattctgccatgacctggcagagagaagaggcttagcactggagcctgctggagcctgaagagcggactccaaattcctcttctgcgacttactactggctgggtggcccaggggattctctttaactcttttgtttccaacctcacagggttgacttccaagatagagaacgggaaagctaacctgaagatgtcatatcaatgagttattttgataacatcaagagatcatctgtgatactactgattcgtttttcctaatacataccctcatcctaattgctatgcactcaaataacttaccttcccctgccctcaaacccattttcaaactaatgcaaacagaacacctacgtaaaggtaggttcgtcccctgcctggcagaactaaagcctctgttggaggtaataagaacatggggtctggccaattctcaggaaagtcccaggcaccatgagcatcagatgtggggagaaaaaaaggcaggaaaagttagaaaagagtacaccttgaggctaacagaaaccagcgtgccaatgaggggatcagtttgtgactcaagtaagatttagggacatgtccaattaacgaaggcactgtcctaaatgtcttgagaaaaaaggcaccccaaaatagaccttctatatgatcacagacattaacatgccatcttgaaatggcaacatactgcaaaagaatgctgacaaggtgagacgcggggcagtgtgctgggtagacaaggccagtatttagaagtcagaacaccttagctgggtgaccactgcagtcacttaaggccgcttagtctcactttcctcatccatgacaagggtgccacaatctaactcatgaggccaggaggaaaagttctgtgtctaggactcatctgtattattggatttcacatgtcgtcttgaccttaattagacataacacaactgattttttgactaggcgctgcatgccacctgagcaaagaaatctgtctctttttctctgaatctccagagtccatctaacacagtgcctgacacaccttggggcttgatcaattttattccatttacaactgaaaaatgaggtgtaaagtaatacattataaactctggacactatataaattatacaaatatgttaaaaattattgaaagtaaataaaagacacttgccaatttagaagctaaaaatggcattggaagttaaggactggtaaagctgtctccagtcctgcccaggggagaaggacattttgaccagggcacctatgaatacaatctcttaggccaaggcatctctagagtggagaaaggaaactttcagttgttgtctggtgagaatacccctcagaatcactccaagccacctacatattaactggttcccacacagaagaaaatgtaatgcctggctggtattttgagaagccagcttggcaggtgagttccatgctgcaaataaagtcttcagcttcagaccctcatcaagtctaaatttgattgttagaattagatgtcagcttgataaaatccatcatctaaaatgcaaaagccagcctgagcaacgtggcgaaaccctgtctctaccaaaaatacaaaaattggccgggtgtggtggtggcatgtgcctgtagttctagctacttgggagcctgagatgggagaatcacctgagccaggaggtcgaggctgcagtgagacgggattgtgccatagtccttcagcctgggcaacacagtgagaccctttcctagctactgaggaggctgaggcaggagaattgcttgaacccgaggggcagaagttgcagtgagccgagaccgtaccactgcactccagcctgggtaataaagtgagactctgtctaaaaataaagaaagaaataaataaaaaggaagaaattaaaaaagataaataaatagatacataaaatgcaaaagcaagaggcaacagtgccttccagatctctcctcggagtaagcagcataatcccacagcgagatggtatctgcgagtagtggcactgaagtgtgatcatctcgcatttgcccctctccctggctcacaaatgtgacagggaaaggcggtggcacaaaacaccaggcacagtgactgcacacaaaaccattgctcaaaagctacttgttctactgagtcggcagtgtaggactctcttctgataaaattaacaacaacagcaggaatataatggcccgtttcctggatatatggcctttcacagttaagagtttccatacacattaaagtgatgcctggaggagtatcaggcaggcgtctctattttcattttcttttctttcttttttttttttttttttagagggagtttcgctcttgtcacccaggctggagtgcaacggcgcaatcttggctcactgcaacctctgcctcctgggttcaagcgattctcctgcgttagtctctctagtagctgggattacaggcacacaccgccacgcctagctaatttttgtatttttagtagagatgaggtttcaccatgttggtcaagctggtctcaaactcctgacctcaggtgagtcatctgccttggcctcccacagtgctgcgattacaggcgtgagccactgcggcccgcctattttctttttctatatgagaaaggtgaaggtcaggtacgtggccaaggtcacatataaagcaaaaggcagggctgggttcctacgctactgtttcagttggcttctttccatctcttcacaaaactgagatgatggtaaccttggattaactggagctgaaatatgtgctagaatttccctttagacctccaaagcccagtgaaatttttataggtgctactagaaaaaggggctttcttctaattatttaggtatgacacaaaataaatcatgtcatctttgccttctttttcctcatttcaaatggatgttgcatcatggattcagcataacttttttttcaagggggctctgctgaaactatgctctgttgcatccttagcccgtgatctggttagggcagaaatgcccgggaatcaggctcttggttcaaattaccctccctagtacagatcaagcgggacctaagactgcaaaagtatttactgttgtcaattaagctacaaaataagctattcattgaccttggctcaaatcaaatcctagaaaatggaacttgtctttaccctgtcataatcaaaattatgggtcctacaggaaacttttttgtgtctgtgctcagaaaaaaatatgaagtggctttgctttgtctctatttaccatggtttcaccatgaccttgtccaaggtcagtgctctgtgagtcggcttatggccaacaggaagacaacatggccgagctgtgagcacctgaccagcgtcgagcaacactgtgaacgagtggtgtatagcgtccactgtcaccagttcctggaggtcagggcttgcttttttctttctcaaacaactgcctctaagcagccttcatatctagcagaatgtcaaagaagatcattccacaatttatttattatttatttatctatcgagatggggtttcactctgtcgcccaggttggagggcagtggcatgatctcagctcactgcaacctctgcctcccgggatcaagcaatcctcccacctcggccttctgagtagttgggactacaagcacacaccaccatgcccggctaattttttgtatttttagtagagatggagttttgccatgttgcccaggctggtctcgaactcctgagctcaagtgatccgcccacctcagcctcccaaagtgctaggattacagccatgagccaccacgcccagcctattccacagtaacttaaatgaaacttctacttagagaaacgaaaaatacagccagtattaaactgccccttgaactccccagcagatgagataaaccctgagtcacaactttcttgcctgacttgtctcttcctctattcagatttcctcccatctgaacaactggctcatggacagacagaggctgacctgtggcagcaattgtgagctgtgcttcctttccttgagttataaaatctcgggctttttattggacacacagttacccagaataaaaaattcattcccagcctaccatgtagtttagatgtggccgtgtgacataagtggaaggggtgtattcaagttctaggacattcaaaattaggaggtcttgatcagagcttcactgggggcccataaggatgaggacagaccaaggccataccctaaggatggcagagcaggaaaaccagacaactgcagagctacacagcagccttgaactccctccatccagaatgttaagtgggagagaaataaacacatgccacagtaacaaccaataaaactccctcgtaattacagctgcatattctcaggtgggcatttttctatttaaatgcgataaaattaaattcaaccccagaagtttttctatggcaccaggtttacacaaatcatttgcaattaaatccctttgcaatatgttagtgctcacttctcagaatccaaaataagggaaaaaatctgttgtagattattacatgtacattattatagattacctgattgtatatttctgtgctcactaattgttttatgagtatatttatggtcttttccattacatagaatatttctagttttcacctttttgtcttactctttctttctcaatagcctagggcacattaatgaaagcataaaagatactgaacgaatatatgttttaatgagcatttaaagactctataatgtaatcatattttaacatttctccttcattcactcactcctcatcctcgtctgagatactcaggttgtggatggaggaaaatatatgcctcagctaaatggcaaattgccatggggttgctccacaggttggcaaaacctcaaatgctaaatttgtgagtgccaaggatttaaatatataaaatgcctttatttgtgaaaggtctcaaaggactttgctcattgttgattcatcatatcccttaggtttgcaaaaccatttgcaatttacaaagtactttcacactcatcatctcagtccttggagtcaggctggatattagggactgacacgttatcaacaaggagccaagatggtgaggcacgcctggtgctcatgctcatgagttgctcatgatgtcattcatctcaaaaacctggtgtgtgaatggccctttgggttattttcctggtctccctgttatgagcagcgttgcagcaagcgttctcattcctgtatctttgcagccttgagctaatacttctgtgggatggacttcaaagtggaaccgctggtcagagacttgagaacgggatgcaagcatatagaaagaggcactgggaaagtcttcctggcaggaaaatgaaggagagcaccaaagcatgaagtacaggaggcaggcctaacgagatcatcatttccagcttttatttaactgaaaatgtaggctattgcttcccagcttcagagtgaaactaagtccaaggggacatcacccagggagctgctggtatggcctgggcattggaactctccgggcatctccagtggcacatgagcataggctacctcaccagatccctcagcagctgcaccaacaccctgggcccggggaggatgaggttccgcacagtcgttttctattggaaggagaacacgcaggagctttggcttacagacaacagcagctgggcagctggggctggccaccatgggaaagggacagagcaagaaccagattctgtcaactttaatctacgttaatcctgcttataattctgacatttccttcccaccttcactctcagggtttgcttcatagactctaagacccctaatctagctatttgggtgagtatattatttgtaaatgattccaatgagtttagtttttgtttttggttttggtttttttaagacggagtttcgctcttgttgcccaggctggagtgcaacggcgcgatcttggctcacggcaacctctgcctccagggttcaagccattctcctgtctcagcctcccgagtagctgggattataggcatgcaccactatggccggctaactttctatctttagtagaggtggggtttctccatgttggtcaggctggtcttgaactcctgacctcaggcgatccacccgcctcagcctcccaaagtgctgggattacaggcgtgagccaccacgcctggctccagtgagtttaaaacaaatccttggggctggcgcggtggctcacgcctgtaatcccagcacttggggaggccaaggtgagcggatcacttgaggtcaggagttcaaggccatcctggccaacatggtgaaaccctgtctctattaaaaaacaaaaaacaaaaattagccggatgtggtggcatgcatctgtagtcccagctactcgggaggctgaggcatgagaatcacctgaacccaggaggcagaggttgcagtaagccaagatcatgccactgcactccagcttgggtgacagagtgagactctgtctcaaaaaaaaaaaaaaaaaaaaaaaaaaaaataggctgggcatggtggctcacacctgtaatcccagcactttgggaggctgaggggggcagatcgcctgaggtcaggagttcgagaccagcatggccaacatggtgaaacctcatctctactaaaaatacaaacattaggctgggcacaatggctcacgcctgtaatcccagcactttgggaggccaaggcgggtggatcacctgaggtcagcagttcgaaaccagcctggccaacatagcaaaaccccgtctctactaaaaatacaaaaattagccaggtgtgggggcccacacctgtaatcccagctacatgggaggctgaggcaggagaatcacttgaacccgggaggtggaggttgcagtgagccgacattgcaccactgctctccagcctgggtgacagagcaagacaccatctcaaaaaaaaaaaaaaaaaattagctgggcatggtggcaggtgcccctaatcccagctactcgggaggctgaggcagaagaattgcttgaacccaggagacggaggtcacagtgagcggtaattgtgccattgcacttcaacctggtgacaagagcaaaactccatctcaaaaaaaaaaaatcctctagagggatttgtttattatttatttattatatatttatattttagccccagagaggcagaattgcagaaagagctctgggcctcagagagtcagaaaacctgttcgattagctgggcttggtgacgcatgcctgtggtcccagctacttgggaggctgaggtgggaggatagcttgagcctgggagttcggaagctacagtaagccatgatcacaccactgcactccagcctgggtgacagagtgagaccttgtctctaaaaataaattaaaagaaaaaaacctggaagaaagaagagaaggaagattgatggggagggagaaaagggatgattgtgtactatgcactagctctgagcccggcaccttacatacattaactgatgtctatcctcagagtaatgctacaagaatggtgttgctgctccatttactgaaaacaaaatgaagcttccataagttaagtgtctcctcacaatactacaacccccaaaaaagcaactaaaacaacaacaacaacaaacaggacttgaattttctgacttgtcaaaggattttccattgttccaagattgctgtgtaaactaaacagatgcaaaaactgtttactaaatgctactgaagaataacaggacatcatgatggtgatgccatgacctgcaacacaggttcactaagaatttttgagtctccctggaggtcagccagctgtgtattctcaggctggacgacggccctagaaccgccttgtgagaagtccactcagtatggcagtagctgccattccctgagacatctacactccgtttagagaaatcttcccagaaaggccaaatgtgtgtctttctgcctttaaaatatctttattcacatgcatttctaaggttgcccttcggtttcttccatatcattttcacctttttacccttcttggcagcacataaagcataacttaagtgggtagagacaaagagaagcttgtctggataggccttcgtatatactgatagggattatataccccacccaccacatttgtaaataggctaagaatcacccttgatccttcctcccactacatcagatcttagtggttctccttcagacccacccctcgactactcccctttcctctctgttctcacagccactgccttacttaaggtccccttatttctcacctgcaatagcgccctaactcgtctttttggtcagttctccacagcctgctgcttaggtcctgtgcaccttcccttcataattacttaagtgagctgctagtattacttactctaggtccaggcagcttcctagcgctcacgaagaacacatgacactgccaagttgaccagcttgagtgtggcagcaaacccactgcccccttgagtcctaaaatgataaggtgcagcgaagtgtgtatctgttgtgggttgcactgtgttgcctccaaaaaagacatgttgaagtcctaggccacagtatctgtgaatgtgacctaatttggaaatagtctttgcggatagaatcaagttaagacgaagtcagcaaagcgggccttaatccaagataactcacgtccttaaagaagagaagagacacagaaacagacacagggagaaggtcatgtgatgatggaggcagagattggggcgacacagccacaagccaaggaatgccaaggctggccagcaacactagaagctgagcaaaagcatggaacagaatctccccaaccttcggaaggagcgtggtcctgatgcccatgctgattttgaatcctagccttcggaattgtgagaacacatttctgttgttttaagccaccagttcatagcaatttgttaaggcagccctaggaaatgaattatagtatctaaagaaaggtgggaagggctgaccaccaagatgaaacaagccttcgtgcccaaattcctctgcttcaccaagttgcctttggtagtttcgtatatatactctgtaagaagctagtggtctcagaattatggttctaaagaacaaatgtgattttgttaaaaacctccactttctgtaggacaaattccaagcaagcccttagtgtgccatgtaagccctctcaagtctggccccaacctgcctgtcccacgtactcatgtactcatgatcatcttccccctccacttccctgcctgcatgctgacctccagccatcactctgccctggagtccagcaactgattctcatgcacagtagacaacaggcatggtcaaggcaaccatccagggtggccctggatgtccatcataacgagcaaaaccacaaggtccttactctagaacagcagtctccaacgtttttgacaccagggacaggttttgtggaagacaatttttccatgacagtcataggagtggaacggtttcaggttgaaaccgttccacctcacatcatcaggcattagattctaataaggaacacgtcacctaggtccctcacatgcgcagttcataacagggttcgggctcctatgagaatctaatgccgccactgatctgacaggaggcagagctcagacagtaatgctcactcatgcatgcttacttcctgctgtgcatcccagttcctaacaggccacggaccgtattgcccaggggttggggacccctgctctagaagaccagaagtttgggcagttctgaagcaggcagaaggacctgcagctttgggcacagaaatcacatgagtttaccatataagaaccataaagcttaatttggtgggtatctctggcactatatatcaggcaagcccagttggtgttataggcaacgttatgatttaaacgtgtcttccaaagttcatgtgctgaaaactcaatccccaatgcgacagtgctgaaggtagaaaaagggggaacctttaagaagtgactaggtcatgaggactctgccctcataaataaatggatgctgttattgtgggagtgggtttgttttaaaagtgagtgtggccctgtcttgctatctctcacacactttctcactctttctcgtgcacgcacttgccatatgttgctttctgccgtgttgaagcagcaagaaggccctcactagatgcagcccctcgatcatgaacttcccagcctccaggaccaggagaaataaaattccttttcattataaattacccagtctgtggtattcagctatagcaaaccaaatggactacaacactcagcaatatattttctctcttaattcactttgaactttcatcacaaaataaataattgagtcctgtgcttggctctgtgctaagttcaagaacacacataagagcatctaagggatgatcgtgttcacaaatcaaatcagttcagtctagttgggaaaacaattatcatgcatcaatctgagcatactacaaggcaacaaaagaaattttagggtttcatttttacaactgaaagagttcagagaagagaaaagatcgtgtgcactaatcaggaaaggttccgtggaggaacaggaacttgggccgagcctggaggaagcagaggactcagccactgggacgagggggactttccagggacaacacaaatgaagaaacagaagcataaaggagcagctgtcactactgctgtgaaaaaccttgcgtttagagcaccattctttgttttttaagagacagaatcttgctccgtcaccctggctgttacaatggcatcatagctccctgcagcttcaaactcctgggctcaagcgatcctcctgcctcagcctcccaaagtgctgggattaggcgagaacaccatccttgatcatgctagttcacaaaatggggcccccaaaccagcagcatcagcaacaccaggaaacttgttagaaatacaaagtcttggctgggcgcagtggctcatgccttgtaatcccagcactttgggaagccgaggcaggtagatcatgaggtctggagatcgagaccatctggctaacacaatgaaaccccgactctactaaaaataataataataataataataatacaaaaaattagccgggcatggtggcatgccacctgtagtcacagctaatcaggaagctgaggcaggagagtcgcttgaacccgggaggcggagatcacgccattgcactgcaacatcttgggccccaccctaaacctgctaaatgagatgctctgggcatgggggtggggcccagcaatctgtgctttaacaagtcctcccgtagattctggtgctggctaaggcttttgagaaccactgctttagtgagaagacttataaataagtttgtaattatctattcctacagaagaaacattgaaatcatctccaactagatttcatttagctcttgatataacccaaatgggggtccacatgaagggagagtcagtatatggacatatgtatcccccaacacacacacagaccaaatcagccacctgactgccaggaagcaactgttaatacgcatctgaaggatatttggaaaaattcattatttaaggaagcaacacaggtctgatgtcatggttctatgggacaagaaatcttctgtactaacgataaagtgacttaattgtggttatctaggaccctgaaataataatgggagtacagatgcaactaccccacccccgccccacctccaacactccatcatctttcagtgatcattctgtggcatgttctcctatctcctatgctcacatcctagagatgagggtacatgctcttttatttcaagctcttgtttctgagaacctccagcaattcccaacttccaccattcctgccaaatgaaggctggatttattttgatttgtgttggctctgtagccccttgttaagtaaactaggactctgtgtctggccaatgcattcacgaagagaaaaatagaaggaatcaaagtgaattatagggagagagggagggggaagttccctggaagtctaaaagtaggaaccaaggatggtatttttggcttgggactttctgtaccacatgaaattatgagaatgacttaattgctcctgtgcattcgaaacctgagagagaccataatggctgggttacgcccagactgactggaacaggagttagacagcgtggcctcctgccagctaaacctgctctgcaaacacaagtgactgcatcattcatgctttcaggcctgggctgagtctgatgatggccggtgttgcttttcttcctcaatctccctggactagacagggcagagtatgttacagaggactgtcattttaggggtagccagaggggcagaggtgggctccagaatcctttctctacctcgctatgtgcacttaggcagccacttaaaccattctgtgcaccctagtttccccatcccctgaatatgaatgacaactctgtgccttaactatttcacacaatgctggagagaataaacttgagaaaacagattcaaagaacttctgggaagtgaagattgttatactattgatagttattcctggactctcttgttttcacacagtgtcttttgcatccctccttcccacatactgtgagggatacctattgagttgcctgccctgattccctctctgcaggaggtagcagccatgatggttaatgccaccctgccacctggtcacaggagaaggcctctgacccaagccagaccaagtgatctcactcccagaaatggtataatggaaagatttagggactgagtggtcagtggcttaggctcattatacaacccagtgattttcactccggggcagctctgctccccagaggacatttggcagaatatggattcattcttggtggtcagactgaggagggggtactactggtatctagtgagtggataccagggatgtagctaaacatcctcctatgcacaggacaaacctccacaacaaataactctctggcctaaaatgtcagcagtgtcaatgttgtaaaaccctggcttaggtgactgctggaggtagaggggctgaggaggaggcagcttccatctagctccagccaattgttaccacaggcggggtggcaggaggaatgaggcctcaaggttgcctggtctgatttttctagagaagctggaaatctggatttccatgagtaaccttttgatttttaagcaccagctcaatttttaataaacgtatgggccaaataaatacatctccaggcctcatggagcctgggggccaccagcttacagcttctgatggggagaggagacccaaagtctcctttacttgagctttttgaagctatctggcttctccccttccttggatgttgtgaggcaacagaccatgatttttttaagtaagttctctgtgttgcctaaacaatagcttccattacatgtgcccccaaaagccttaactagtacacaactcctacctgtttctctcccactcacttctttggctacatgttttgacctgattgccatccccatccacgtaaaacattttaatctcagaactggaaggggtcttacgaaaggtctactagttagggtgggcgggggagagtattaggaaaaatagctaatgcatgctgggcttaatacctaggtgatgggttgataggtgaagcaaaccactatggcacacgtttacctatgtaacaaacctgtacatcttgcacatgtaccctagaactaaaaattaaaaaaaaaaaaaaaaagtctagttctgatctgccaagaaataacactgggtaagttacttaacctctctgtgcctcagtttcctcatttgtaaaacagacatgatacttatatcacttcatcagactgtgaggaagattgaatgagctcttgtatgtgcaatgattagttaaaatgatcacattaacctcttccttgaattctttgcctttggaaataatgccccaatgctgctgctgttgctgttaataaaaatattaaaataagcacacttagattaagattggtgtttatatttgtctgaggcttagcataaaaacttgcaaaggtggaattagagcactaacttgaactttctcagtgacaaataagctgcgatccatcagcttactcagacacgtttttgtaacattttgtagacactgaggaatacttttgcactgaggcacccgtgggccaacaagtaccagagtggtttggctcgtggtgattctgagaaggagcctgagcagcaggagacagagcaagtaaggaaagggcagctgtcaaaccatcaaacctccacttgcaaaaaccgaaaaagcatacaagaaattcttgggccagagtgcaacaatctctcaccatctgaagaatttagtgtatccaggtttatggctaatctaacctgtcacaagggctgtggctttctttgctgaagccaaatcattctggcctgaattcttgccaataccacttgaccctcataaaagtccttgacagcagagtggatgccatttttcccttggctttgaaaagcttccttgccggcacccattacaaagagaatagggtctgctctccagactggaggccaaaatgctaattaactcatacccaagtctgccaaaaaaatttgtgggcagcactctttcttcccagcagtcactattatagcagtattatagagagaagagaaagaaagaaaacgaatggaaatgaataaaagccagaaagaattctgatattaagaccaaataactgcatacgcttttttacatttgtctttcctacattatttattttttatttttcggaagtctgatcacttcttgcccatataaactggtctttcaattataaaatttatcttgtcatgtacggattagacatcaatcctcttgctttccatagcgaacttcacagaggatttatgtgaggtctacaggatccgttagcaagtctttcaaaatatttctatgaaaacactgtgctttgtaaggaagatatcatacaaagcaaataatgcaactatagcagggaaataaatctggaatccacccaagtacctgtgaaagttggtattagtaagataccactcctaaatgtaaataacttcccatggtcttatcagcagcagagctaaataagatgctcttatttagtaacctcagtagcccaggaataatctagagtattaagttgtcttcttgctaggaatagcttcctccctaggcagagaaaaaagttcacctgatgtttgtatatgccaaaaggggcatgtacattccaatctttatccgtctatctatcatccatccatctactcgataaatattgaatgccaattaatggtccagatactttgctataagttggcagatagagatgaacaaggcacacacattacctgccctcatagagcttacagtccaataaggcaaacacagaagtaaacaagcaatgctaacagtctgataagagctgtgtatgctaagacatacccttttctccctcctccctaaagaaacctggaacaaggtgccaaaagctggtaactaagtagaatttaatctggcatgagtcatgataacatgtaggatgcttagggtaaactctaaactcacaatcactaagggcaacgcaacagagaaagtgatttgggaagacagcagcaacaagagacctccataaagaaggctcttgtggtagcatatgcaagatgaccactcaggccaaacctagtatgactatacaaactgttatcagaggggcagtgctgatagtttcagtttcaggactgccccatattagtgtgaaagtctgggtacaggtggaatttctgttcttcggaacagtaaaccctgtgtaagaaagggaggcagaactgggggacagatttaggagaacaaattttctggcttgtcagggcctaggggtgctaaagatgagcaatggaagaagagatggagagaatgctggtgtgacagagcgagggcgtgaaacagtcaggaacttttctaagtccttcatgtgggctaattcaatatttacaattgagctacataacctcataaggcaggcacaattattgtcacttccattctacagatgtggaaactgaggtagaaggttatgaaatttgtttcaaggtagctagtaagtcatagagccagaattcaaacgcattcagcctggttctctagttcagtggggcagaagagtttagatctgcctaaacagtaaatggggagtcactgaggatatttaatcaagacactgtgtaattacaattgcgatttcatgagtgcatgtggtcaccacatgtaggacgaaccagaggggaaatggaagataaatggcatttaatgaatgcctctggtatacccaggcctctccagccattatcttacaatcctacctcattacccaacaatcactctagaagaggcagacatggaggtcccatcttcctagtgctggaactaagtctcgaaatgcttcaatgtcttgcccatacactcctgtatgcaatagaattgagcccaacggagactaccatgaaagcccctgcttttcccaccacactgtcctggaaatgctagacacaacaaactaggtagtggtttttataattgtcaaagcaagtggtcatgagaactggaggactaaaggatggtagacttgataactgatcagacatgaaaatcatacaagagattaaaaccaaaaaacaaaaaagatttcaaaattattagtctagaagacttgcattgccagtcatagacatttggaagttacaaaagaggaagatgtttttgttttactgcagtttgggggtagagagtagtagaagcctaccagaatgttgactaaaaatactaacatttattgagtacttactgtttgccaggcagtgtactaaggacttcacgtgcaccaattaatttaatcctcacaaaactctttgagacagatgttgttattatccccattttaaagatgaggaaaatgagaaagtcactcaagattacacgaagagtaaattgcaaagctggacttgaacccaggtctatctgacttcctgtcttatagaaactgggcattttaagcctcagagaagacatgacagtgggttaagaagacttgcatgactggctcatgctagagaagcagaaccagtatgaatgggtaagtgtcattttaaaatatattttagtggctgggtgtggtggctcatgcctgtaatcctagcactttgggaggtcaaggcaggtggatcacttgaggtcaggagtttgaaaccagcctggccaacatggtgaaaccccatctttaccaaaaatacaaaaaaaagcctggcatggtgacaggcacctgtaatcccagctacttgggaggctgaggcaggagaactgcttgaacccagaagccggaggttgcagtgagctgagatcgtgccactgcactctagcctgggcaacagagcaagtctccatctgaaaaaacgaaaaaaagaaaatttagttcaaacatgaagtttctgtaataacttttctgtattctaccttgaaaagaaaataaatgcatattttataattattataaaataatgcaattgccctgacatttctagtaagtttagctgctcaaaaataagcaggcttggaagttttagccagagctatcaggcaagagaaagaaagaaaaggcaccaagataggaaaagaagtcaaactacctttttttttttttttttttttttttttttttggctgatgttatgattctgcacctaaaaaaccccagagacagccaggcacgggggttcatgcctgtgatcccagcactttgagaggccgaggcatgcggatcacctgaggtcaggagtttgagaccagcctgaccaatatggataaaccctatctctactaaaaataaaaaattagccgggcatgggggcatatgcctgtaatcccagctactcaggaggttgaggcaggagaatcacttgaacacagaggcagaggttgcagtgagccgagaccatgccattgcactccagcctgggcaacaagagcaaaactccgtctcaaagcaaacaaacaaacaaagaaagaaacaccctagagactcctccacctcgaactgacaagtgacttcagtgaagttcacgatacaatatcagcatacagaaatcagtagcatttctatacaccaatgacattcaagttgtgagccaaatcaagaatgcaatcccattgacaatagcaaaaaaactaaaatacttaggaatacatctaaccaaggaggtgaaagacaactataagaactacaaaacactgttgaaagaaatcacagatgacacaaacgaatggaaaaaacattccatgctcatccattggaagaatcaatatcgttaaaatggccatactgcccaaagcaatctacagattctatgctatttctatcaaacaaccaacgtcatttttcacataactaaaaaaaactattccaaaattcctatgaaaccaaaaaagggcccaaatacaaaagcaatcctaagcaaaaaagaataaagccagagacatcacattaactgactttaaactatagtataagggtacaataaccaaaacagcatggtactagtacaaaaatagacacattgaccaatattctgttctctgttctgttcaacagagaacccagaaataaagctgtacacctataaccatctgatcttcaacaaagttgacaaaaataagcaatgtggaaagaacttcctattcaataaatggtgctagggtgcttggctagccatatgcagaagaataaaacttgaccctacctttcaccacatacaaaaattaacccaagatggattaaagatttaaatgtaagacctcaaactataagaataatagaagacaacctaggaaacaccactctggatatcaatcttggaaaagaatctatgattaagtcctcaaaacaactgcaacaaaaacaaaaattgacaggtggaacctgattaaactaaagagcttctgtacagcagaagaaactattaacaaagtaaaaagacaacctacagaataggagaaaatattcacaaactatgcatctgacagaagtctaatatccagaatccttaaggaacttttaacaattgaacaagcaaaaaaacaaacaatcccattaaaaaatggccaaaagacatgaacagatacttctccaaacaagacgtacaaactgttaaaaaaatgaaaaaatgctcaacatcactaattatcatagaaatacaaatcaaaaccacaatgagatacaatctcacaccagtcagaatggttattagaaagtcaaaaaacaacagatggtggtaaggctgaggagaaaagagaacaattacacactgtaggtgggagtgtaagttagttcagtcactgtggaaagcagctgggagatttctcaaagaacctaaaacagaactatcattcaactcagcaatcccattactgggtatacatcgaaaagaaaataaattgttctaccaaaacgacacatgtacttgtatgtttaccacagcactattcacaatagcaaagacatggaatcaacctaggtgcccatcaacagtgaattggataaaggaaatgtggtacatatataccatggagtactatgcagccataaagaagagcgaaatcatgtcctttgaagcaacatggatgaaactgggggctattatcataagcaaattaatgcaggaacagaaattcaaataccctatgttctcacttaaaagtgggagctaaacattgggtactcatggacataaagatggcaccaatagacatggggactactagaggcaggagagagggaggtgggtaagaactgaaaaactagttataccccatatctacaaaaaatacaaaaatttgccagaaggctatgtgggaggctgacctgggagaatctcttgagcccaggaggttgagccgagatcacaccactgcactccagcctgggtgacagagtgagaccctggctcaaaaaaagaaaagaaaagaaaaactggcagggtgcagtggcaggtgcctgtaatcccagcactttggggaggccaaggcaggcagaccacctgaggtcaggaattggagactagcctggccaacatggcaaaaccccaactttacaaaagtacgaaaaaaatagctgggtgtggtggcgggcacctgtaatcccagctacttggaaggctgaggcaggataattgtttggacctgggaggtggaggttgcagtgagccaagttcacaccactgcactccagcccgggcaacagagtaagactctgtctcaaaaattaaaaaaaaaaaaaatagaaagaaaagaaaaactaactattgggtattatgctcagtacctggatgacagtaccccaaacctcagcatcacgcaatatacccaagtaacaaatctgcacatgtaccccttgaatctaaagtaaaagataatgtgttttgtgtcaccttttcaacataagaaactgtcaccatgaaactgtatctatacttacaaattgctctgaaaattttgaccttaaaagctattttttaacttgaaaagtaaaattaaaggtaaaaaagaaacccacagcatttttcactagagaagaccaaatcttttgtggttaaacaatccagatcatatgagtgtttagtcaagtgtttttcaagttcaaagtgcttacctagcatgtgtaagaaggaagccatgagagccagagatgggctgaaaggaaattgtcctgcttacctggctattttaaaagcataagtggctctgtcagagggaaagtgaaatctaatagagtcctgacacagattgtattgattctaaaaagcacattgggaaaaagaaaaaggtacatgggttttgagtttgtttgttttttttccatttaacatatcttaaaccagaatatgtcttacaacagaagacatgtcttaatttagttagcaatatttttcttttttaaaggtatataagaaatggtgctttctggccgggcacggtggcttacgcctacaattccagcactttgggaggacgaggtgggcggatcacgaggtcaggagatcaagaccatcctggctaacacggtgaaactccgtctctactaaaaatacaaaaaaaaaaaaaaatagcctggtatggtggtgggcacctgtagtcccagctactcaggaggctgaggcaggagaatggtgtgaacccaggaggcagagcttgcagtgagccgagatcgcaccactgcactccagcctgggcgacagagcaagaccccatcacaaaaaaaaaaaaaaaaaaaaaaggtgccttttgaaatatcaatggcaaccaaaaatggaaataagattgacagaaaagaaacatctgttcctaaaaccaaactaaaccaatggttttgatgaaatatggtaatttctgaacatgaaacataaacaatttcaacaagggaattgacattcagatttaaaattaagggtgatatgggccaggcacagtggctcacacctgtaatcctagcactttgggaggccgaggtgggagatggcaaggtcaggagatcgagaccatcctggttaacatggtgaaaccccgtctctactaaaaatacacacaaaaaaatagccaggcacggtggtgggcgcttgcagtcccagctactcgggaggctgaggcaggagaatggcatgaccccgggaggtggagcttacaagaagccgagatcgcaccactgcactccagcctgggtgacagaatgagactccgcctcaaaaaagaaaaaaaaaaaattaagggtgatttggagaacggctgtgtgcatttgtctgatgactgcactgatgttgctgtgtgctacagggccccagcacactggaggggaggaggacctggaagttaagggaaaatagcaggcttgggacaaagggtgcagccagagaggggtctggctgcccataagagcccctggggggctgtcaccttatattattactagagcttgcgggatgtgtgttctgagtttgaagcagcaaagacccttcatgagcccacagtgacttctccagctccatggtgagaaagccaccaaaggcaggaaaaaaaaaaacaaaaacggaatcctcgagagagctgagattcaagatctaatctgggcaaagtgagggatcctcccttgtgccctcagttctcaagaacaggacccactttggccacaaatcataagtaagaaaagaaggctcagccgacagaacgtgagacaagtacatatatccgtgtgggcagtgaggcagtgaatgacatctaaactgttagaaaacccagactccaattaattctattctgcagtgtcctaggtctgcaagcatccaaaagtgcaagcatcagtcacatccgttaagagagaatatgttttcaaattaaaaaaaaagggagaatatccaaaagaaaatcaatgacactatcggaaagggggccacccctcgcctatgagcaacacaagtctgtggagagccttgtgctaaaccaccccaaaatgacctgcttctgggtctgggttttaaaagaaaaaaatcaggctgtctttggagttgggcatgttctggggagcatcggggatgctagagtatctgggttggttcaaggggaggaaaaggtagagaagaagcacacctcagagatgctgccagatagagctcctcaagttcaaggtgacattcttctccctgaaacccaggtgggagaaagagctgtgtctcgccgtatttatccccatcccaagccccccccccacagagggcagcatacagcagagcctgagaattattggttggatgaatgctcaagtgctgcacctgcttctttcagactgaggggacctgaggagtaaaattgagccttatgtcctaaagacattaaaagactcctaaaggccttgcttctatcagggagtaattaagacacaaagaaaaatccagatagtctcaactacaagtacatttcccatttacaaaacttcaagtaatagctggatttgtttttacttttagcactctaaggctttttagaaaaaaaaaaaaaaaagccttttgactgaagaactatcttcccttcagtagggtttaacaatttaaatgaattcaatttccttttcttttttttttttatttctgggacagaatctcgctctatcgccaggctggagtgcagtggcacaatctcagctcactgcaacctccacctcctgggttcaagcgattctcctgcctcagcccttccgaggagctgtgactacaggcgcccgtcaccatgcccagctaattgttgtatttttagtagagagagggtttcaccatgttggccaggatggtctccatctcttgaactcgttgatccacctaccttggcctcccaaagtgctgtgattacaggtgtgagccacagtgcccggccaattgtcctttttagttaggggataaaagatctccaaatgacataaccagggatttcgtggaagtgatcacagcttgactaaaggacttaaattcgtgcacaatgagtcccagtcagtaggctgtgacatcagctgaccagcacctaactgcaccacaggttgagattatttatttatttcaactccagattttatggagtttgatagtgcaatccaataacacatcttttaaacaataaacactaaaatgtatacatgtccaatcattttgttagcttttttccatgaaggaatactaagatttttaaaaattaatttagcatttcttcattatctttttaaaattaaattagttaagattaaaccattaattcctccatccactggcccaggctgggggaatactgctgtgcttggtgagcacaggagcaggtgtccatttccatggcatctgtagtgctcaatgtcagcccacgcaagtccttgagctctcaatatctgtttttcagtgtctgacctgtcaaatgcgggacatggattgactcccacagacccttccagctctaacccccatggcctataatcagggctgtccagtgaatcagaatgtggaggcatcaagaatcttcccaaagcacaaaaagcaacagctacgacatttaaagtaatgggaataggaagagggaagtcaccacacattcttcatgatcctgaattctttaaacaccaaaactctcattaaactcaaaggttcagttcctcttccatttgagtacatttgtattatcagatgcttaaaggaaaaacaaaacagaaaaaaaaaaaacccagacagctatgtatttccctgaagacacaaataattcacacttctctggaaaagcgcacagtagaattgggtgggacgggcatggtggctcacgcccgtaattccagcactttgggaggccgaggcaggcagaagacgaggtcaggagatcgagaccatcctggccaacatggtgaaaccccatctgtactaaaatacaaaaaaaaaaattagccaggtgtggtggagcatgcctataatcccagctactcaggaggctgaggcacgggaattgcttgaacctgggaggtggaggctgcagtgagccgagactgcgccactgcactccagcctggcgacagagcaagactccatctcaaaaaaaggattatttgggtggtcagtctgaacccatttttcaatttaaaatcacaagatgtttttcaatgtcgtatcgacacgtgataactgttgattttttaattattattttgagcctaaatgtctcctaaccaagagatttacattttcatgattttaccattccatttttgtctatgaaccttgcttttgtgttaaaatatgtactgctacttgcataatttatagctatgctttaattaaagatgatgtattcctacataaattcttccctttgtcaatatggtaaaaaggacattggaaacacaactcgaaagcgacctgttcagagtctacctcttatgggctgagtgaccaagacctgccccctgcccccgactctactgtatgtaaaaaggttttataaaacagcaagtcagggaaccactcagggaacagtggggagaatgtaggacaatcctgagcaccaggcttcaggcaatcaggcacctgcacccagaggaactggaacctaggtggggcttttcgggtggggtcgcagtagggaaagagaactgaagaggtaatgataccatctccctttatgggtaaggcgttttctcacttgactcttccacagagtgcacacctccatgcaggagtctcccatgtaatcctccaccttgtgtggacccaagactttgctttctattcccatggacccaccagtgcagccgtggctcaccgctgggcactgctagccttgatgcctgcttacatctccatatacctgctttttaaaaggcactttgtacatttttctttttttttttttatttcagagatggggtctcactctatcacccaggctggagtgcagtgccagcctcgacctcccaggctcaagcaatcctctcacttcagcctcctgagtagctgggaccacaagtgtgcatcaccacatctggctatttttattattattattatttatagacatggggtctccctatgtttcccaggcttgtctcaaactcctggccttaagcaattctccttcctctgcctccaaaagtattgggattgcaggtatgagccagcacgcccagccatttatttactttttaaacatcactgttaagtggacagtgcaggagggtatagtgggatggcagagagaccagttaggaatatcctaaatcatcctgaccgagaattgcctctccagctcgctgaattaggagggcagctatagagtggggcaaagctgtcagattcgatgtatttttataagcagaaataacaagatgtgctgacaacttgtacatgaaggggctgagggatggagtgaagttaaggaaaggccagggtggactgccatttccagacatgtcttgggaagggctgaaacttctcatcagtgggcaaaggaacgtttgccacattgacaccctctccatccccagcacttcggaagctgtgttaaaagaggagatggtgggcccaacagcctgggcagaagtgtggaggcttaccctgctaaaaggaggaagtggaggaaaacacaaagctccatggtgggggggttccccctctcaaaggagatggggctgggtggcagaggtgtcagcagagggtgagagaaagttcaccctgacagattaactgggcagcaaacgggcttgcaaaatgtggcctttgctcaaaccaaaggtagaatgtgagagtggagtagtacattttcttgcactggggaagtgaccttctgcttagtcccgtctacctcccagagtgtggaccagaagagagattctgcaggaggaaagagaacttgatccattgccaggctcaaaccttcaagacttctgaaaaggaacccaccttcattggggtggcaaattgaccagacaatgaactttctggcccctctcccaatacacgcttggtactgggagaggggccaaaaagttcatttttacaacctctatgaaaccccagttgtgttgttggtatctcttcatttcatgagacataaattcataaattagtattactatacttagtattttataatgaccagttatagaaacttaaaggacatacacaactccagctgtgcagagatgaccctgatcagaatacagatgttttgatcaacctgctacacatagctgttctgtgtggaggggacctcatcagccctcaatatattgggcaatctgtagaagactctggtgtggagcatgcaaggcctatagagttaagcatttagggcatgtgaaaaatctaagacactggtaagtgagtaggtcccagggctacttctacccatacgtttgagaaaactaaggcaggggtgtgttaccctcttagactctgtgggagggcattatcatcacaatttacagacaaggaaactagttcagagaggttaagaaactttgcccacagctaatcaggacagggttagaatttgaactcagcatcctatcaatgacaccatagctgcttcacgaagatgactgttatcaacagaaggtacggaggactcaaaatgggtaatgtaagtaataatgagaatattattcatgacaacagtaacaattaacattgactgaatgcttactgttaatttaacaaatgtgtgttgagctcctcactatatgccagacactgctggaggcactgggaagacagctcctccatggagcttacaatctagtaaagactcatgccaagtcccatgaattattcctcttaatcctcaagcaacactatgacgtagatactgttctaacctatattcagtgtgagagtcagagtggttaaaggacttacctaacgtgccatagctagaaagtggtgtcgagctggggccagagatcctgagaatcttatgatcaatccagttcattaggtacccaatagcaatcctaaatgtgcattgttggaggaaaatggaccaacgactcagaatgtaaacatttcgggtagccccaaaccaaaagagatttgacatccattcaaaaactgcaggaatactctaaagaacattctaggacctctgaaaatcacagggtggtgagcagcccacccaaactttcccacagtctagtgtgccttccaagttcatggtctcatatgactccatatgaaaactgccagccgtcaaatgctggacaggccaacttcctgaataaccaccactttttgattctctcctaaggtctttaaaagagcaaaccacagctattctcacttcccagaaccctttgctgattacagcgtgagatcaaatccccatggacagggcggactggtatttcaaacatgaaacactggaatgcagattaataatttaccaatgactgtaaacgaatattattcatggagggaaaaaacttctctcttttaaatgggaacccagtcagattatctcagtactttaagaagcaaactgcaaaataccttcttagaattcaatatttattaacgctgatgctttattttttaagaattaaccattcccagcttcaatattctgcttcagcataaagttcactttattctgcatgtggatttctgtattctctgcccagataaattaatacatattccagagtctggggccacggtcaatgaaaaaccacagcaaattcctaagcagtaagagatattccacatggcttgaaatggctgaaggagaatttttttaaggttaagaatcaaagtgctgtaattgaagatcttaaaatcaagcagcaaggcattctcaaggtacctaatgttgacttcaaggatcatttaaggtaaacttccctctcctcatccttccttgctcaccctcgaatccagtttccagctttaagagtggaacattgctgacattaggtcggtgatgttaacttaaattggcaatgcaatgtaaaaagtggcaggcaaagtacgtataactcaattacttgaaaaagtaaatatccccaaatattcccaaggtctgttgtcaggtttttgcctaagtcaatctataggtacatggcacagggaggtactgtaataatagtcttttgtaggtaaatttctaagcaaactgctttaaaaagctatccttgattcaacttgcaggtatttacaatagcaccctccattccatttaatattataagtgcacctgtcccacctttatgaaaatcatgtagaacaggagtcagcaaactacagcccgtgagccaaatctggctcaatgattatttttaatttttatttatttgtgttggttttttgagaccgagtcttgctctgtcacctaggctgaagtgcagtggtgcaatcatggctcactgcaactttgacctcccaacctcagacgatcctcctgcctcagcccctgcaggtagctgggaccacaggcatgcaccatcacgcccagctaactttttaaaaatctgcggagatggagtctccctacgttgcccatgctgctctcgaactcctgggctcaagcaatcctcctgtgtcgtcctcccacagtgctgagattacaggtgtgagccacgacgcccagtctgattgtttttgtaaaccaagttttattagaagacagccacgtgatttcatgctacaatggcagagttgagtagctgtgacagagactgtatggtccacaaagcctaaaatatttactatctagccttttacagaagaattttgctaaaccgatgtaggatcaatgaggaaaaccttgaaagatgtgacagcagccttgctcagtccacaggtggactcactatattatggacacagtaagtgacagggcttttaaatcacaagcaccttccttttccaacccccatctacaactggggaaacatctctgaactaagggaagagcactgatatgagaaatcagaggtcagcaacatatcagaaaagaaacaactgagaaccaagaaactgccccatatttcagatgagatgggagaggtagaacaatatatacaaacggcaagaaaaagatcagatagactctcctctcctagagatcgcaatcaacttgattatcaacaccagccccaaattgttttttattacaaaggtatgtagacacagcactctaccactccaaaaatactaagatggaaagaaatgaatcccaaattttcaacaacttatatcccttccaccatctaaatttcattaggttaacaggtcagtagcacatctttaaaaagtataaataactctgttaaagtaatacctgtcagtcattttcaccttgatgaaaattattaatgtttcaatcaaattttcttttctgtttatatgtagctagttctggctctacaattctataatttcatggtttgatttcactgcatgcagctctcttttattattgcagggcaagggtgatattcaaaagagatgaaaggaaacaaagactaatttcacagtaagggtaacgtgaggctactacaagtggaatgaagcccaacggctctcttctttagcctgaaatctaggttctagataaaaattgggatgcgtataaattaaatttaaaagcaaaagtatcctaccatgttgcagtaacttagcttttccttcctttaccattttgtgtcctaaaacaactctgtgagtagaaatagataatgtagacattatttccattttgcaaatgaggaactgtgttgtctgagaggttaaatcacttgctcaaagtcacgggtaagggagaattcaaagtcttctaactgccgctacttcttttgtgagacaaaagtgtgtgataggatttactgtgtccaagaatgctgccgatttaacgggaaggaatcctgggcttttgtacagcaacacatttaccttctcaaaattaaaaagtaaacccattatttacaaattacaacttgcaattagatgggaagaagtaagcatgctgatctaggatttccattatgtggctgacactagggaggccacgtccattctcattagaatacacagattactaacctgacagcagcagcagtccacagacaggtgtttctagatgtagtgtcccctgtgctataaatccacagcaggattgtcagtgatgtgtctgatgctacagccacataaactaactttccccatcacttagatcaggcatttttgctactactgaacagaagagagttcaggaattgactttgctggcgctctatttttttttttaatttaattttttagagacgaggtctcactatgctgtccaggctggtctcaaagccctgagaccaaagctcaagtgatcctcccacctcggccgcccaaagtgttgggattacaggcatgagccaccacgaccggccctgggattctattggatgcagccaatttctttgtcaagattggctccatgctgttatttaatcaggtgtttcctactgtgtagacaaacctaacagctctccatcttaaaaaaggagtgaggaattgagctggacagagatgtgcattccaaatttttctttccttttcataaagacttgatcgtcttatttatctggattggccatacacagtaatctcactagctgacagttgcttagtaaacacaactgaaggacaatccactaagaaatgtcacatttcttttaaactctgaaatcctatatcccagttccacatcttgcttttcaagtttctgttttaactatccagcttcatcactatctactttctttctttttctttttcttttttggagacagggcctcgctctgttacccaggctggagtgcagtggtgcaatcttggctggctgcagccttgaactcccaggctcaagtgatcctccaccacagcaacccccggagtagctgggattacaggcactccaccaccgcgcctgggtaatttttgtattttttgtagagatggagttttgccatgttggccaggctaatctcaaacttctgggctcaagcgatcctcctgtctcggcctcccaaactgctaggctataggtgagagcgaggtatctacttttgaatctagtccatctactcaccaacctcccacacccattgtgaaattactactactacccacaaccctaccacacaacactggacctatttcccattggtgagtgggtatccttcctctgagcaaatggacttcctacttctttctagatccattctcttcctgcctggctttcagcttctagtttttcatgcttttttctccctttattcctatgtttatagttgaaagctaaaccacaagagtgagttcagtaaatattttttgagcttccactatgcatctaagtaaacacttcagaaccagcatatatcctcataggaaagagctacttcttcctctgaaaccccctggaaatatgcccaggtaatagggaagcacatgaaaggtaagcgacttcctgactgaatagaccaattgcactcagttttgtggcagtggatataaaagaaatatgaagaacctctcgtcagtggggcacaatgactcacacctgtaatagcaatgttttgggagaccaaagtggaaggatcgcttgagacccggctgggcaacatagtgacactccatctgtacaaaaactttaaaaattagcctggcatggtggcacacgcctgtagttccagcgactcaggaagctgaagcaggagggtcacctgagcccaggaggtcaaggctgcagtgaaccatgattattgcatcactgcactccagcctgggtaaccaaatgagaccctgtctcaaaataaataaataagtaaaaataactaaaagtataattggaatgtttgtaacacaaagaaattataaaggcttaaggtgatggataccccatttatcctgatgtgattattatgcattgtaggactgtatcaaaatattgcatgtaccccataaatatatacacctactttgtacgcatatgttgtttttcttaaaaaaaaaaaaaaatgaccattttagacgactcctgacataaacacagaaaaatgctaccaaatgtcctccttttccattatggtaacagcatattccccccactggtgacaaagtggcagaaactgctacaggaccaaagtagaatcagatggtatcaataaaactgccaacttcatccaaatattctccaaagcttattaagtctctgaaagacgattatacagagatcacttggcaagggctttctttcgcaggcccttccagtcacaatgctgggtctttgggttcagcctggcagggtcaaaaacagaaggaaatcagagagaaatttgccaactcttccacactgactacaagaatgatttacttatcagactggcatatatgtctccctcattttgctccatccacttagatgtctcacgtacaggtcacactttcagaaacctcatagagaattgccaagcagacaaaggaagcctatttgcaaaaaacacatccaccaactcctcctcgctaagaatatccctgaagaagttctaacacatttattagtgtaaagatttaacacaaagattgtctcaaagagaacattcacaccacactgggtcaaaccgtgaaagagaaaaacaagggcattcttgtggcatctaagcctactcagaataatctttattcattatttgcatagctcatggctttatatttttattattaaagtgcaattttgacgttcaaatttaagaagaataaagaacaagatttggcaccacttggtggatatatgtactatccttggtatgtagtaaaaggtggactagcatcaaagagtgtgaaaacgactccaagctactttcagacacttcagctggcaagcgcaggctgctacagtatgagatgtaatctgccaaataccacagaatgcaagattttacggattttgaaagaagcaagtgatgattctgtggccacatcaggagagcatgttttctgcatcaataaatctgtgccgaatatgaataaaaaaaaaacccacttggttctacctcaagggctgcttttcaccattgtcccacacataagccagggctggaaaagtacaagagacccggccaggcttgctctcagatctctttgaagtcccccacctgttttcctagctacttggaggccacgatggacttacatttaaactatattagacctcatgcctcagagataggccactgctaagcagcctgagcatttatttaccaattaacttagtccggcattttgagaggtagtgggagagacacggacgcattcaaatgactccccttgagatgtcaggaaagaacctgtatcatctgaagccatgtgtggccctgattcatgcggaggaatgagtgtcacggactataagcggtgctgtctgcacacacttgttctgatgcctttccaatgagaacccggctgtgtgctgtgggctctctctggtcacacaaaaaaacaagtcctgcagcaactcaagtgtgctaccccctctcccactacacccaaaatattaacacaaaagcaaaaaaaaaaaaaaatcttgaaactttttctggaattaaaaaaaaactaggccgagtgcagtagctcaggcctgtaatcccaacattttgggaggctgaagcgggcagatcacttgaggctaggagtttgagaccagcctggacaacatgccaaaacgccatgtctaaaaaaaatacaaaaattagctgggtgcgatggcgtggccctgtagtcccagctactcagaggctgaggcaggagaattgcttgagcccaggagatggaggttgcagtgagccgagatcatgccactgcactccagtctcggtgatgggagtgaaacgctgtctcaaaaaaaagaaaagaaaaaaccctagattcaaagggacatacataaataaggtaaataaggtttatttatgtccctttaaaactagcagtcaggctttcataagtaacttttatttttaaaattatgtgtttttaatagtacttgaattttggacatgtgttggatcatctgagaattctctgatacctccagtaattcacatagtacacccctggtctttttttgttttgttttgttttttaattatactttaagttctgggatacatttgcagaacgtgcgggtttgttacataggtatacacgtgccatgatggtttgctgcatccatcaacccatcatctacatcagataattctcctacccctcccctagccccccaccccctgacaggccccagtgtgtgatgttcccctccctggtccacgtgttctcattgttcagctcccacttgtcagtgagaacatgcggtgtttggttttctgctcctaggctggtttgctgagaatgacggtttccagcttcatccatgtccctgcaaaggacatgaactcatccttttttatggctgcatagtattccacagtatatatgtgccacgttttctttatcctgtctatcattgatggacatttgggttgacaactcctagttttaaaaaaaaaaatctatgcttatataatacctccttgcagttactgaattgtacagttattgaattgtttatcttttacaaagcacttctactttatttcatttgattcttatggaggtgttttattattatgaatatttccgttttacagatgtaaaaatggagggaactgattaagatgacaagagccaggattcaaaccagggctccacactctaaatttctattgaataatttttaagtttcctaagtttactacaggtatgaaaacaaaacataaggcaggcaattatgatgaaacctgctctgctcaggaatggagttgtgttatccatatctacaactgctgagcttgattgtgatttttctaaacatgaacattcatcagatataattcgtataatataaagcacatggttttattctgttctacaatttcgcatttggcagaaaatagagctttagcctacattatgaaacttaaaagaacattcagactactatagtcaaaaatatttcgctcggctgggcacagtggctcacgcctgtaatcccagcactttgggcagccaaggcagacaaatcacttgaggtcaagagttcgaaaccagcctgaccaacatggagaaaccccgtctctactaaaagtataaaaaattagccgggcgtggtggtttgctcctgtaatcccagctactcgggaggctgaggcaggagaatcgcttgaacccaggaggtggaggttgcagtgagctgggatcgtgccactgcactccagcctaggcaacagagcaagactccatctcaaaaaagaaaaaaaaatctcgctcacagagttcttataggacaaagtaaaatctaagcttagatatatctttactcaataaggcaaatcacttaaacatcctccatacatttccctgtccatgatgtggctaatatggttaaattaaactcctttttttcctcctactcaactgagaaatgtcagcgaagagtgtaaattaatcaaacaaaatccttctaaaggaaataagctctgtggtctttgcagagtcaggtaataggtgtaactaaagtggccctatattgacaactgcattgtgaggcaaggcaagaaaaagtgttcaagtctaaaaaaaaaaacaaaaatgaatagattgcttaggaatttggtagctgtctctacttacaaatgaatttctattttcattaatataattttttataatagctatataaactagatcagtattgactttttttttttttttttgcttgaaagaggagttgaaatgtcttccacagcacatagtacgttcctgactcccagatctgtgctgagcaaactttctgagtttttcaaccttggtcaatgagaggactgtgtttattataaatccatgaagggatatcacctgctgaattgcagagaacagagaaaaatgtttcctctctggttttagaacatctcctcttaagctcgctccataaaacactcagccaaccctgcctgcaagatgtcctcagtgctgagccaggactgtctctatgggctctcaggagtattggggctggtctccaaccaccctgctaagctgggaaaaacagtaggggagtttcaactattgctaacctgtaaccacttcccacaggcaggaggagcaaggtccttgaaaacccatttgggtaaaaatttagaatgatatggggcaaacagtgcaagagaaccaaagacaggggtgaaactacctacaaaggtctatcaacatctaaaaatagacatttaaacaatgaagagtgcaccctataaataaaacatcaggctgggcgctgtggctcatgcctgtaatcccagcatttttggaggccgaggcaggtggatcacctgaggccaggagttcaaaaccagcctggccaacatggcgagacctcatctctattaaaaatacaaaaattagccaggcgtggtggcacatgcctgtaatccctgctactggggaggctgaggcatgagaattgcttgaacctgggatacagaggttgcagtgagccaagattgtgccactgcactccagcctgggtggcagagcaagactctgtctcaaaaaaagaaaatgtcaatgacacattttattcaacttgaagtagtaataatgggtactaaactcttccattttatcaaacctcaatagacagaaacctttcagagccttcctctccactggttctaatggatggtgtggaatgatacacagtgcttggatacagattttatgtgtaacaagagatgttttcctgttcctggttttctaaccaaatatttgactgaccttctggtttccaaatggagacagaaatgtaagatagcttggttatttgacgtacaaaacctttgacctaactgactccatactgtagaattggtatttctcaacttcactaccccgatattcacagtagtccagcctcctattgactgccttcatccagaacacagcccctcccaagagacacaaaagggcagctctgggcatgttaggctcccatcccagacattcttcatgttgattcatctgtgtttctctcctaatagggttgttcagtcacccagtttccttctcgttcctatagtcaacttccaattaaaaggtctccctactaagaattttaaaaattcagtccatgtatggtggctccagcctgtaatcccagcagttttgcggccaaggcctgaagactgcttgagcccaggagttaaagaccagcctagacaatatagcgagataccttctctacaaaattttatatatacatacttttttttgttttttttttttttgacagagtcttgctctgtcgcctagcctggaatgcggtggcacaatcccggcttactgcaacctctgccttctgggttcaagcaattctcctgtctcagcctccctagtagctgggattacaggtgtccgctaccacatctggctaatttttttgttgttgtatttttagtagagacagaattttgccatgttggccaggctagtctcaaactcctgacctcaggtgatctgcctgtctcggcctcccaaagtgctgggattacaggcatgagccactgcatctgacctctacaaaatattttttaaattggctgggcatggtggtgtgcaacctataatcgagaagcatgaggatcgcttgaacccaggagatcgaggctgcagtgagccatgatcgtgccactgaactccagccaggatgacaagcgacaccttgtctcaaaaaaaatagcaattttttaaaccccgcctgatcgttaaattaaataaggcaaacttttcacattaacctttttttttttgaggttctatttccgtgatgtgctgtgtttttgttttactttctctagacagtctaatttctatggactattggaaggaggaggaaaattgtcaggaaaaagtaatacttgagttggttttctatgacgtcactcactgtgtttttaccatgtgtagtatcaaataacagtagcatcaaatgacatgtttacaattgcctttgcaaataactgccgtttctaagttcattactcctcttactattttttatttctaatttgcttggacatttaatgtccaaagtaaaactaactttataatatttggtttttattcaggaataaaatcaggaaggatttaagaaaaatcttcagccaggcatggtggctcatgcctgtaatcccagcactttgggaggctgaggcgggaggatcacgaggtcagcagttcaagaccagcctggccaacatggtgaaaccccatctctactaaaaatacaaaaatcagctgggcgtggtggcacacacctgtaatcccagctactcgggaggctgaggtagaaaagcttgaacaggggaggcagaggttgcagtgagctgagatcccgccacagcactccagcctgggacagagcgagactccatctcaaaaaaaaaaaaaaaaaagaaaaaaaagaaaaaaagaaaaatcttcaaagaacataaaattcattttaatttttaatttttgggcatatataagtaggtgtatatggatattttgatacaggcatgcaatgtgtaataatcacatgatcgaaaatggggtatccacaccctcaaggatttatcctttgtgtttcaaaaaatccagtaatactcttttagttatttttaaatgcacaaattattattgactatagtctttctgttgtgctagcaaacactagattttttttttcaataacatttaaaatacacttcatgaatttgcatgacatccttgctcaggagccatgctaatcttctctgtgtcattccaattttagtatacgtgttactgtgagcatgcaaatgctagctcttattcattctattatttctaactatttctttgtacccattaaccataacccctgtctccccagttctccttcccagcctctggtaaccatcattctattccctatctctatgagttcaatacttttaatttttagctcccacaaataagtgagaaaatatgaaatctgtctttctgtgcctagcttatttcacttaacataatgacctccagttccattcatattcttgcaaatgacaaatgacagggtttcattcttttttattgctgattagtactctgttgtgtatctgtaccacatcttctttatgtgatgaatgatttcattcatcatttgatggacacttaggttgattccaaatatttgctattgtgaatagtgctaggataaacatgggagtgcagctatctcttccatatgcttatatcctttctttaaggtatacacctaccaatggaattgctggatcataaggtagctagctctgtttttagtttttaaggaaccgcccttctgttctccacagtggctatactcatttatatttccaccaacggtgtatgagagttcccttttccccttttcttcacatccttgccagcattcattattgcccgtcttctggataaaagccatttttacttgggtgagatgatacctcattgtagttttcattggcatgtctctgattttcagtggtgttgagcaccttttcatacacctgtttgccatttgtatgtcttcttttgagaaatgtctattgatatcttttgcccattttaaaatcagattagattttttcctacagagttatttgagttccttctgtattctggtgattaaacccttgtgagatggaaagtttgcaaatattttctcccattctgtgggttgtctcttcattttgttgattttttcttttgctgtgtggaaggaagctttttaacttgatgtgatcccatttgtccaaaaaatctttgcttagaccaatgtcctggagtcttcccaatgttttcttttagtagtttcatagtttgaagtcttagatttaggtcattcatccattttcatttgatttggtgaagtgtgttgcttgtaggcaacagatccttgggtcttgctttttatccattcagctattctatgtcttttgattgcagagtttagtctatttacattcaatgttattactgataagtgaggccttactcctgccactttgttatttgttgtctggttgttttgtggtcttctcttccttctgtccttctttcctatcttcctttaaggtgattttctcagttggcacattttaaattcttcctttttattttctgtgtacctgttgtatgttttttagatttgaggttaccatgaggcttgcaaataacatcttataacccattattttaaactgatcacaacttaacatcgattgcataaacaaaaagcaaaaagacaaccaataaaaactctataattttgtctccccactttttaacattttgttgtttctatttatcttactgtactgtctatgccttgaaaagttattattttttatgggttcatcctttcatctttctatttgagatatgtatagtttacacactactattatactgttataatattctgtgtttttctgtgtacttactattaccagtgagttttgtaccttcagatgatttctcattgcttgttaacatccttttctttcagattgaagaactccctttagcatttcttgtaggataggcctggggttgataaatccctcagcttttgtttgtctgggaaggtcttaatttttccttcatgtttggaggatatttttgccagatataccattctagagtgaactctttttttttttttaatgcttcagcactttatgccactctctcctggcctgtacagtttccactgaaaagtctgctgccagacgtgttggagctccatcatatgttatttgtttattttctgttactgcttttaggatcctttctttatccttgacctttgggagttttgttattacatgccttgaggtaatttccttttagttaaatctgcttggtgttctataaccttcttgtacttaaactttgatatcttttgtttgggaagttatcttattatccctttgaataaactttccaccattatctctctctctctacctcctttaaggccaataattcttggatttgcccttctgaagctattttctagatcttgtaggtgggcttcattcttttttattcttttttcttttgtctcctctgactgtgtattttcaaatagtctgtcttcaagctcactaattctttcttctgcttgatcagttctgctactaacagactctgacgcattcttcagtacgtcaattgcattcagcagctcgagaatttctgcctgattctcttaacttacttcaattcctttgttaaatgtatctgataatattctgagttcctcctctgtgttaccttgaatttgagtttcctcaaaacagctattttaagctctctttctgaaaggtcccatatctctgtctctctgggattgacccctggtcaatttatttcatttggtaaggccatgttttcccagatggttttgatgcttgtggatattcatggatgtctaggcactgaagagttaagaatttattgtaggcttcacaatctggagttgtttgtacccatccttcttgggaaggctttccaagtattcaaagggacttggttgttatgatctaagtttgtggacaccacagccgtatctgcattatggggtaccccaagcccagtaacactgtagttcttgcggactcgtagaggtactgccttggtggtcttgtgtaagatccaaaagaactctctggattaccaggcagagactcttgttcttttcctttactttttcccaaacagagttttgctctctgtgctgagatgtgtggagctaggggaagggtgacaaaagcacccctatggccaccaccactggggactgcaggtctgacctgaagccagcacaacactgggtcttgcccaaggcctgtataattatctggcctatgttccctcaaggccctagggctctacaatcatcaagtagtgaagccagctaggcttgtgtcctttccttcaggacagccctgggcccaggtaggtccagagatgctatcagggaaccagggtctggagtcagaaatgttagaaatctactgagtactttattctactgtggctaagctggcaccaaaaccaccaaagtccttcccactcttacctcccacctttccccaagcaggtatctcttcccgtgttctccaccccacaggcccacggggagtgctgccagggcaccaccaatcaaagagcataatatttagattcaataaatacaagcagccattagccagtcaataggcactagaatcaataggtactaaaagaccaagaactcaaaccagcatgtcattttttaaaaatcaactcatctgtttgcatattgataggatatgaccagagctttcaaaataacttgaagtactttatttagaaagacaaacagaaaaaattttaaatgcctaactttttatgaagaaaaaacatcaagaaagaaagaggcttgaccaatcgggtagacagaagagccacttctccctgaagatgagggacttcagaagccacagcagattaaacacattgagcccactggaagctcttttctaaaagcaatcagataatggtacacagaatggctaacagatcagacaggcagttgaagtatttaaatgagagagagagaaaaaaaaaaaacctaagcaaagtgcagaatattgcagaagaaatacagcataaaaaagcaaaggtatcaggactgagagtttaactcttaccacacattaccctctctgagcctcagctttctcttggggagcctcaaaatcctgtgctcaagggattctcctgcctctgcctcctgattagctgggactacaggcacatgtgccaccacactcagctaattaaaaaaatgtttttagaaataggggtcttactatattgcccagctttaccagcttattagaagccagtgggttaagcattgacctttaactttggcttttcatctgctgtcaaaaaatagaactgcctaactacttttatacttcctgtgatacaagatgattgaggaaagacagggaaatgcaaagagagaggtaccaggaatagaacattgttaacagctggcatgccctgactcagggaatggaggggtatttagcctgtggatgctaaggatgtatagaatatttaccaattctcagagtctctaaggccttctgtgagttatccatggtttagacacatgtctggattaaagagttactgttactttcctctgctttcacataaaacttccttaaagctgtgacaacaattctggggtagagggatgaggttttatccagcagttgcattgctttctttctaaaagactttcaaatgcagctaaaacacgtggaggtagtacttccgaatgcatgtgagtgaatatcactttatagtttgcaaaacactttttatataattggttcttagaattacttgattcctggaatcaacattttttccttctgagattgtaagcaaaggtctggctcccacttctgaatccctcattcagctaggcagaattaacacatctttccccttcttccacttgtgctttcttgacctcaggatgacgaggtgcatcactgaacatccagcccccgaccagggacctattcagaagcacgaactgcaggctgtgtcccaccatggatcacattcagcccagactcagctccttctgcaaccctgccaaagagcctacgaatgacggccccatagcccaggccactctattaatgaagaagagtgcactgggacacttgaggagaacctgttttgtctcatgtttttgaagcaagagtaaaaaatggaatgcctcaaaatgctacaatccctctatattcaggtgagggagattcttgtaattctgtgggttatgacatgatatccattaaattataagaactatggataaaattattaatattttcaaaagacaatgttttaggaaatatcccattcaaatcagtaacaagggtaataaaatgccagtaataaacttaagaaatggggaagatggctgggcatggtgtctcacgactgtaatcccagcacttttggaggatcactagagcccaggagttcaagaccagcctgggtaacatggcaaaaccttatctctacaaaataaacaaataaaattagctgggcatgaaggcacacagctgtagttccagctactcaggaggctgagatgggaggattgattgatcccaggaggtggaggttgcagtgagccctgatcatgccactgcattccagcctgggtgacagagcgagaccttgtctcccaaaaagaaaaaaaaaaaaaagtgaaagaattgtgtaaagaaaagcataaagatgaatggaggcccctgaaagaagggctgatggggaaggacaccatgtctgtgggtataaggcatcagttacaaagacgttcaccttctcaaagtgctctagagcacgggttcccaaccccggggccatggacccgtgctggcagtggcctgtcaggaaccgggctgcacagcagcaggtgagtggctggtgagcaagcattaccgcctgagctccgcctcctgtaagatcaaagcagcactagattcccatagaagcacaaagcccattgtgaaccgaatatacgcaggatccaggctgcgcgcttctaatgagaatctaataccgattatctgaggtggaacagttttctcccaaaaccatccccactccacaccccaggctgcagaaaagctgtcttccacgaaaccggtccctggtgccaaaaaggttggggactgctgctctagagggttcatgctactccaaccaaagttccaaagagattttcttatggaactttgacacattgattctaaattttatctggaagagtaaatgagtataaattgccaagaactcacttaaaaaggaatttaattagtaaagtcttgccaaaaataaaaattaaaacatattccgaaactagagtaattatagaatgtggtactagcaactggtttaggaataaagaaaaggatcaaggaaacagaagaggctagaaacatatgatagatatgaatttaacataagataaaggtggcacttcacaacaggagacaaagaatgcaccagtgaataaattatttttaagaccactaaccatgcatttggaaaaaattatacccctcacaccagaaaagtaaatttcgggtgacataaggagctaaaatttaaaaatacaaaaaagttctagagaaaatatgtatgtaattacataatttggggttaaggaagacaatctaggaaaagaaaaacaccctgctgcttatgatccaagacccacgtcattttcaattccacacagctgtaaagcagcggctctcctatcagtttttccactggaatcacctggaaccctggtgaaaaacagattttgaagcctcatcccaaacctgctgaatcacctcctcaggtggttttgatgcctcgccatgttttggaggcctctggtctagggtcaatgccacagtggggaggaggtaagagaatgcaggtggtaaaactaccatagccttgacagcgatgaaaccccccaggtgctagtcacacaaaggcttaccttttgtaaagtcccctgggaactagtttcctatttattcaagtcagctgtattaaataataccctccctaaccaaaaacgccaaaaccacaaaacttcctaagttacatggtgtgttgcagcatggcaaaaatacatcctgatcagtttgcatttggtgttgcatcaaattatggcatagcccacaatgcttaaacatccatcaacagtggctctcaacctaggctgcttttaggaaccatccaggaagctttgaaaagtaatacagttgtgtctgaatccttttggtctaggatggtgcccaagggttgtcatttttaaaaagcactacgggtgaattttagctggataaagaccattggctatatgtcagaaacaacttctgctccttggagttcaatatcattttttttttttttgagatggagtctcactctgttgcccaagctggagggcaatggcacgatcacagttcactgcaacctccggctcccaggttcaagtgattctcctgcctcagcctctcgagcagctgggattacaggcatgcgccaccatgcccggccaattttgtatttttagtagagatggggtttcaccatgttggtcaggctggtttcaaactcctgacctcaggtgatccgcccacctaggcctcccaaagtgctgggattataggcgtgagccaccgcacgcagccgagttcaatatcttaatgagacacaaaagcttaaagggtctaacacaaggcagaacatgatgcatgaggtaagaacatttcaaactaggtgccatggacatatggaagaggaaggtgactatctgggaaggcttgggggtccaggggagggaattttgttgagcctagatctagaaactgatctaagacttggacatgatggaaggacacccaggcaaggggaaaaaaggggatcatttgaaaccttattaatagtaattattaattagtaattatttcattttcctcccataacttcccatataaacatcttaggtatatatgcatatgcctcctatattttttctatttgcaattataattttctaatgattttgtcatactgcatatgaaatggatataattatgtctttagcttctagacaaggctgtgattcctctagctcagggttaaggcagaaaagggtgtctttcctccactcccagtaatgcactattagcaatctaccatataaaaaagggtaaactgaacccactctattcagaaaatttcaactcacaaaccttctttaaattacccagcgagttagggaggaggatgatgagaaatcatcctcatccttgccaagaattttttcaaataagcaaactatcctgcccaaattcagtgaatgcattactaattaatttcgttctgtgatgtctgttctacatgatgatgatataactttctgcaaaacaaaaactgaggcactctacatctgccatccatccctccccaaactaggagatatgaaagtttgaggctgagcaggtcaagcagggatgtgtctgttttcttgaaccatttctaaccttactcaattatttccaactgaagcatttccttaacaggcaacatgcaactctttcaaagacaatctattaaaagactggagagaaatgatatcatttccctaaaatttagtgagccaggacttgaacaggtttgttagaaaaacactaatgcggtaactctattattgcctctaactttagggcgatgtggtagtcagaaaggaggggtggctagaacagagcctcagccacaaccaggttgtggtgcgttacatagtcccaatggtggtatctaaggcattttataattttcttattaattgtcaatacatcaccacttgaatgaaaagagaatggaagctattcttacttcattttttaacaaatgaaactgaagtacagttaagtaatttgttctactcagttccaggaaacaatgtggggaggagggcctccttccctgatcaccaggcaggctcctgcctttcctcagggtggaagagatccactgctgctgtctgctgactcaccttcacactccagctagaggatacactgactcacagtttcattaccttctattcaccatgactgtagtcgtagacactcagaaatgggagttccaagaactgagcaggagaaggaaaagaatgtagatgaaattgaaaaggataaagggtacagcctctatcattgaataaaccagaaaagacacaggagaatgtagtgtctgccctcagagactacatgcattactgagaggaaagtggggagaggaggcctgatccacagctaaccataattccccaatatgaactgccagataaccagggaatgtcgagagtgtacaggaatgtgggaaggccaaagggaaagatggtgaattctgaaaaatataaagaaatgtaaattatctctgatctcaagaggcttacagtctacttgggctgtaagagactgtgtgaaaacagataacaatgcaagatgacatagtttagtcacaaataaataactctatggtaagggccacaatttggagaagggaatgatctccacgagttaaatcagaggcttccaggaaatgagtctttatttgttgttgttgttgtttgtttggttggttggttttttgttttttgtcttttttgagacggagtctcgctctgtcacccaggctggcgtgcagtggcgcgatctcggctcaatgcaagctccgcctcccaggttcacgccattctccagcctcagcctccagagtagctgggactacaggcgtccaccaccacgcccagctaatttttttgtgtatttttagtagacacagggtttcaccgtgttagccaggatggtctcgatctcccgacctcgtgatcggcccacctcggcctcccaaagtgctgggattacaggtgtgagccaccgcacccggccttacttggttttttaaggattcagatgaacaggaaaaaagggaagggaaatctagtcacaggaaatggcctgaccaaggagtgtattctaggcagactataaaacataaacctgagaataagttcattcgttcattcaatcaatatttagtgaaaatccactgtgtacaagcactgtgctaggagctaatagcaggaacaaggcatgtaggctgccctcacggaatttatttgagaaggactactggaaaatagagttggataaatgcaaccagtaattggtttaatttagaccgtaatgcattttggtctttagactgttcccagtaggaactgagagtttttgaggaagagtgacagatgcaaagccgtgttactagaagatgattgcgctgatgctatttctgtgaattaccgggggataagagtgaagaccacttaagaaacgcttataatgttcccagtgtaagacaatgcacatccaaactagggtggccactgtgaaaaggaagggggagtcctgtgaagatatactcacaggacgttggaaatggcaggagcaaggcagggatgggaacaacagacaaagacactactgtctccagcatagatgcctgggggaattctaaaaggaaaaccaggtaggagtaaaaggtaaggtgcagttctccagcgccaggactggagtgttctgaaggctgggctcttttcaatgcccttctctattttcatgctattgatcgtccccattctggatctctttcttcctctctggcctgacaaaatctgttctcaccctctttaggagaaggtttgatagactagttcagagggatcagtaatgggagaaagtatagcatggacagcagccgtggaagaggcaccccgggttgataggttttccaagcatgctgtcggcaacagcctattctgtgcatctccttaaggatagctggactccctccagaattgtccaggagaaaagtttccctcgattccacttggaagaatcgctctttaatttttggttgagcaggataattagagatgattgagtcgcatatctgaaagcttgggatatttggcacgtccctaaccttggaagatgatatcctggagggcggccatcacacttcctctggggaagtgtccctgtgccgtagtgctttgcaatcatctagagaccttgttaaaacacagatctgcaatcaggtgtgggtgggacctgaagttctgcatttctaataatatcccagggatgcccacgctattagtccgtggacccacaacctaaatacgcatgtgtctagaagcaaacagctcctcttctaagcagaccttagattcagatgaccaggagtttaaatcccctctctgccacttttcagatgggtaaccttaaacacggtacctaactcattttcctcatctgtaaaccaaggaaaatactaatatgtactttaaagtagatacaaatgctggatgatatagaagtggtttcttagtaatcgctagttccaatagcagattctcttctattcaacagtgtgttaaactgttaaattcacggaagcatacccagcccccctcaaaggctctaaggtctgcagaaggaattaccaagaaagcaaagcacagaactccctcagaaactggaggagccattgaaaactctttatcaccatgtaatcctgtacaatcacaagcacttccgaaaacagcattatcctgtatttgtctgagtgatttataacgttaagatcgaccacatgatttcctagctctaaatttcccaaactccggtttgcagggaaaggaagcatttcttttctaaggaagtcagcacacctagatctagccaacggcagttgatttttaagtttcttcaaccttcacatttccctttctcaaaagttggatcccacctgcattaaaaactactgtcctagcacattacaaagttattcaatctaaaatgtcttgtttatactaaaattataaaaatgcatttaagccaggtgtagtggtgcgcgcctgtagtcccagctacttgggaggctgaggtaagaggattgcttgaccccaggagtttaaggctgcagtgagctgtgatggcaccactgtactccagcctgggtgacagatagagaccctgtctcaaaaaaaaaaaaaaaaagaaaagaaaagaaaagaaaagaaaaaaaagaaaaaaaaatccatttacaacacgaaccagaatagtcttatactggattctttgtcaaaggtgaagaaacaggccaggtgcggtggctcacacctgtaatctcagcactttgggaggctgaggcgggtggattacctgaggtcaggagttcaagaccatctggctaacatggagaaaccccgtttctactaaaaatacaaaaaaatagccgggtgtggtggcgcacgcctgtaatcccagctactcggaaggctgaggcagaagaatcacttgaacccaggaggtggaggatgcagtgagctgaaatcatgccattgcaccccagcttgagcaacaagagcaaaactccgtctcaaaaaaaaaaaaaaacaaagaaagaaaaaaacgcaaaggtaaagaaacctctacattttgaaaagcaaaccacagctctgtaaaagcgaaatttttgtcctgttaaatatcaccattcccttgtacacattaatcttttaactcccaaaacctaaagcatgtgaacataaataggctccaaaataatctagagtttgtgtgtacagatagaaaaaatgtgcatattttatttttaaaattactctcactttctctaccacacactaagaaaaacccccatttggagaaagccacacccttcactaacggctcgatcaacctttcaaaacaacatgaagggcaaacattaagagccattcaaaaccaagggaaatgacaatacagttgaaaaaagttctctgaatgtaaatgaagctactggaatttgtggggagcagaataaacaaaacaattaagccattagcctgtctcctttgagaccgtcctggcctttggaggagagcaataccagattcctctagcacaggtggatggcacgttggcttaaggaaaaacaaaggcagcaaatcctcgtctttaaaccagaacagacacaaccttggtcaggaaatttcacattctgaaagtccgtatcacctaacaaggaaaaccttcttatcctggccatgaatctagcagtgatctttcatatcagcaaaagcagcctaaccactcccccacaaacgtcagaaaagccctcgcttggggtcacaggcctgggtgtcctcaggtggcagaactcgaacagactgctgcctccatgccaggtgggcacctggcatgtgaacctaaatgtgataataaatatcaggctccaaaatggtgcccaggtgggcaccattgcaatggctctttgttcggagttgggagcttttgaacggatagtggtgaatttggtttccattttgacctggaaagagtagctccaccccttgtggggacaggtcaggactggttgtgtgatctcaggtaattataattacctagcctctcaattgaaggggcgttagtaggaaaggagtgagaaacaggtagaaaccttcccagcctaccagcttccctccacagctaccccctcctgcaggagccccaccgaaccactaatatcctgttctgtgaaaagaaaactcaaaaggaagccctagtggttttatctgagggggctacttttatctttgaaaactatttccagtttacaattagttgtctcctttaatccgctggctctcatcaatcactcattcactggcggctgccttgctgccaccaagttgaattggagggttttcagtcctctgggcacttttggtctagtggggaacagttgttcaattcagcaaagttgccaattctaccccatgccagaaatacaaacacaaaccatgagcatgacagtgtccctctccgtcgtgactttccaaccaaggaggatggaataataaatattaaaaatatcactcaaaaacttccaattggcaggagggccccaatttaccttgcctgtctcaactcctccattccttgtctacaagccactggcaattcctccttccaaatgttctaactggtggtgatctacatatctttccagatactacaggttacctactcctgccactcacgtgggaggctatttcttttacccttctgtagagcttaggatacttcacccagccacctggagctggaaatggactctaaaaagctcaaaaagtgcaaatctgccaatttttcacttgagttccagaacaaagattttatgcgcacagtttgaccctgccagtcttagtttcactaagcattttaaacatccaaattcaacctgtccttcaaaaccacatgcaattttaaaaagcaaattgtctaatgcgcaatcccatggcaattctttcgattcctttttccatctcttgtatttgcctatttcttttttttttgagacaggctctgactctgtcacccaggctggagtacagtggcatgatcagggctcacggcagcctcaacctgccaggatcaagcaatcttcccacctcagcctcccaagtagctggaactacaggcacacaccacgatgtctggctaattttcgtttatttttttgtagagacggggtctcacaatgttgcccaggctggtttcgaatgcctgggctcaagcaatccacctgcctaggcctcccaaagtgctgggattataagtgtgagccaccacgctcagcatatttgcctatttcttaggcatctacacttgtgaaaatcactggcaacatatacaacagattctgttttctaggagaactaccttttgttaaacagttgcacggggaaggcgtttgccccattttcaacattatagctgctgctgagtgaagaaaggcatcatgactgcagattgctttctactgccttccagggacaagccacctggctttcaggtgcccttttaagtgtctttttatcacctgtctcctctctgtcctcaccattccatctttccgaagggcaagcacaacggagtggggagtgacacacatcagacaaggttccaacgaaaatgaaaggcttgcgacattcaaatcacagggtgctttcacctattcattcactcctgttcattctatcagctgagtacccacgagcagcagttttttggagtagattttaagaatgctccaccttgtaggcagttctgcatcctacttttgtccctcaaggaaaagacctgggggtagttttaaagattgtatactgatgcataacaaaaagaaatacaaacatttttcccattaagttttttggggttttttgttgttgtttttcctgaaacagggtctctctctgcaatctcggctcactgcaccctctgcctcccgggctccagcaatcctcccacataagcctcccaagtagctgggactacaagtgtgtaacaccacaaccggctattttctgtattggcaggtctttgccatgttgcccagactggtcctgaactcctaagctcaagggatctgcctcccttggcctcttaaagtgctgggattacaggcgttgcaccactgtgccctgcctcctgttaagtttttttttttgtttgtttgtttgtttttggttttttttttttgagatggagtttcactcttgctgcctaggctggagtgcaatggcacgatctcggctcactgcaacctccacctcccgggttcaagcaattctcctgcctcagcctctcaagtagctgggattacaggcgcccaccaccacacccagctaattcttgtattttcagtagagatgaggtttcgccctgttgaccaggctggtcttgaactcctgacctcaggtgatccacccacctcagcctctcaaagtgctgggattacaggtgtgagccaccgtgcctggtcctctcattaagttttaaaatagtatcatatactcaagtattggaagtcaagaaacaacgaggggaggtgggaatggggagaggagaggctgggatacaaagctgaacgagaaaggattctacctgaaaagtaactgatcagaaggaaagacaaaatgcacattagcaattataagatctttatagataaagtgctcatgagattttgaagaaggagataactttttttttttttttttgagacgagtctcactctgtcgcccaggctggagagcagtggtgcaatcttggctcactgcaacctccgcctcccgggttcaagcagttctcttgtctcagcctcccgagtagctaggattacaggtgcctaccaccacgcctggctatttttgttgttgttgttgttgttgttgttttgtatttttagtagagacagggtttcaccatgttggccaggatggtctgaaactcctgacctcaggtgatccacctaccttggcctcccaaagtgctgggattacaggcgtgagccaccataccttgccaaggaggtaattttcaatgatgaggctcaagaaggcagagttaaggctggtttaaaagaagaattagactgacgggatggagagggggaggaattgattccagccagacacaagctgaagatggagaacatctaagcctgaaagggaaacaccaagtggatgaatttggtcagctgatataggtgagtgtagccacactgcagaggtggaatcacaggacttggcaagtggtagaatgtcacaattcactacatcttaattggagcatataaaattcacttttgtcaactgacacttaaatacaactgctgcaaaaaactgaagactcttgactcatagccccaaacaaagaggatgatgtctccttgtctccatagagcagacaatgcttgccacattgtcctccatgcttgcttggagagttgctaagcagggctggaccaaggagtatcaagagagccttagggaagaggaggaggaggacaaaaaggagaaagaggaagaggaggatgaggaggaagaggaggatgaggaggaggagagagctccctttggtttactggccttacttatgtttcctcacttctcagcaggtgcaaactatgtctcctgccttctccagctctcctcatcctttccaagtccagatgaatgcttcaaggagaggatggacaagaggccttgtggggaaagaaaaggacactagttggaagatgggtttggggtgtgagggtgtgtgagagaaagagctagaaggaaaaggccatcccagtttttctacaccccaagccctagttctagatcatagaaacaaagcacagaaatctgctccagagtccagatattaaggcccagcaatttcttatgtcaactattaaatactaattttctaattaatatcaatgtatcctcaccaggaaaatgggttttcaattatttatataaagtaaaaactttatgtccctgacatatttatttggagtctgtattgaatgcatttctctttgtgatcacagaaaaatttaccactttgaacctctcttctaatacaccattatgtttgattttcaaacatttccagtaaaagcaggtttacgaccataattcctgaactgtgggttaagagacttgtattctagggacaactctgctattaacttgccaagtaactgagagacctaggtcaggccaccacagttccctggaccttaaagggtcacttggggagaccatgaaccacattggggatttatgaatctttttcccaggaaaaaattcacttaagaatgaatatggacacaaacaatttcatagactaccctggaagtggtctccaggatacttctcatcttgacattctatatttaaagctatttggtcactgaaagaaacaaggttgggcacagtagctgtcacctataatcccagcattttgggccaccaaggcaggagaatcgctggagaccaggagttctagactagcctgagcaacaaagtgagaccctgtaaaatatatatatattttacatacatatatatatatatgtatgtgtatatatatataatatatatatatatttttttttttaattagctaggcatggcagctcatgcctgtagtcccagatactcaagaggctgagatgggaggctctcttgagcctaggaggttgaggctacagtgagacaagatcacaccactgcacttcagcctggatggcagagcaagaccctgtcaaaaaagaaagaggctgcatgcggtggctcacacctgtaatcccagcactttgggaggctgagataggaggatcacttgaggccaggagtttgagaccagcctgggcaacacagcaagacctcatctctaaaaagaggaagaggggaagggaggcagggagggagggatattattttccatagccattaccatgatacatatgatactgcctaggtagagctgggactgtagggtggggaaccaatgctgtcctgcacactgagactatgaatgccaagatatcactgccagatccttctgtggatgaggctgggccaagcttgaagaagtcccctcagtggctggagatgcctacagcgttctataaaacaaagccactcctattaaaacttaaagggaagctatttgctttggttctctgagtatatctcttctttcagtccaatgagcagttagtgtctagctttgctctatgtgaaagccaatataatatggagatatttatggatgaaatggtatgctatctaggatttgcttctaaagaaaccaggggaagataagaacagtgaaatcaagattggtcatgagttgtcaacggctgaagttgagggatttgttttctctccaacttacttatttttacatttttgattgaaagacagaacagaaagtcaaagtgaaagatcaggaggtcaaggaatttttcacgtcctgtacaagtcctgggcacgaagctaaactaatcctactcgattcacgtcttgacgagcccacagatagcaaaatctgtggctcacagaatatggaattgacacagggttattttgagaaccatcttacagtccaaaagacatgactttcaaccaaggggaaaaaaaaaagaatttttgtctgtgtgtggaatgtctttcttcacatggacagctcagaggtgggcgaaaatgcagaattgggcagcaagaagtattgtccccaccttggaaggcctgcattcccctttctgtccagcaggccatcgagcccagcatggtttggcatgattcattgctctctaactttggacttaatgtaaaatgtttgttattcttgtaaagcaccctttagcagatagaaaatgattttccttcttgttgttagcttctgtttttgccctttttttcccccaacaaaagacagcagttttagaatgagactgagcctcatcactacaaaaggacttcagctccgattcctcatgccttgcttgggaaagcagcagcagacagagcaggagccatgctggcttctgtcaaacaaaggggttcaggggatcagccagagaaaactggagctaccactcaatctattcctgcctccaagtattcccgcaatgtaggaaagttgacagaaaaggttgagggtagggaactgaatctgagcctttgggcagtcctcttccacagtgactctggacttgacagtgtgacttgcttcagccaatggggataatagcaagcatgacgcaagcaagggttgaaaaatgtgtgtgccctggagcttgtacccttgcttttcttgggaaccctgtggtgtgaccactactatgtaaacaagccagagctagactgttgtgacaagagacacatggccaagccatcccatggccccagctgagactggaccaactaccagacatgtgagtgaggccaccctagatcatccattcccagccaagccactagctgaccacagtgattgaatgaaccagctgagaccagaactgccacgccagtgcacaaaatcataagaaagtataaacatttattatttaagttactgagtttgggtgattggtcacaccaaaagctaacacaagaaaaggtggctaagcagagctaagatgtattgaacattgggagacatatcccctaatggctctttacacaatagtcagtgggactcactattgatgcgactgtatgtcaactgtcattgaaataacctgacatagatccaaaattgaccatactccctaatactcatttcaagacaatgttagttgtaattcttggaatgctactgtatgggcttcaggggtttataaacctcctgaagttaaatgaagaattatatgtattttttcatctgaactgagaaaagatgttaaaactacagaggataacaaagaaatatatatgtacaactgcctagaattaataatatctcatcatatttgctttggatttttctatatgtaaagcaaataaaacattactgactcagtcgtctccctttcctctttcccccttcagtattttgaacttggtgtggatctttctagtctgtggatttttttaattaatttattaattaatttatttattttttgagatggagtctggctgtatcgcccaggctggagtacagtggaatgatctcagcttactgcaacctcctcctcctgggttcaaacgattctcctgcctcagcctcccgagtagctgggattacgggcgtctaccaccacgccaggctaatttttgtatttttaatagagatggggtttcgctatgttggctaggctggtctcgaactcctgacctcaggtgatccacccgcctcggccttccaaagtgctaggattacaagcatgagccaccacgcccagcctatattttttaaaataatatccacacaaatacatatatgtacacatacacaaataaatgtatagacccccaaatagcagtcttattttgtgtttttgacatttttcttacatggtttcagatatgcgtctttctacaacttgcttctttaccaaacactacccttgtgacacctatgcatattgataccatattatcaaacaagccacatgtatttctcttccaatgaacatttagattgttcctgttttgtttgttctcgtgatctgcggaatgtttatttgttattataaacactgtcagggaaaaggtcagtagcttccaacatattctcagaggactcaggacattctcccatccaaatgttaggaatctctgataatctgatgtggagaaagggcactgtcatcattttgcattgatgcatatttctgcattacagcattcccaagccttgaaggaagctatctttacttacattcttaaaatagcttattagattcttctgcatttaaatctaaaattttctataaggtctgcatcttcctaggacaccaaaaacagccctattattttttcattgaaaatttcttagaatcagataatactgtccaaaatattctgtgaccatgtaatgttatcctaaattgctgtcaacatcaaatggtggtcacaccgaagaaattattaggagactaacaatgtgatattctaattttgttgttgtattctgtaatgtatttaagaattaaacaactaaatctctgttgttctcacattttcctattttctattttttttaatcctagttaagattagagagccttctagtatgactttctttttttttttttttttgagacggagtctcgctgtgtcacccaggctggaatgcagtggcacgatctcggctcactgcaagctccgcctcccaggctcacgccattctcccacctcagcctcctgagtagctgggactactggtgcccaccaccatgcctggctaattttttttgcattgttagtagagacggggtttcaccatgttagccaggatggtctcgatctcctgacctcgtgatccacccgcctcggcctcccaaggtgctgggattacaggcgtgagccaccatgcccggccagtattactttcttttacttttatgcttgctctcactatgacatcttctagtctctatggcaaagtcccaaagcaaggaaattaaaactcagaacactactactcataacagacaatgttcttaagtctaaattatcccctctggtattactgaataaaatcaaccaaaattggtgattttctatcagccttaccttccctcaggagtatgtgaaataatgaaaaagtatacaaatacgtggactcggcattgtcaaatttagaaataatttattgaaccacttttcaaagagcatggacttagcagatctggctggtcacatacaaattgtgtggccctaagtaattcccctcccctcactacactttgattttcttacctgtaaaatggcaataaaaaccaacactggtgctagaatgaaatgaaatcatgtatatggaagccttttgttatcatttctccactatatggggagcttctcataagcagaggcagagagactaattcatctttttggagacggaatcttgctctgtcgcccagactggagtgcagtggcaagatcttggttcaccacaacctctgcctcccatttcaagcgattctcctgcctcagcctcccgagtagctgggattacaggtgcccgccaccccacccagctaatttttttgtatttttagtagagacgggggttttgacatgttggccaggctggtctcgaactcctgacctcaagtgatctgccctcctcggcctcccaaagtgctgggataacaggcctgagccaccatgcccagctctaattcaccaagcctgtatgctaacctcctttgccatggcaatgtcttctctccactttgaggttcaaagctctccatctccatccactcccgttctctggtaagaccactcatatttgccaaggaagacctagaggtctgagtacccactggtgtcacatatttgagtgtcaacgccagaatccagggggagcaccaatggtaggtacctttgggctagaacctgggaatgtggagtatgcatcccaagctcacccaaagagggggcttcttatctcaggagccaaagattaagcagcccattactgaccacagcggttctagtgggtggaaggaggaactctcccctgtacacacttctggaggaagtctccatacagttatgacacacagtgagtaatccggctacatgggattataatactgccaccaaaatataacaaatatgcttatcaagaaaaaggatttgtaaaacaagtggaaaaataacagaacacaaattgtatatttgccccataattacaaccacataaaaacaatgtgtttgaggcccggtgtggtggctcatgcctataatcccagcactttgggaggtcaaggtgggtcacttgaggccaggagttcaagaccagcctggccaacatggtgaaaccctgtccctactaaaaataaaacagttggccgggcatggtagtgtgtacctataatcccagctactcaggaggttgaggcaggagaatcgcttgaaactgggaggcagaaggaggttacagtgagccgagattatgccactgcactccagcctgggcgacagagtgagactccatctcaagaaaaacaaacaaacaaagaaacaatgcatttgaacagactgaaaggaaacccagagacaaaaataattactgtgttagggtgtgggggtactttgggtgaattattctaaatttctttttctttttttttttcttttttgagatgtgccccaggctgtagtgcaatggtgtgatctcggctcactgcaacctcggcctcccaggttcaagcagttctcctgcctcagcctcccaagtagctgagattacaggtgcctgccaccacactcggctaattttttatttttagtagagacagggtttcaccatgttggccaggctggtctcggacttctgacctcaggtgatccctccacctcagccttccaaagtgctgggattacgggcgttagccaccgcgcccggctgaattcttctaaatttcttataatgaagttagtacagtaaccttccacctacaagcagactttcttgaaaagtcccagaaagaaaactatctggtcacgtccagactcttaaagaattattcccaccactgtttggtaagaaaaaccttattagactgggatctaataaggttagatctgcactggatcagatctaacttggattctggcaccagctcagctaaaaactagctatgagactttggaagtaatttaacctctctagatctctctgtgaagttaacaaatggatttaggatagaatttttaagctctcttctgggctttctacaatgtagcctatgttttactttctataatgtaacgtatgaccataaagtgctataaatgaatttgtaacaaacattatcagagctcaaaagacccaagagagtgtgcctccttcagagcagttcttatacttattccaggaaaaagggacctgctggatactgcatatctttagtggggctaattgttccgcctttgaggcacaatgtaacttctggaaacacctgagagggatgtaatacaaagtctggtgagtaataggaatgatcacactgggcactaaggagttaaaaaataaaaaataaggccctccctccttccctcttcttcccttctttctctcttttgagacagagtttcactcttgttgcccaggctggagtgcaatggcgtgatctaggctcactgcaacctccgcctcccaagttcaagtgattctctctgcctcagcctcccaagtagctgcgattacaggcatgcaccaccacacctggctacttttgtatttttagtagagacggggtttcaccaggttggccaagctggtctcaaactcctgacctcaggtgatctgcccacctcggccccccaaagtgctgggattacaggcgtgaaccacagggcccagccctgtctctttcttttttttctctctctctctttctctctctctctctcactctcacccaggctgcagtgccacagttacagctcactgcatacttgaactcctcagttcaagaaatcctcccacctcagcctcccaagtagctgggactatagtgcatgacaccacacgtggctaatttttaaaattttttttggtaaaggcctgaacgaccacacccggcaaaaaaataggttttattacatagctcataaatgaccattcaaaagtgctttgaacaacggcaatgacgtcattctcatggtggtaactcagaagggcgggccaacttcattcacatgtacagtttgagttctatgggttgtcaaagttcatgtcactatgttagggctggcttttacagttgtacttctcttaagtgtggctgtcccaaagatatatgaaaaaaatactttgctaggatgccccaaaaccttttgtctctgccaacataaattctgaaactgaaattcaaaacacaatttgtttaccactattacagaatgtgcttataaggctgagatgtttattttaatacctttggcatttaacctttaacctcttatttactttgtaaatatttcagcatggtgagaaaaagaaaaaaaaagtttttaaaaactcaccattaagaaacattttaatcacagattggtaaaaacacaagttgctgcattttcgcaaaaaaaaaaaaaaaaaaaaaaaaagagatgactcaaacttggaaaaccatgactgtacataattcctatatatcctaccatgaagcttataataccttgcacttacacagaagatttaaaatatttctgcttgttgaagcagataaaaagagatttctcaaattcctaatgaataataaggccccacacttggctcatgaggaaacgcaaggtactatatgttctttcactgagtctcacaggggctcatcacatgcccacactaggcacagaggcaaaatgttgtattctaagttatcagaatgcacgccgctgctcattatctaaccctcaggaaaacgcctgagacagaccgccaattcatgagattcaactgaaaaaggagtgaaaaacaagaagtccatcatgtgacattggaggccatggcattttcagtggaggaaggagttgaagggttgaagagaaaagctcaatttgcagcctcaccactcgtggaaccatcctacacaggtgttgagatagcgccaaacagtagcagctggatgcagattttccctgttataatagcttagagaatgcataggctgaaaataccaggctattccctctctttagggagacccagtaggaaggtgtggatgtatggataaatactgaatgccactactgggtatgcagtgaacgtttagacattcttcctggtgagtgaatgagaagaatcactgtggttcacagaaggacaccatgttaagacttacaataaagtggctgcaaacagctaatctgcagctgtgtttggcccctctgagatgatcaaatcacatataaaaattggcagaggccgggcgtggtggctcacgtctataatcccagaactttgggaggctgaggcgggcagatcacctgaggtcaggagtttgagaccagcctggccaacatggtaaaaccctgtctctactaaaaatacaaaaattaggcgggtgtggtggtggggcctgtaatcccagctactcagggggctgaggcaggagaattgcttgaacctgggaggcagaggttatagtgaaccgagatcgcgccagtgcactccagcctgggcgacaagagcaaaactctgtctcaaaataaataaaaataagaactggcagatatagcataaaaatctagatttctagtttctcttgaaaaacaagataatttggtaatatggtcgatataaccatggcctagaatcaagtagtggtgcctcctagaatggcacatatattccatatttactctctagaggccagcctccctccaccaaattataagacatttaagtttgcaaccactggccgggcacagtggctcatgcctgtaatcactttgggaggccgaggcaggaggatcacgaggtcaggactttgagaccagcctggccaacatagtggaaccccgtctccactaaaaaatacaaaatattagctgggcattgtggcaggcacctgtaatcccagcactttgggaggccgaggcaggaggatcacgaggtcaggactttgagaccagcctggccaacatagtggaaccccgtctccactaaaaaatacaaaatattagctgggcgttgtggcaggcacctgtaatcccagctgcttgggaggctgaggcaggagaatcgtttgaaaccgggaggcggaggttgcagtgagttgagatcgcgccagtgcactccagcccgggcgacagtgagagactccaactcaaaaaaaaaaagtttgcaaccactgacaagactgtagtcctcagcaaaagtgtggtggaggtgactttcaacttcagtaaatgtctgcttcttatacttctccatccctctccatccactgctccacccattttctctccaaggagatgcctgggctgtcaaatatttcccactaggatggcccactcacacttgtccctagataatgtcccggactctaggtatttccccaacgctttgcctccatcaaaactttttttgtgcttgatcccattcctttctggttttgttttgttgtattgtgttgttttgactaggagactactagcaatctgataaactaatctgtggaaatcaagtaggttaccttcccaggaaacatttgaaatgtattccagactttctaaatacatgccatgccatcacctaaaggaacttacctaccttatcatcagctatccatcagatttctaggttgtaaatctattcctgggtattcttatgtgtcatatctataatttcctcacaagtatatgcaagtaaggaaaagggaacagctcttgaacatgttttgaggtgatggtcaattcagatttgctcaaatatttctgtatatttaatgcacagaaaccttgcataaaaatcaatcacaatttctggatccaaagcacatagcggacctacagccatgggtttcagtctatcagagagtccaaactggtcatggccacaaaagcagaacttcctttgcagatgatgataagcccagattctacgaaggaagccttagatgggtattacggttaaagtcaacagagatttttttgtactctgctaaacaacctccactaaattataaagatgtgcagggttttttttaacttcttcaagtctccttaggaaaaagacacaagtaactattgcctggtagtgttcctagttttctcaagatagaaaagtgtcccaaagtgagttttcaggaggaagatagaaggtgaactacaagctgtacactgtgttcatgagtcagaaaatgaaaatggctattttccttatgagtcacaactgaatgagtcttagtagggcctcaggtacagatggagagccctcctactatgctaccagacttcctaaaagacacacgcacacacacacactcacacagaagaagtccacggtataggtgttctccctatagcccagccaagggccttctttttcttcttcttcttcttaatattttttaactgaaacagggtctcactatgttacccaggatggtcttgaactcctgggctcaagtattcctcctgcctcagcctcccaaagtgctgggattacaggcgtgagccactgcgcctggccgccaagggccttctgatgaattttagcctccatgctaatcttcagccacacccaaagaaggtaatgtcctttcccttcctgttctaagcagctgaagggatacaacttgggcaggcctgggcagatgtggaacacaaaatgaagtatcatttggcttgacagagtctgacataaacattaaatattgtaacttgggtttctgattatttaagatgatgctctattctaaggcaacttcacatacataatgaacaatttttcaagtcaggaaagaaatgattaactttggccaaatcactctggatccagtagatctatcaatggcacatctcctgtttcaggacagccagctgtttcaacttttccatcagtgaattgtgacttcagcaaccatatctgatgcacagatagtcgcctgggggcacacaacatgcccatctgtgctgatggcagggagcccatcaatagggaagtcacacactgtcctcagatagaaccacctcttccctacagcatgccttcttcgcatgcatttgaccaaccctctacttcatctgcaatggggctgaattaagcatggtatcacaggtttcggaaaaggcaacctagagtatatttcagtccattcagcatgaaaaatgagtttaactgaggggaagttaatttcctcaaggtaccactcaagtacttaaattcagtaagattctttaagttcttgacataaacacattgatttttttaagaaatattgacccacggaaaatgattacagcaattctcaagtaccaggactatcacactgcttcaagggaccaggtgcccagtgaggtagcttcacccaaacacatgcccaatgggaatggttctctgctggggtgagggaaggggtccaaaagtaacgtagagtagactgacttcttaaaccttaaaactagaagaggaaatgtatagacaaagtgttctcttagatggggcaaaagtgacttaattttggactatgtaaaaagaaaaggctttggccgaggatgccttgaaaggtttctcgttgatgtttgtttgtaatcattctttggaataaacagcacggggcaagggggcttctgagctttgtgtgcaggtttcgatgggcctctgctgcacttccctcaggctgctcaccgggatatcgattttttaattagtgttgtgctggttatcattttgacttggcttctcttccacagccattagaaaacaacagcaaaccagaagaggacgagataatccacctaagcaggactacttgaaaagaagcaagtgtggaaactatgaagccttgtaatagatttttttttttttgatgaactgccgatctcttcaaaatagagtccttgctttcgtgccccgcaaagaaaagtacaccacgccaaagcccaagggaggtggctaaggttatacagggagggaggggagtgtagctggactggggagttggaatagcagaaaagtcacaagtcaaagaggcggccccttccacacattcccaaagtgccaaagggaaaacagcaacaaactcgaaactcgcgagggcgtcttcccgtgcgaagcgtcccctggatccccgaaaagccccgatcccctcgcgcttgggaaggggtggggtcctcttcaggaggtgtttacttggcgtccggggcgcggagaccctcggggccggcgcccggcacaggtccggggcggcgtggttgccgcccgcgcccgagtctccctggctcttgacagcccgccggccgccaggtgctcgccctacctggcgcccccgcctgcctttgtgcggcccgcgccgcccctcgccaaggcgggccagggaccgcccccgcccgcgtgccgctgccaggcgggacagctgcgggcgctgccgggcagcggagcggcggcggggaggagagggagtcggcgcgagggtgcccggggcggggcgggcacggccgcggggagggcaggggacgccgccagcggctgcggcgcgagtctccgagcacctcccctgccggctgcgccccccacgtcccagcaggaggaggggaccccctcccgcgccgtgcccctcgcagccgatgcgcccacaccctggcttccgacagctggcagccatagcaacccggccacagaaagtttcgcgacgcagaaaccgacttggaataaagttttccttggcccctcgctcgctctcccccggcccgggtttacggaaagcggcaggaaatcagagctcgcgacgtgccggctcccgcgtccaccttctccacccctggccccggcagcgcgcccaaggtgggtgcaccacgccggggtttcctgccccgtccccgggtccggcgtcctaggacgcggcgcggccaactcaccatggtgactcgcgccgcggtcgcgtcttcgccgggtcccgctgccggggaactggggctggaacgcagtcttctgggcgaacttcaaaagttggttcccctcgccaaaaacaggctcccgacacccaagcactcacaggagccaatgggaacccagaggggactccatccaggcgggattggcggtgctaggtgagggcgagacggcggcgacttagcaggcggggcgcatgctgcggagggcaagagtccactcgtactcgccggtcgccgccggcccaggtgagtccgatgcgctcggagcgtccgcctcgctcccctgcctcactcctctttcttcggccacttaatccgtactcctctggctgagtctcg

SEQ ID NO: 1457 - DNA, 979320 bp, Homo sapiens
atggatgtaaaggaccggcgacaccgctctttgaccagaggacgctgtggcaaagagtgtcgctacacaagctcctctctggacagtgaggactgccgcgtgcccacacagaaatcctacagctccagtgagactctgaaggcctatgaccatgacagcaggatgcactatggaaaccgagtcacagacctcatccaccgggagtcagatgagtttcctagacaaggtttgtagggtttcccctgctgatttgctctcaactgtctaacttacttgatttacatggttgatggctgcttttggagatccagcatggtggtttttgacagatgtaccctacagcagacccttggttccataaaggacattcctaacaacatggtgaatctctatcctgagaaacctaagattatctgtggtttctcaaaactattctcctcatagtccacttacaagcctcaaatttctattccttttcccattgggtttctcacttagattctccttgaacaaatggtgtatcttggttaaaacatctttgaaatagtgtataataatacgcccttttccctctactaaaatatgatgttaattctgagttatacgtttctctttttgtgtttcagagcatgggtggccacatgtatgttattttccaattccactgatgtaattatccctcctactttccccaagtcttaattttcctttccttatactgttttgatttcttttgggaggagaatatttttctcccaagcactaacagttggcactctcttcatgtccaatatttataaagagttctgttatcacttctccagggttgctgtaaatgcatcaacacgtagaataaagcaaagcagtgctgagaggtggtgtgacaaagctcactctctagctccatgtcttactagtcccagcctcgctgtgtgtgcactttacattgatggctcagcaaaattacaggcaaacgcacaaaactgtaccgaatgcctcgggaagggtcactctgccagtgccaaagggctaagccctgctctgctaggttattgcctcatttgttttataacactgattctttatttcttgttccatgtccttgggagtaaatgttgcaatgggtttaatttctaatgaaataacttagcttggaattctagtcctggtttctcagcttccttaaactactttttactactttttattacaaaatgtgcatgtgtgtatatatgttattaattagcactatgcccacggtttataaatctacaatccagaggttgttgtagataacatctttttatacactcctggtttaccctagcttcagcttttatatttaacataggattgaaaaaataaatcaacagagaaactgttagaattgtgtttccattgccattataactcttgcaggatacaatttttatttaatcttccttcttattttctgagttatcttcatgtaaatgaaacacatgctgatcctcctccatgagaaaatgggggcagaggctgcttgaaaattgctctggatcaaatgcctttgatctgtaacttcaacaagtgtttttgctttgttaagtcctcaccattccccaaatttcaggtagtggcaattggaaaaaaaatatgaagaatcatggcttaattaactgagagagagcttacatttccaatataataaaattgggacacctctctgttgtttcccagagctgcactaacacgagactcagatattttgaaaggtgatgcacgttcaacgtggttcaaagcctttcattttctgctgtagtttttgtctcatttacgttgttcctgcatacgtttttgtgtctcataattctgtgctgaaatgttcacttttcttcctaagttttattaaaagtgcatcctggcttctggatcattgtgcactgacatgtagattccagatgattgttgaattgtagataggcctgtcaccttttcctttattaatatttacataaaataaaaccaaggactgggattttattttcaaatatacctttattcttcctgtttagtcttgttcccctccattgataataatggaggttgcttggccatatcaaactcatagctttgcaattaacaattcacacatgccgcatgttgttattgagcccatatttgtttgtgtaatgtgtttgcatgaattaaaaactgtgcaggccaaaagtagaaataaaaagcatcagaaggtatttgcatatgcaagtgcaattccttctgaagacatctatgaatttatgcatgaaaatgtagtcagagtctgagtggatctactttgatgggttctaaaattgaactctgcaggaagtaaataagcacatatttaaggagaggaggaacaggagatacaatctggcaagcagtacattcaacttgaaacttagccactacagacagggttaaaataaattttacactcagtaataacaataatttttttaaatgtcatgcatttcccattttattttcttattcatgaaatcaaagagcaggatcatctccgtacttattagcctagaggtacattaacaaggatcatagtgggatcatctcttgcagtattcttatttaaaacccaagacactgatcataaaacaaacacacttctcacatacaaccaagttttgcaaacacagttggatgactctacagatgctcagggtggaaaagaattgccagccagcaaaagtgatgggggcccagagtcagaccttgtccagttaccccagctggcccattcaagtatcaaatgcaagaacctgccatctcccagcaggagaaatgagccaggtgttcccatgagaagtttacggaagctcggtcaaattgtgcccatctttgcttgctttcaacacagaatcctcctctgccttcttctattgtggcttcttctcttgagtatgcaaatcacctgtctggcctctattatgctggatcctcctggtgtgaaagaagaaaattgctgaccttcggtctgtggccactggagtaattagtaattagtaaatgactaatcctgcactaaatagcatcctagtggtctgagagctaatgcacctgacaaaagtgagcagtggtctgatccctggtcagacccagccctaatccaacctgtgaaatagatgccactttgaataatgaaggtcggccaagttcccaggcagtttgtacaagcttgtctttttttttggaccccggagttagggtgaagagcaatgtgatatacaagacattctcctggggcttaggagtctagagttggacgtgaattctgcttttgcatgtgtatgtgcctgggactctgctctgcattctgtgtttcatcaggattactacatggtttttaggtatattaaacaaacaacaataataacaatgacaaaggaataatggcgaacaggcgggcgcggtggctcacacctgtaatcccagcactttgggaggccgaggtgggcggatcacgaggtcaagagatggagaccatcctggctaacacggtgaaacgctatctctactaaaaatacaaaaaattagtcgggcgcggtggcgggcgcctgtagtcccagctactcagcaggctgaggcaggggaatggcgtgaacctgggaggcggagcttgcagtgagcggagatcgcgccactgcactccagcctgggcgacagagcgagactccgtctcaaaaaaaaaaaaaaaagaaaaagaaaagaataatggcgaacatttgttgagtagtttgtgtcaggagccaatctaagcattttgcttgcattaactcagttaatgctcacaacagctttgcgaggtggatactatcactcccttgtttacttatattaggaaactgagtcagagagagattaaataagtcatccaggttgaaaacatggaaagagccggagataggcttcaaacctaaggggctgtattcaagacctgtgttttaaaccaatgtgtttcatcacgtcccaaaaaaataagtaaacaaaacaaaaatatctttaaatccttagtcaaaggctgggaaggatctatgaaattcactttctaagccttttaagaatccatacctttaaatctttcttaatgatacaggaactgtagttaacagtattgattgaacatataatgttcaccaccagctcccagccctgctgatctaattcctgttctcatccattcacctccatctcacaatcattcctgactctccagaagcattcctgcctacaatacctctctaccaaccaccactgtaggaaaacgtttcgactgtagggatgtgtactgggctgtcagcactgattctatgccctcccttatggtcatcacctttttgcacaaactctcaacctggaacactaacaaagaaaggtgtcactatctaaatgatattgctcaggtaagtagaactgacttgtttctgtgctaaccaagacccagtgggccagagagttcagccagccctcttattcctcaaaaagtgcttctttccagttagcagttcaagtctctcgagagggggccaagattgaattctttctctgtacgtcaggctggctgtctaggtcaaggtcgaagaaaaaattgggggaagattgaatttttgaaagtatgcttgcatcagttctctcaatcagttaaagcaaagagataaatcctaccggctatttgatgtgctttaaaaagcatgtaaacaaaaatcaacacacatacacattttaggctaggtttggttttggtactccataaactaattcttgctcctatgatctttaaaataatgtgggcaataacttttgctctgtataatttggcataatgtacatttaaacagtgttaatgagctgaaaactcatgaaccactagtaagctagagtattacctgcaatgattcaattaacttatataataattgtgggaatactttggaaattgtaaatatttctttctatgcctttgtcttaaaatagccatttttccactatacctaaataataattaaaaggttctagtttgaaaacctcagcactttaatttacctacaaagaataccttgtagatgttagtaaagttcaagagtttctgtggtcagtatcttgaaggctgaaatgtaccttgagaagattgctttccatttattttcccacttccaggtaggacttcttttcataactcaactaagaataacacaatgccttctagtctttggttgtattgttttttcttttttaaaaaatatccttagaaaaagagaatctacaacttttcaatgttatctttttgctggataacttgaatccttgttgttttatatgggaggcatatgtgaaaagagtaatgaatgaagactctggagttcaactttgtccatatcccagtgctgatgggtaccgctagtgtgatcttgatcaaattctagaacacagactgagtctcattttctccatttgtaaaagctctaccatatataggtattgggtttatttcttacaattgtgtatttattagatctggacattatctttcttttaataagtgctagtagttatcgttacagttattgtcactttaaccctactaccagcagaagtggcgatcacttgctctccgaccctaataatactttggtgcaacagaaatttttctttcctcttgatttgtttcccatgacttgcaaaaattctgacattttcaaactcagaacttttttccagcttgttcatagagtgtgtctgactctctatccaccatacatttctttcccaaagatgaacataactcatacattattttcctatttttagacaggaatgaaagatactatctaacaactgtcaactgatgccaacacactgtaagagagttgctagtcagacaattttacaagtcaaaaaaaaaaaaaatagattggaaaaactgctctaaggtagtgtcataggatacaaacactttttttaagtgtgcattttatggcatgtaaatccatacatatttcagaaatgagtttaagagtagatttaatccatataaatgctggataaaattaatccattttcgtcactttatgggcaataatttggagtctatgtcagagagtcaatgttttggattttcatcattgatgcttactacccttctaggaatatgtctatattttttgataactttagccatttggcaactatcttcatgtttgcccaactgttatcctcccagtaattatctattgtcaattctgtgttcaactttatatttaactttctttgaattaccttccttctcctgctctttctcagtggaaattccccagagtttcaccctaatcctatactcttcttctccatagcactttctttagaacactcttattcatatgacttcagtggccactatttctgcttctgaaaactttttcatttacaaacaatagtatcccagttcaaattagcttacttgaaagggtaatgttttggcagacatcaccagtaatctaagaaagcatctgccctcacacttatcatctctcacaagattctcattctcatatattggctttattctttggagcgatctctttgaagatgtctgctgattacccccactctcacattttctcatttggtaacatcactggaaagagtcccttgtttatatatatggttggggtttattttgctgttttcagcagaatattctccaggtagatattcaggctggcctggcatgggacacatgctgatgatacctatatctaccattttacggctgtagctggccacatcttggatgtaggtttatcctgtgcttggagatagcttacagtgagtgcctcctaaacctgatggaatgaattccgcacaggaaagaaagactctgatagctgcagtagactgtaaacactaactggcctgataacaaatgctcctaatgctagtgaggctgaagtttaaggcttcctttctgtagtctatctaagctgtattggtccattctcacactgctaataaagacatacctgagactgggtaatttataaggaaaaagaggtttaatggacttacagttccacatggctgggaggcctcacaatcatggtagaaggcaaaggaggagcaaaggcacatcttacatggcggcagggaagagcacctgtacagaggaactgcccttcataaaaccatcaaatctcatgagacttattcactatcatgagaacagcatgggaaaaacttacccccatgattcaattacctcccaccaggtccctcccatcacacatggggattatgggagctacaattcaagatgagatttgagtggggacacagccaaaccatattataagcttcacatccactttgctactgggccttggaatattttatctttacatatccaagtgggaaatttaattgtctttccctcaaaatttgtttccgtttttcatttctcagctttggggaatggtatcacagccttgcattttagataaagtcttccaagcctcttttttcttgatcctttatattgatgtttaccacatcacacctattattcctgcttcatttatctcagtttcaagtttctcattccatgggcagcttccaatatttcaacactggacaattgcttgagcatttcaatcgcctccttccctaattctttcctctggcatgttttccataacatggatagttttgagtttttaaaacacggccttatttttcccacttccctcaaattgattcaaaaatatttcaggggttcctaaaaggcaactgcaatttgtgggacacaacaataaaaaaaggtaaacatggtttctaacctcacagaacctggcagttttaaaatggtaagatataacagatatgtaactaggtaccttataaaaaacactacaaaagggataatattggatggttttggagagacctctaacccagatttatgtccggaatggcatcccagaaattgtggcattcctgcatacatttgagggatggggaggaggttggacaatcaaagaggcaagacagtgttcaggcaagagtcatggcatgtgcaaaggcccagaggtgactacattttgttgttccaaggatgtcaaagaagtgtaggttggatgagctagagtggcagagagagacagtcatgaagacatttcagggagacagtgctggtttcagcttgtggagagaggaaagatggtcagttagaggttgtgtcttcatctaagcaagggagcctggtggcctgaactaggatagcagagattgtttgagaaatgttattgagataaaaagagtgttggcttttttgtttgtttgtttgttttaaggcagagcttcactcttgttgcccaggctggagtgcaatggtgcaatctctgctcacagcaatctccgcctcccaggttcaagcgattctcctgcctcagcctcccaagtagctggcattacagggatgcgtcaccatgtccggctaattttttttttttttttttttttgtattttttagtagagacggggtttctccatgttggtcaggctgttctcaaactcctgatcttaggtgatccacccgcctcgggcttccaaagtgctgggattacaggcatgagccaccgcacctggcccctgattgttggctttttaggataccttaaaagtggaggcagatatactgttctgagactcctgggcattgactgcttttttctcttggaaagagaatattgcctttctgatgctgagtttacttaaagagccaggaaaggtcaacgcttgcaaataaccccttaagtggaagtacatagattgttagttcaggttcttctggaatgttggacataaacctaagtataaaaaatgtagtgttgcaacaaaaatttggatttttttttaaaatttgttagattcctgcctatgcaaagggtagcaccagctacagagcacttcatacggatcccaggcaaggaaaaaatagagaagagattatgctgcatctgccccttctctgtgtggaccatgataccattgtttgttctctatcatggactaaataaatcagagactctaagtagatgtgagttctgtgtgtgtgtgtgtgtgtgtgtgtgtgttcaactgagtgtgtgttttatccctgccaatggtaactttatttgcaaagctgagtacgtttggaagatagaaacaatactttcttgcaactgatggggtaagcaggctaagcaaaaaaagaaaagtcaaggacatccctgaagtttctggttatggcaactgacaagatgttaccatcaatccccagggcttgagacagaggatggcctggtttgtgggttagatgggataggtaactgtcaaccttttgaattggaggtatcctgtaggctctccatgtgcagatgtctaataggctgtggctgtccagtcttgaaattctggagagaggcttgagctggataaagatttagcagttgacagctaataatttcatgggacttggtatgatcatctgagaaaaaaatgtacaaggaagagaaataagaagttcacatgacagtgcaggtactcaaggaataggaaggggaagaaaatcctgtgaaacaagtgggggaaaaaaaagaacaccttactttcctttacatgtgctattcactcagtgcaaacttgacctgtcattccacagggcgagttttattccccatcccaccactcagagttgacctcctttatgtcccctaaatcagaggccacaaaattaatgtacataggacatattcggcccctagataggttttatttggcctatggatttctttagaattttgaatcaagtgccagtctattcacatttcagtttgccacaggccccgtttctgccttctgtcttacaccagtcctattcctctcaggcctttattttatatgccaaacctctgaaagctctcacaattgcaaaaatatcacggatcttcctatgtctatttttttcttgtggaatacctctctgcctattgcaaatctattcatcccacagggtgtgacctgtggttcacgtctttggtgaagcttcctgccctctgaatttttatagcccttaatgggttgttattgttgttattattctcttgatgagtgactcagcatacatagcacatggattctatgactcctatgaatagggaaataaacaaagggctctgcagttttgtgctctgactcatagatgcaactaccagggaatttgctctttttagtggcttgtttcctgttctaatgagaaaaatggaaagcacagctcagaaacagactctacttagaaaatgtggatggtatgtctgtccagcatgacaatgtcaaatctcacattttgaaatgccaacttacaacttttctgccatttactctgacactagcatgttgagttgcactaacagttcctttttctgattattggtgatgcaatattatcagcttctcttggctggtgccacatgttgcagttaagtctctgcagctgtctactctgcggtatgtataggagggctttggtgcatatgtgatctgtgcagggatgcctttctgaccagaacctttgggaaaactgcacagtgagagacggaagaattgccaggatcagccttaccatgctttacaatctgtgtccaggagtggcactgccccacccactgatgaatcatcacactgatattatcaaaggagacattacattttcaatgtcatgttttaggtttataatttaattttcagctctggcaattccagaagcatccctagggacatatgaagaggaaggggctagcgtgtactcgaaatgaatacatgttcatttcttgagcaccttaattggcatgcacatctcacaagctccctttttctctgctgcagccaaactctctcacaccaccaagttactcaatattcctcctgcactgactgccttcctttccactcaacctcaagtcagatctactttagtaataaatctctgctgggaatgatcagaacaaatactgagtgtgcaccacaatattaaaaataagtgtaatatagacttatttaataaggtccaacagacttttataacatttggaatattttaccaaaggtactatcagcattatgtttaatgcattttctccaagacagaaaaatcttttcaagaatgaggggggaaaagaaaaaaaacacaaaacacagagaaaagtcagatgggctctgatgcattctcactcaactaaatctgtgattctccttcctttcccagatctttctcttcggccagacccacaaaatgtgaagcctctttgtgttcaccctgatttatgaatagtcggcactgggcaattgcggtcccagtgggatacatttcagtttaaaaatagtctgaagcactttctttcaaattcccacatgtccactgccacctcataatatgtgcttctccttctgtccttgtgcagttaaagtcggatccatgtacggggaatgaaagcactgaatttgtttgtagcactttgaaccaaaatggtgaatttatttagagagtagttccagcgagttaagttagtttcaatggacatattggctgcaactggagcattgatggaagggaggcatactactttaatgtcctcaaaaagaaaaaaagaaagaaagaaaataaataaataaaatccagtcaactgcaggataagtatccataggccaaacaaatccctctcaaaatgactgcaagttcaggtgacaccaacagctgtcaaaagacccctgtttgcctggcggcagctttgggttcaaattcttcctagtttacagtgacatttcatttaatgcttgcactctgactccatttgtctgccctgcaaaagctctgcaaagagctgacccagttaacactttctgtttcacaaacccagagactgaacagcagggaggctacagcaaagtgctgagttgtcctagctgagcagtaaggggacaatgactgtggccacagtccatgtcatttttgtttctagaccagtggtgactcattggactctcctgggcagttctgaaaagtctgcatgtcctagtctcacccaagaccaattaaatcccaatctgtggcagggaggacccaggcatcagcattttttaaaaccaaatctttatataaataaaatgtctcaagggatttgagtgcaaaaggacatactctatagaatataatatttctttggtaactgatgacatttcaagcttataggacctcatacttagcatagtgacttagaatctcacttttcactcagaagctcataatagagtcttttgattcttcaggggtttaggttaataaatgcaatataaccgaagctcattatgtagtgtttctaaaccactatcgagtaatcatttgctggtgtattaggcattgcaagcccttggtgccatagtccatctccttgtttctgagtcagaagaagcaggtggactgattcttctggcacccctgcttctcagcccacattgtgtcaaacattaaaagtgaggttttaatttgagtacctggcttggaatgtaacaggtaacagttgattatgttaattgatccaacgtcttcaaagtcaaagcagtaatgatgaatctggacctactattggaagaaaatgatcaagttacatttatgttgaaagatgaagtcagtagggaaagattctgttaaaatagtgggtttcatgcgcatccatgtgaagagaccaccaaacaggctttgtgtgagtaacaaggctgtttatttcacctgggtgcaggcgggctgagtctgaaaagagagtcagcaaagggagataggggtggggccattttataagatttgggtaggtaaaggaaaattacagtcaaaggggggttgttctctggtgggctggagtgggggtcacagggtgttcagtaggggagcttttgagccaggatgagccaggagaaggaatttcacaagataatgtcatcagttaaggcaggaacaggccattttcatttcttttgtggtggaatgtcatcagttaaggcaggaaccggccatctggatgtgtacgtgcaggtcacaggggatatgatggcttagcttgggctcagaggcctgacattcctgtcttcttatattaataagaaaaataaaatgaaatagtggtaaaatgttggggaaaatttttgggggtgggatggagagataatgggcgacgtttctcagggctgcctcgagcgggattggggcggcgtgggaacctagagtgggagagattaagctgaaggaagattttgtggtaaggggtgatattgtggggttgttagaagaaacatttgtcatttagaattattggtgatggcctggatatggttttgtatgaattgaaaaactaaatggggccgggtgcggtggctcacgcctgtaatcccagcacttcgggaggccgaggggggcggatcacgaggtcaggagattgagaccatcctggctaacacggtgaaaccccttctttactaaaaatacaaaaaattagccgggcgaggtggcgggcgcctgaagtcccagctactcgggaggctgaggcaggagaatggcgtaaaccccagggggcggagcctgcagtgagccgagatcgtgccactgcactccagcctgggcgacagcgagactccgtctcaaaaaaacaaacaaacaaacaaaaaacccaaaaactaaatggaataagagaaggagaaaaacaggtattaaaggtctaagaattgggaggacccagggcatctaattagagagtgcctaaggagattcagcatagtcctgccagcaaagattatttatttactttaagagttaagagtggcagtttggggatagcacgaggaggtatcagctgtgatggcttggagaaacagtgtaaactggcagtgtaaacaagagcagggcatgtatgagtagttgagaacggtgaataggagtgtgactagacagaagatagtagggatgacaagtttttgggggcacagtccgagttggtctggtgtctggactgagactggggcttaataaaaaggagcgtccatacaggagctcaaatgggctgtaccctgtagcattccgaggacaggcctgacttctgagaagggaaagtggtaaaagtattgtccagtcctttttaagttggtggctgagcctggtgaggtgtgtttttaaaggacctttagtccgttctacctttcctgaagactgaggactgtaagggatataaaggtttcaccgaataccaagagcctgaaaaactgcttggctgatttgactaataaaggctggtctgttaacagactgtatagaggtgggaaggctaaactgaggaattatgtctgacagaaggaaagaaatgactgcagtggccttctcagaccctgtaggaaaggcctctacctatccagtgaaagtgtctacccagactaagaggtattttagttatctgactggggacatgctgattaaagctaatttgccagtcctgggtgggggcaaatcctcgagcttgatgtgtgtagggaagggagggggcctgaataatccttgagaagtagtagaacagcagatggaacactgagaagttatttccttgaggatagatttccacgatggaaaggaaatgagaggttttaagaggcaggctagtggcctgtactatagcatagcctgcctttgctggtgtgtggcgattaggcctggtggaactgccatcaataaactaagtgtgatcagggtgaggaacaggaaagaaggaaatatggggaaatggggtgaacgtcaggtggatcagagagatgcagtcatgagggtcaggtgtggtatctggaataatgtgggaggctggattgaagtccgggccaggaacaatggtaattatgggagactcaacaaagagtgagtacagctgaaggagccagggagcagaaagtatatgtgtcaggtgggaggaagaaaagattttggaagttacgagaaatgtagagagtgagttgagcatagtttgtgatttttagggcctttaaaagtattaaagcagcagcagctgctgcacgcagacatgagggctaggctaaaacagtaaggtcaagttgtttggacagaaaggctatcgggtgcggtcctggctcttgtgtaaggattctgaccacactaaccatgcctaggaaggaaaggagttgttgttttgtaagggattgaggtttgggagattagtcggacatgatcagcagggagagcacgtgtgtttttatgagaattatgccgagatgggtaacagatgaggatgaaatttgggcttgactgaagtaaaggggactgtctgtgaagccttgcggcagtacagcccaggtaatttgctgagcctaatgggtgtcagggtcagtccaagtgaaagcgaagagaggctgggatgaagatccagaacagaataatgcgttgtagagggaggtattgaggataggagagtatatgagtttagcaccatggggtggataggcaaaacaatttggttgataaggcacagatcctgaactaacctgtaagtcttgtctggttttaggacaggtaaaatgggggaattgtaatgagagtttataggctttaaaaagccatgatgtaacaggcgagtgataacaggctctaatccttttaaagcgtgctgtgggatgggatattggcatggaggggggtaagagtgattaggttttaatgggatggtaaggggtgcatgattggtcgataaggaaggagtagaggtgtcttatacttgtgggttaaggtggggagatacaaggggaggatatgaaggaggctttgaactgagggaaaaggcagcaatgaggtgtggctgtagcccaggaatagtcagggaagcccataacttagttaaagtgtctcggcctaataagggaactgggcaggtggagataactaaaaaggagtgcttaaaagagtattatctaagttggccccagaattggggagttttaagaggtttagaagcctggccgtcaatacctacaacagttatggaggcaagggaacagcccttgaaaagaaggtaatgtggagtgggtagcctccttattgattaagaaggggacggacttactttccactgtgagagttacccgaagctcagcatccgtgatggcctagggggcttccgaggtgatcgggcagcgtcagtcttcagccgctaagccgagaagatctgggaaggagtcagaaagccttgggccagagttccaggggctctgggagtggatgccaggtgagttgaacagtccgatttttcagtggggtcccacacagatgggacatggcttaggaggaatcctgggctgcgggcattccttggcctggtggccagatttctggcacttgtagcaagctcctgggggaggcagttctggaggaatgcctggccactgtggtttaggcatttggaagttcttgtgtgctggagatgtggctggggtttgtctcacagtggaggcaaggaattgcaactcagaaatatgttgccacttggctgcctctactctattattgtacaccttgaagatgaggttaagtaagtcctgttgtggggttggagggctggaatttaatttttggagttttatttaatgttgggagcagattggataataaaatgtatattgagcataagacggccttttgaccttttagggtctagggctgtaaagcgtctcagggttgctgccaaacgagccatgaactgggctggatttttatatttgatgaaaaagagcctaaacgctatctgatttgggataaggaaaaaggagcattaaccttgactatgcctttagctccagccacctttttaagagtaaattgctgggcaggtgggggagggctagtcacagaacaaaactgtaagccggaccgggtgtgaggaggggaggtgataaaaggattatagggtggaggagtggaggctgaggaagaattgggacctagctcggcctggcaaagaggagagagatcagatgggtctgtagaaaaggaatattagaaagactcacgacgcttggggttgggactgaggggacaggtgggagggaaagaaggaagatttgggacaagttgcattgggaacagagactatggagggactgatgtgtaaaagaatgcctggacatcaggcacctcagaccgtttgcctattttgtgacaagaattacttagatcttgtaggatggaaaaatggaaagtgccattttctggctatttggaactactgtcgagtttatattggggtcaagtggcattatagaagaaaataaggcatttaggttttaggtcaggtgtgagttgaagaggttttaggtttttaagaacacaggctaagggagaagaaggaggaatggagggtggaaggttgctcatagtgaaggaggcaagcccagagaaaagagagagtagagacacagaggaaaggggtttgggggttcttaccctccagaaaaggaggaaaggggtcagggtggggaaataaggggttggggtgcagagataagaggtcggggcatggaaataagggatcagggtgcagagataagaggtcggggcgtggaaataagggatggggcacagagataagaggtcagggcgtggaaaaggatcagggtgcagagataaggggtcagggcatggaaataagggactggggggttcttgcaccctagaaaagtggtacttgccactaagggtgaaggagaaggggttggggggttcttactgcccagaaaagcggagaaggggtattgacatggagagaaggggttgtggttcttgcccctcccccagaaaagcgggacttgccgctaagggtgaaggaccaaggcaggcatccctgcatggtcagacacctctgaaacatgggtaaataatcagagaggtgtccctgcagtgattaaacaccaagggaaggctgccttcccgagtccgtgagcagtgctggagttttgggtccatggataaaacgtgtctcctttgtctctaccagaaaatgaaaggaattgaaattaagagaagggagagattgaagggtggtgccaaaattgaaaggagaagatggttgacggttagtgagagaggttggagaagagagtaagaagaggccgcttacccgatttaaaattggtgagatgttccttgggctggtgggtctgaggacctgaggtcgtaggtagatctttttcacggagcaaagagcaggaggacaggggattgatctcccaagggaggtcccccgatcccagtcactgcaccaaatttcatgggcgtctgtgtgaagagaccaccaaacaggctttgtgtgagcaacaaggctgtttatttcgcctgggtgcaggcgggctgagtctgaaaagagagtcagcaaagggaggggtgaggccgttttataagatttggttaggtaaaggaaaattacagtcaaaggggggctgttctctggcgggctggagtgggggtcacaaggtgctcagtaggggagcttttgagccaggatgagccaggagaaggaatttcacaagataatgtcatcagttaaggcaggaacaggccattttcatttcttttgtggtggaatgtcatcatttaaggcaggaaccagccatctggatgtgtacctgcaggtcacaggggatatgatggcttagcttgggctcagaggcctgacagtgggtctgtatctccttttcaatgtgaatatgtatcgagactatgaatagctaagtaaaggtgaaaagtcccatactcacaaggaccaggcaggtaagataaacgggggaaataggccaggttgtcaactatgcgtcatggtggggactgttctgatttgaagtctgtatggccaggcagtgtctctcagggctggcaggttggtgcttccagggaattcaggtgtagagttgctagatctcccagttcctcaagaaaattgagcaatctggatttatttttatataaaatccccagatttaaaatggttctgtaatggtcacttgtggaacagtttaagtaggcttttggcacaacatcctggcttcagatttttctgacaataatgtgctaaatgcccttaaggaccaggacaattacacatacgcaacccatgaagtgcagaaagttagcagctgtgggacttccttgaatgatgggttcagaagccagaagataagaagctgatgataaatgcttcttcccctcatcctgagatgcacagcctaaggctcctgggaaggtccagcaccatcatgattaggcacccacaacggcagtggctaactgtataactcttccttgtgttggctttccctttccttgtctctgccactgttccttactcttgctcttctgaatcgcttccccagtaaactacttgttcacagcctcagtctcagcctctcctttcaatacaaattgggttaagacgtttggcagctaattcatttttaaaagtcactgtgtagaacaaaacaagactatctatagggcagatgtgtagtgcaggacttcttgggaaatggtagatttaaaaagaaggcattgagcttgagttacagacgtgatttggtacttagggaatatttgtaacttattttgttttccataagaaactgtgtgattttttttctttgctttttggattgtttgtttgttttttttaaagaattttagtaaacctttcattttaggatagttttggatttacatgacagttgcaaaaatattatggagtatcctggttgaatttttttgttgctgttattgttttgagtacatgggagttttctaaacacatgcttagcaaacctgatactgtttttccctcttcagagctgtcagttcagatttcagaaagtgcagaataggaagttataaacataccctgtaaattccttgaaagacagtgcctcactcatctttctatctcccttagaaccagccacactgccatgtacgtgacatttaataaatagttgttgaacaggggatcctatcatacatgagcacggagagggatcatagccagtctgaaggcccttccctgcactatccctgaccaccatacctcttttcctcctctccaaaaggcaacctttccccctgtgcgatttctgtcctaccagggtagattgggaaggacactggatattggaaggcaaggtttttcgttcaggtttgcctgaatctcccactcactcatgtatgattaagtgatctttgttgccaaacaaagccagagctgcagctttgccgtctggacactgtgagagctttctaggacatacctgtgcactgcatgtcacagtgtatttttagccaatccctgagtgaaagctgacaagcattttgtttctcttctagatcctataagcacccaccttgcatatttactcagtggctaacgaaaacagtaataataacacatgctatagtttcagcctcagattttagaacatctttacaaggtcttttttatcaacccttctcaggaaactcagacagcttgcttaaaaaaccaggaaatatagaaacaatatctgtgagaacaagttacttttgttcaatctcagtttacatctcaagaggatgattattcgtagaactttaaatgatgtggtaacaaatactgtaagctatttgttttccgtccttcacagaattgaaagcattcagcattctatggcagggattcggcacattttattcatggactatgtcagggatgaaatgaacagaaggcatcttatttcatagaggttttgttttgttaatgataacaataatgccctgcattgagtacgtcattgggtgccagggatcctccagtgcacctcacaagtatccattcaataatatccccattttaaaaatggaataactgaggttgagagattatgatcagcagagctaaggggacaatgggatttcatggaggatgtttagttccagagcaatataatctaatttacattactgaagaagtcgctggcttctcagtgggaaacaaatgcaaaaatggtgagagtggaaacagggacaacaaaagctacccagggttgcttaaggggaaccagcatcccaatatctagaagaggtgttggtgggtctgacagaagtttggagactcggagttgttcaaacgctaaaggcagtagcctgctccttatattcgattcggtaagaattatagatatgagcaatggttattttgtggagcacaatgaaagcacgtttcaatcagatcgtggcccttttccgtaagtcttgctttctggagcagagcagtgggtccggcactgttgtactttatctcaaaccagatggtcttctctagcttctatcagcttgcttgagacacacagtaagtactggcttcttgctcctcagtcatccttaggggacgatgatttgtttcttggcttttgaaaggtgatttaattcaggcgtatcagagccccttttctgtaaggggaaagaatcttaaaaaaaaaaacaacaactagaaaatcgtctgttgtccacaaacccacacatccctggttgtacggaacatcacagcttcttgttcacaggcagctttaacagatagatgcggggatgccagctaagccaagtgataagaaaacaaaacaaaacagtggataagggctcatcattaaaatcaactattcgtatcatttatatagtccccacaccaattattctgggaactgtgtctttctggaactttctgtcaccatcattcgttttcccaattctgtaacaccataataccctctttctctaacacagatacagaagacttgtagcaataatgttaataactgaataatatttactgaatattaactgtatgcctcactattccctgtaaagttggtacatgaaaatcatcactctgctaaggacaaccaaggcctagagaggttagttacttgaccaagtgcaggtaacttgtatgaaagggctggaaagagaatcaaacccaagctattgcactccagtggctggtgatcttaggtgcaagaaagtctgttgactgactatgtgaaaaccatactccccgcaacactggccagagggaagaaatcaaatccgtgtgttgagatggtctggacaggcaggctgctggaaggcagagtatcattacagctattaagacaatgcagagggctattttggtgctcagatctgtgcagccagatggaaattgtagttcaagcttagtgttgtcagacagcagaggctgtgggcaaaggggaaggcacgggtgagcgatttttgactgtttatctctaatgtgtgtggccagtgtcactcccatctctgatgtctgtgatttattctattatactgtcaggattaaaacaccttagcaggagaaaaataaagggagggatacaaatggtgtgtcattgatgtgacagatgctatttctctggaaaccatagaggatgagggtatggaaactctcaaaaatgccacgaccaccgaatatcagaaccgaacaaacctttagggaccatctgtttcaagccactcatttgacagatgaggaaactaagactcagggagcttaggtggtgatcaaagtaacataagctcctaaatttagagcaagaaccctaactcccaccgcccagttcagtattcattcagcaacatcacctgctggtgaggtccattgttccttcccctaaattcagagttgagattcacattaagtaaaaaaagaaaaatctgtttttattttagcaagagtaaagaaaagtagaaagcacgagccggaaattctctcctttgctctccagtatccatacaatgttaacactgggactgtggtccttggctctctttgctgttgctatcttttgtggctagctcctttcccttctctgaacaaaaggagaccctagtcacctcctcacccttgttaagtgatggggtgggccattctctgcctggtgcagctttcagctccttactgcgtcctcacccatccttgcctagacctcttcatccgctgtctctctcctgctgtttcctgtgtgaatagagagaaaggatcagagtaagtcaaagtcctggcctgccaaggaacccagacacccgtctctccacctcttgcctccttcctcactcattcctctgcactaatctttcagcaactcagattttctgaaacacttaaaatcagtagaaaagcacagaatttgaagcaggatgacctaactttaagcctaatcctgatcacggtgagccatgcaacatgggacaagtctcagacaagtctctgtgggccagagtcatcttctgtacaattggtatcctagacaaagttcctacacccagtattattctaggggtgaagttcattgatgacaaaatacgttgtaaagagtgtttattagcaccaaatttttactgtgggtgaaatgcctaaattactttgtaactcctcagctctattagaaaatcgtcttgtgctcagacatgattatgcactgacagggacctcctgtgagatgtgctgtctcagcccaggagactgaatccagcagcctccaagagtgctgtgttcccctcaggccgcactgcccagcagagacagcctgtgttcacccagaaagagggccaacatctttccagctgtgaattctgcttatcacttggctggatgcagcattgcttgtggcccaaatctcaccatgttcctcatataaatatgctgtcgggctctgctcgtggtgttctctctctaagaaatgaagtctgccaaggattaagcttagaattgagaccacagtgtttccatttctctagtttctaacgtgaagacacacatacaaaactaccacgttggagacgaacaaagggaaaccattttgggggtgaaggttagggagggcattcctgctcagagctcagaatcatcaacgcccaaccttgacacttaataaaagtatcactagaattgcctggagttgtgaattacctaattttgtagggacttcaatctctatctatattgtgtgtgtttggtggggtgggtgggggggaggtttaaatgataaaaaatccaaaacaaaaaacaaatcacaaatcaccttcctatagaatgatccttgtcttctctaggaagtctcctattttgtatccctacactgaagcaggtaagtttgctttgaatatgataccagaaagaagaatggaaagaacaaagatggccgctctccctttctctgaccccactgggttgatactgcaacgtggtccctgatttacaattctctactttactatgatgcaaaagcgatatgcattcagcacacttctgacttaggatgggattaagtccagataaacttattgtacattgagaatatcgtaagtcgaaaatgcacttttgactgaacatattttcaacgtatgatgggtttattcgttaagccaaggaacatctatagaatagacgcaatctctcccaaagctcaaaccaagatgaacccctcagaaaaacgaatgtctgcaaacagctggaaaaacctctgctatgtgctttatcctcacccctttcaaaccttagggctatggaaaggctttagaacctcaaaaccaggctatgactataagccgcaggagatcactcttgtcaaaaaacacttaaggttcattttgtccctagttttgtttgggagctggggatacagatgctaagaaggtagtccatgctctcaggaaacccacaagctactccaggagaggctaaaagagtcttattatgccaataccatagagaaatgacctggtagacaaaagcacggtattatgggaggagaagccaaggcttcccggagacccttgtaggagagattttgtgctgcgagtcagagttgagtttgctgaaggtttcctgagatccagttaggtttgctctagtgtgaactagattactaaaatagacagagaaaatagcatcctgatatttaaatatatgattaccctttctttataagtacttagctggaagtgtcttcgggtgaatactaaagcgcgtatctgtgaatgtagaccatattggaaacagatttactgtcccaaagcgtagtgcttactcagccatctgatgagatgtgagcactgagcagtttgagagggatgcatagagctgttttattacaagatgctgttatgagttatagcagctttccttatgctctacggctgtcgccaaacaagttacatgaatataagcagttttatttgcaattttttgcttacattttcttagcatattcggattatagcttctcacagctccactcatgctcctgtggctgtcccagtatattgctttattcagagccaaaaggagcgtttacaaacatttgtagaaagtcctccttagagtacacagtgctagtgtttattgatgctatcacctggcacttgtttttttcaaaaaataaaaaaagaaaaaagcattttcacccttggatataatgtgtttctttcagagaaaacttaataaatacatgaatttgcctttcatttgatgcagttgcagtaactcctgtgtaggaggttttgtgtttcaggaaaaaacaaaataaaacaaaaacaaaaaacaaaaaaaacaacaaatagagtttcaaatttcatttgatcaggattgaacctgaaacaactaaaataagaaagaattaattttgtctgagagatatacaccaggcttggttgttacatacaagttataggctggaaaattagtgttgttaattcccctggaatgtgtgaaaatgaatcagaggaattgatgacgttaataaaaatgacaataacagtaaattagtttatactaaatgtaaataatggttatgctgggacctaaatgaacctgcaacagctagggacttagtatgaacccagtttattcttattttattaagcatcctctagatcaaaatattgtgttattaataattacaataaatatctagcatacagtgctcagtattcagagcctgtcctcatctcactgtttactttgggaaaatagcatgttcattagcacttggcttggtccagggcttaggggacactggacatttgaacatgactgcataaccgagcttcattgaggagcaggggacaggtgccagatgaggttttaggtaatttgaaggattagtctttaaagagtcttttaaattactttgcgctgtactcctttttgctggttataaaaataattcacatccattttaaagaatttggaaataataagtgtataaagaagaaaattaaaatagcctatcattttactgctgaatagcaattgtttttatcattttggcatatttatttcccagcctttgagttgtttgtgtgtatgtggaatgtattttcaaaattggaattatatgtgctatttatatactactctgttcattttacttttgtcatgaatgctttccttaaattgttcttctggaatatgatttctttaacaatgatgtggcattgtcatatggatatatcacactgtactttccatctaatctttttcccaatggaattttagttttcgtgcgtttttcatattataatagttcagtgaacatcttttacataaatctttgtgtatgtcactcatttcttcagaatacatctgtatttaaaattatgctaatggagaggtaataaaagaacgagtaggccaggttttgatataggtataaatgtttggggcatgcatctaaaatcaaaaatgctttttaagacaaaatttaaattttacttacaaatcatattctaaatttttcagccacatatgcaacaatccgtttatatcatattctgaaatgcatcattctgttgtaatgatattttgttaaaccaattttaaattgtatgaatgtagggatcttatgtcattttatctggagcctagttaagggggaattttttaaggtcatatgactatcccttaaacctcaatttctttgcaatagcatcatgaggactacatcctaggaaatctggagttgtaagcataatcacaggcttaattgttttcccttgaccatatgcatatattgttgtatacatacacatatgtgcataaatatacgtatgttagatatatattatataaatcacatgtaacatattacacatattaaacacaataaaacatgtacttatatatttgtgttcatgaacatacataacatcataattttaaactattatttaaagagtttgtgcataccatcacatgatttgacagatgtgatgtgttttaatcaggtgaccattagaacaataaatacaatgctttatagcaatctggtctggtctactgttagtctccacttgccccggctgtcaaatattgcttagagttcatgtcagaaggagctcttgcatcatagtccaaagcagacattcccagaacaaaaaaaatggagtcaagagacacagacaggacttccttttctgtctcattttcgatgtatctgtgggaagctttctgcctatacaacaaatcattcctagggagggctgtatcatgatatgagaaacgaacaaaaaaaagaaatgatttctgattcctatgggaaaaattggtcttatgtgaaaattaaactcagtgtgttataacatttgctacataaacctgaacaaaagaaaaaaaaaacttgtgagagatgctttttctctccacagttatctttcataactatctctttagttttgtgtgatgctgctcaaatttgttggtctaaactgcagtgttctcggagggttcagcacatgcccttccagaccggaccctggcaaagcagaatcaagcgacaggatagccctgccctcatgaaaccttgaccttgactcttttttttttttttaaatggagcctccttctgtcacccaggctggagtgcagtggtgtgatctcagctcactgcaacctctgcttcctgggttcaagcaattctcccacctcagcttcccaagtagctgggattacaggcacgcaccaccactcatggctaatttttgtacttttagtagagacggggtttcgacaagttggccaggctggcctcaaactcctgacctcaagtgatgcatcctccttggcctctcaaaatgctgggattacaagtgcgagccaccgtgcccagcctgaccttgactcttggctcaattttctctgttcttggcatctatgttcttcagaccatgatgcaagaattccaggggtgtacaatcttttggcttccttgggccatattggaagaaaacgaattgtcttgggccatacataaaatacactaatatgggccaggagcggtggctcacgccttataatcccagcactttgggaggccgaggcaggtggatcacgagctcaggagaagacaagcctgaccaaatttgtgaaaccctgtttctactaaaaatacaaaaatcagctgggtgtggtggtgtgtgcctgtaatcccggctactcaggcggctgaggcaggagaaccatttgaaccagggagatggaccaaatgtctatatggcctatagcatttattattaagtctgtgacaccaatgtacttcacttggcaagtcacttattcaccttaagcctccatttcctcccctaaaatgagatcaaaagaggcataaatgattgcccttctcccatcattcactctatctctgcctctatgtagactcagttcttgctcttcaactgacttggtagatccttgaatatatgtagtcattttaattccaaataattagtactaaagtaagaaaattctggtgagagaaaactgcaactatgtttaaatgtacaaataaaggtgaatcaatcccatttggagtaaagaacgtccagatgtcctcaaaataagtgtcctttctcctccacctattccctgtcccgagtctcattttcatgctcagcaagaccctctaccggattatgtcatcccccaccccgatacaaaagggttatgtttataaatgttgaatgactaacatatcctctcagcattgccatatagagtggcaaataatgttggaaggaaattgggcattttggaaaggactgatatgaatattaattatacaagtgtgggctccaaaatctcttttttaggtttttcccacctgcattcctacagaattgaatgtttgttcttctattatgcttatcagtaaattcttaattttgttaaggaaaaaaaacaaatccagggcaagtgcttacattatcactatcatctgcttgaagcctgaatttcattaagtaggttgttaataaaatgaggaatgatatatcacaactgcaatgctgtgtctcccaaagttaatgaagagttattattttatagatgacaaattaaaaggctgttaaaatagttggtaagactgtcaacggatttagcaacattctaattaaaaatagggcattaaagagaattaaaatcttgaatttggagaaatgagaaaatatgcttaatatgtgatttaacatagttaagagccctggaatctttacataagatgagatggatgtcgttttaaagatatcgtgacaaatttttgcaaaactaggacatcaccatctaatacaatttcacagagttgatgaacaatttgtttgccattaaaattatatttttaaatgtataagtaatattaaagcaataataacattttaatatgtattattataaagatatgctacatgtagccttaatatatattaatgatatacacatttacctgtcacccatttctaacaaattaatagttttcatttttttcattttcactgaagtacttatctatctggatacatttttatacaaaaatagatttttatacaaaagttacacttctgtctgcttttttcagttatacctcagtcttacatatcttaaatgttttcctttttaatcattaaacaccattaattgagttgatatgctacattttacttaaccattcctttcttggttagttaggtcccttccactttttactataataaataacattcaagaaacattttcatatacatttagagtaagtttctggaaatgagattactagatcaaaaagtattaatgcttttttggttgtttaaacattatcaaactgcttatcaaatgacttttatcattttacaccagtaatttaactacagttgtaattcaatgacaaggtggataggatttgatggcatcattattttataatttttgcaaaattagtaggtaaggtggtatcatatgtttgttaacttatgtttaaacaatctgctccaagaatttcacagataattagataacatgactgttttctctattaatttggttttctatattttattctttgacaagtggtcatatgcaaggtgccccacatatgatgccgtaattttcttttagcagattttggaggtattcacagaattgagattaagcatagctcaaacaaagatacccatggaatgaataaatgaaataatatttaatagagtaaaacagaaagtgtttagaaacatgttatagagtcaataacaggtatagtgaggatgatttttttcaaggtgtgctaaacttgaaaattgaccctttttatgagtatttcaggagctagagaatccctcctattcctaaaacaaaggtgaaggagaaacagggaaagacagagacctctaacaaacagaatgaatagctgaagtggacgggctgtctctgggagtgggcattctatagaatgcaagcagtgggggtaaacaaatgctgtttacatttcccatccttgttaaatgaaaaagaaaattaggaacaattatagctagagttatagaaatccaccttgtgaaatagagaccttgggtccaaagcgtctatttgcatttcactgtttctgcctggaacaagtctgttagcatggctcactccctactccctgcaggtctctgctcaaacattatctcttcctgcctactctctataaaatataaagttctgtgtaccccacttgccattccattcactccctgttcttttttatcatgcctcatgcttcttgatctaagatttgcttatttgcttatttatttactcatctatatactgcaagaatgtaagcttcataaaggcagagatatgtactgtatccctacaacttgatagaacaatgcctggcatgtaatggatgcatcataaatatttgttgagtgagagaatgaatgaatgaattgtgaaagatcaccaatggataaattacccaaactctggttgatatagccaacctactacaaatcaatgaccattccagtgcagagttgtacatgagcagatgcagtattggggccacaacactgtgtaaggttggatctggaattaaacctttcttgtaatcatatctgcctaagtgtttctttctttctttctgaagagggattaaagacagattctagaagctcactgtatattattttcagttaggtatgagtatccatacatgtttacttgtgcatgtgtgtatacgcatacatatacataggtacaaatatatacacacacatatccacacatccccacacatgtttgtatatgtgtattaagttcactttagtaaactctgtagaggatattcccttgagtacaatccgtagagtcagataatgtcgaccaatatttttctgtctttttaaagcttgtgaagaatttcttgagacattgcaatggagaaaagcctggaacaagtgaatttaaattgataattacagttagaatctggtactcatattgcataagacagttataactgtgtaaagagttctgctttattgtggctaattatgctcttctaagactgttgccaaaaaaagagcacacagtcaacaatgtcccagccttcctctgcacaccccctaataccaatgtcttcttatgtctcagtcctctcctcatcatcccttggtcacttttcagcctttattttcttatcacattgataacttgtagtatcattaacccttgacactcatcccatctacaattcccctaaaccagtagacgtccctaatttaaaatggccatggtcatcaaaggcagaaaatctgcttcctctcagcagtcaataatgcaactagaaaggatcccttcagtaggttcatgattcttcctattcaagaaatggccattggtgttttgtctttgacatcaattgattttatatttaattcttattcattttttaaaaccttcctttctcaattctaagtcaaatcagcactaaactgtctctgtggcggttacatatcttagttgctctttcatcctaccatagaatggagactcataatgctagaggagaccatgaaaagaccaactcatcaaccctacagttaatcactaagagaattgagctctcttgccatctacctttctatcaggaaatggatccctgagcatctgtctattattccttttgtgtgttgtgctcaacggaaattttccacatctccatctctgtaactccactgtcaagagcaatctcttaggcactgcctgccattgtgattattgccaatatcactgaattaaggtaatcaggccacattcatcgcatgcacttggagcagaagctgaaaccacaggtaaaattgaaatgtcctgtaatggccatttctgtgtcggtttcctgttcctttccctaaagtgcatttgcttttgcttttcctccttgcctgctgagatcattgtgtgggtgtgagtgtctgagggttcaggttgataagttgcaaagggaagaggggataaaaagccacacagcttgaataaataaatgcatgaaaatatgtggtactctagcatgccctaccgccatgtctccatcactacacaaggatgtcctcatagattaacttcagcatcagaattctgaaggcagagaagcaaaagtagcagctgtgggagctccctaaagtggaatcgggcatgacactctgaattttgaaattgcaaacccacagttcagtaggttgcagcaacacagaatgcagatggtgtgttcctttggattgtcagtgtagttctacagtgtatataaatggcttcagttcactcctgttggctctgtcactgccttttaacaccaatgtgtcagtaaagccatgttgcagtgacaatcgtgttggtaatggggctcagaggagaataccttgagaaaatttgaaattaaccatttcagaatagggaagtcttttaaatatgattcatgttagaaaaatgaggagcacagtgcactagacatacaaggttactacaataacttggattcacttaatgcatgttatggaatttaagaatagatgaagttgttcattttttttttttttacacaattacatgttttcccccacggtgtgaataaaacgagataagtgcacattataactatctcagtgattaaagcatcttcttttcatctataaatatcatataatagagttagagtaaatacaaggctgtaattaactttaaggccttcactgatacactatcaaaatagggccttactgccttccaatggcagctgagtcaaaaagaatggtttccatttagaaataatgtttggaggttttattcaggatcctatgccttatttcccaacacacagcttcagtggccagttagaaatataggttccctgccatttgcaatatctcatgcccctcctggtgttcccaacagctttgagactcagagcccacaagtggaatctgtgcatgtgagacttatttaaaaaggaaagttttttaaattttgtgaattacatttttgagactgtcagcttagagttgtcttccattaagttgatagaacgtgaagcaataggagagcagttggaataatatttccttagcagaatgttatgccttgcaaaggcaacttgtcattcgaggctttcttttatgggatatttagagattttaaaaaaaaatctgtttatcaattgatatacagttggccaatttaaaatgatgacttcatttcactaatgaccaatcagtgaaaggagtttaaaatcaattaactttgtgtggggccaggctgaatattatttgtttcactgttgtagaatgtctgtagaatatactgcatgtaaagtatattgtagttaagggtcagatgccctaattctgctttttagttatatgaccttgagcaagtgaatacatttctcagtttcagggttttcgtttttgtttttttcttttaaatggaggtaatactactttcttttggttagttgggtgtattaaattagaaaatccatgtaaaggcacttaacaagttgtctcgcatttagaagtcctcagacagtgttaacaatgatcattattatgttaattacatttacccatacaacctaggatagctataggggaaaaaccaaaagccaacaaatgatttagaatcacagatggttaatactaggaggaaaataactagattttcgtttaccctccttattgtacagttgaaaaacaatactcagggaagtctaggaagtgactattccaataacatgcatctatttgaaggaagaagctgcatcagggtgctaggttttctccaatcagcagtgatttctgctatgccatgtggctttcaaatgtatctgcttaaaaattagcaggatgacttgtctttgaaaatagaattacttcagtgtcacctcactttatattcaaacctacctagaacctattaaatggctggaatcaagggaccagttagtatgtatgatataaccagttgtaataagcaaggtcactactgtgttaaacactatatgcaaccaatctttgaccattcattctgcaaatacttattaaaacctctggtgtatgtcaggcactctactagcagtaatgatagttaatatgtgttgaacacttatgacacttcaggccacaggctaagaactttgcttatgtaatctagtttgactctaacagaaatcttaccaaataagtacttctattagtcccactttatgatatgatgaaaaacaaaaatcaaataagaaacaagtcctcattctatcttaacagatgatctgctatgcttatagcctcaggaataaaaacagtgtttgtcttctggcacatagatgattcccaataaaatatttgtttaatggattggcatacagcctaatggagattaaatacagataaaaattaatacaataaaactagtccaggcagtacaaaaaccagcacactgaaatatagttaggacccaaaagaagaaatgggcttattcaggaaaggcctgaattgacagattctacaggtaaatcctgacttaaatgacattttagatccttgccttcttttcttttgatagacacagaacgagatcattcagggcttagccatataggagtgctatggtttgaatgtttgttccctctgaaactcatgtcgaagtttaattgccattgtaacagtataagagctgggacttttaaggcatgattaagtcatgagagctctgccttgaggggtgagattaatgccattataaaagagcgagttgagccctttcatgctctcttgctcacttgacaccttgccttccaacatgttgatgacacagcaagaaggccctcaccagatggtggcactttaaaattggactttccagcctccagaactgtgagccaataaatttctgctcattataaattacccagtctcagctattctgttatagtagcacaaaacagactaagacaagggacaacttattttttatggttgttcaaatctttgttttcaagtatcctttttacttttagaggaatttcttcctgtaaagacaaacaaacaaaaaaaaacactaaaatctagaacatacctgcaatgctgatttcctgttttgttcttccaagtcacttccttaggataaaaagccactactctgtgcatttagagcccctgaaataaattctccattttcaaatgaccttacaagaagggactagaaaattgctagataagtcagaaaagatttttattttaaaaaattgatgctcttctctggaaattatattacagttctagctgtgatatgtattcacaaaattaaaaaaaaaaagataatccaagagtaagatgcaaactcatttttttggcctgtgtatgaaaatagacaaagaaaaatatagggcattttggggctgttcaggccaggataaaaaaggaaatgggtgtcattcctgaagcttctctctctggcctgctttttccttttctatctggaggctgacagacaggaatcacatagaagttattttgaaggtaattttatatggagtggagacatttttccccttctgcagtcataagccttgagaatttatcaccagcttcaaggtaagaaacttttttgccatgaatttgtctgctctaacgttccttaactttggtctctcagccaacaacttgccccttgtttccagcccagcggttaggtggtttgctaaggtagaaggggagcaaagcagcttaggctggggcagccaaaatatccatccatccctgctttgtgttatgctttctctgtatatgagctctaggttagttttacctcctcaaacttttctttgtttatttccccttaatgtctgcctgggcattgaatctgttgtcttgctgccttggcttattttttttttttttttgggggggggggcgggggggggggtggatggagtcactcactctgccacccagactggagttacagtggtgtaactcagatctcggttgcagatctcggctcactgcaacctctgcctcccaggttcaagcaattctctggcctcagcctccctagtagctgggactacaggcatgcaccaccacgtctgactagttttttttgtatttttagtagacacagggtttcaccttgttggccaggctggtcttgaactcctgacctcaagtgatctgcccacctcagcctcccaaagtgctggcatgataggcttgagccaccgcacccggctgctgcattggcttttatgtcttcttgacactctgatttgtgtgtttatgatgctcgtgtatttaagtgctcaaaaatatttgtttttttttttttgttgctgttgttttttgttttttgtttttgttttgttttgaaagaaaaaacatctatcaagggcccacagtgagtcatatctcaggcttcagtgcacttggctttgtattctggccctgttagccacccataccgtggagagagaatctctgcatttccctctctaggaaacaccacccaaacacttgggttctagattctaatatatcacattcaaatcccactgcgttgctccctgactgtgtgacctcagctatgcaagttgtgtgtaccttttcctttctttcttctatagggttgtgaagaccaaatgagatggctcatatgaaatgtttagcccagtgctcaagaactcttaattaccttttccctccccctttttttttaaatctccccattcttccttaaaggtgaaaataaacatcactgtccaaaagaaaaataggatggaatcaagattaaatgattaaagctggaattttccttttacgtacttaaccagtgggtcattcaaggtacttcacaatttgttgagagaaccattaaacaccattagtaggtcatctgccactgacttcaaaactatagtctttaaaacccagccaaatagggaaatcatcttaatagctccgatcactttgatttgggccagaaggccatggtgacagatgcactaagcatctcataaatagcggggtatttcctttagcaattataattcacagaatagaaatagtcatgtgctattattatgtaatatgatatcacttaaaaatgtaaaactgtcgcaggggcattctggccaactggccctgcacctttaaccacacttcagtttgttctggtctcatctgaatgaccctcacatcataaaatgtctttttctccttcaaattctgaaaggaggatttatactagtacagcatatagagctcgaccgaacttttgagactacctagtcttttaaaagtcctttatgagatgtattattctagtttggttttctgaatgtacagataaagaaactgatttagagcagtgaattggtttggcatggctaaatggatagtaggcggctggttcagaatttgaactgacatcgtcctaactaaccaaggttaagctgaaaaataaaacctttgttttatagatacagatatgtgtgtatatgtgtatggtgcatacatacatatataatatgtgtgttatatgtgtatatatgtatgtggatatatatattcccctccctaaaatagtgctgagatgtgtcctctgaatatctaacacctctgagttttttgttatatttttttcctaaatgcaatcagcttttactcactgataataaaaattgcatgtgctaattttgaagaagtcaaaaaattgagaagagtagaaaaagagccaaaatcgcctgaaatttcagaagtatctgtgaaaattttgataaatgttacacaggtatatttaaaatttcataaaaatataagtagaactcctggagaaaaatcaatgattggttcttattcccaggtcctaccttctaactcagagcatatagtacaggaaaatgataggattcaaaatgtggttcaggaaatgcaaatatcaacgtcacctgtgaacttcagagaaatgtacgaagtcagaacctccccaaggcttactgaatcaagagctctgagggtggggcataacgatctgggtcttaaaaagtccaccagactattctgatgtaagatcaagctagagaacctatggcatgatgtattagtctgaaagatctgagtttgaattcgtcttagccgtgaccttcattggatcatgaccttaattaagttagtcacccaactgttcctcatggtgaagtgaagataatatttaccttaaagagttttgaagattagatataagttacatgaagcattaaatccagagactagtccattgtagaagctcaatcaatgacaaccattatagaaggccaccattgctttcatcagcagctcagttacacaagtcatttttgagagatgcagtagcatgcactctaggagagaaacacactgttgttaatatttaaaatatttcaaatagcattacagccagagaaataggatccatctaattcacaatttgtattcctcagaagcaacatgtagttcttcattgccaagtaggtctcctttcaaagatggataggtaattttttttcaaaatattttaatccatataatttgagcaaatactcggggacatgagattctatgatgaaagctctgttttgatcacaaaactctgaactgcaaatgtgagagtgtgtgtaattccatctttctctttttatttatggaaaaaaaactaaatcgaaccaggtagttgaatccttctttcaagaaggattaacagtcattgggaccacgatgtatttggatagaacaagaggaaaaaaaaacatggaaataaatatgaaatagaaataaacatgattgtgtttttagtggtatttgcaatgccttacaatattactaatatgataataatcatattagtattccactttcaggtacattgatttaatgaagattactgaaatgatttataggaaaaaagaaacaaggtgaatttaataaggtgccagacaactgccctctgagtctataaaagtgttcagagggaccgaattcggcttaacctgacccagagtggcacattacaagaaactgcctcagtcttactcaagtgtgaacgtggctctagcaggccctactgggtattagttatggtgatgctgtatcaagtctgtggagtgttcattccccttccacctctgatccatgtcttttaatctcttaaactgagaatgaatggctattaaaaactttcagtgatttcagaaagattctttaaatataaaccaataaaatgaaataatgcaatgacaatatttaagcaggaatattatggcagataaattctgggaggtttactgctaatggccacttgacatttttaaatagagcgtttcagtaaatcactgaaaattagccgacaagaatttatactcatctatttaaatgatacttgtaaataagtaaatacggtttaaatatagtttgagtgatggtggaatttatagcaggaaatgtcctagtgtaggtttttgttctaattgaagatcaagtcaacaagcaactattgtagttgctttgttcccaggaacagggaagtatgctagttcctgcagacccacagaggagagaagcccaattctgcaaatccagtaactcattgctcaggttaaagtctatcaccctttaccccagaaaacctcctttccttaccacacaagtggacttacaagacttccaggttagaatttagaaatgctcctaattatatcttgtggattttagcttgcatatagttcaagagctatacactggtcaggggtttataataaatatcagtggtatattttaattatgtacatattaatgcattcatttcacaaatacttactatgcatgttctcttatattccagacgttgttctggcatagaagatggtaacagtgaacacagcaacatctgttctgccctgaacttatagtctatagttgagagatcaaccatgaacttgtaaattttttaaaaagataatttcagttaatggtgagttgttaaggaaaaaataaatggagcaatggcatagagagagtaactttggagagagataaggaaagaaccctttacatggacctgtctgaaaagatctctctggaaaggggacatttgaattggagcatgaagtgggggaagaagcttgaacggtggccaggagggtgaggggcattctgagtgaagagtggtcagggtacaggcttgaagagagagtgttctcagtatagcgcagggttagagagaaaggtcagtggggctggacttcatgacaagacagggaaactgtcctataagatcagtttggtaaggaaagcaggatatatttgatagtcttctagagaacataatttactatgttttgatattatagtgggaagtcactggatctgaggcatggaagtacatctactttgttattaaatttctggaaatggccaaaaatcgtagtaattttatacgtactcttaaaataggataaagtcagccaggcatggtggctcacgcctgtaagcccagcactttgggaggctgaggtgggcagatcacgaggtcatgagagcgagaccatcctggccaacatgttgaaaccccgtctctactaaaaattcaaaaattagccagacgtggtggtgcacgcgtgtagtcccagctactcgggaggctgaggcaggagaatcgcttgaacccaggagacggaggttgcagtgagccgagttcatgccactgcactccagtctggtgaaaagaatgagactccgtcagaataataataataattataataataaataaatatatatatatatatatataaaataaagtcaagcctcctaagtcatgttcagtttacatattggggaaaaccccaaagttacactcagtcatcacttcaatgcaagaagcatgtataattacaaaagttctcaggcagtcttttgaaagatacaatactgatgaagaaatagtttctgtctcaagtaagctgcatgctattagagaaagaagctatatataattacctatgatatacaattttaatgaaataaattctgtattggaagcctaaaggaaaacccggcaaattctgaataacattaaacatttattcttttttaaaaaattttattattatactttaagttttagggtgcatgtgcacaacatgcaggtttgttacatatgtatacatgtgccatgttggtgtgctgcacccattaactcgtcatttagcattagatatatctcctaatgctatccctccccgctccccgcatcccacaacaggccccggtgtgtgatgttccccttcctgtgtccatgtgttctcattgttcagttcccacctatgagtgagaacatgcggtgtttggttttttgtccttgcgatagtttgctgacattaaacttttattctacaaatatgttttgattgcctggcacatatcagaaaggatacaatggtgaacaaaacatgcctggctcttgctcttaatgagtttgtagttcaattggggaggcaggaattaaatatgaaatatagtcacaaattggaataaatgcaaaaagcaggaaagaatagcacttaagacagtatctggcgcatagacacccagtaaataccagttgaataaattgttgtttatagaagaaaaacagggattaacatgccttagagacagcatgttcagaaaaaacctccccgaggatttaccgataaaggtgaggtcagaagaagtgaaggaataatcatttcaaaagatttggagatgggatggcttctaagcagagggtccagtatatagagatccaaggatggaaaagagttctagaatgtgtcataaagacagagacatgatgttagagaggaagagaatggtgaaatagggtagagtattgcaggtcatgagaagttataagtcagtatgtaagccattgtggggctttgtatgtttagaagatcatcctaatttctgcaaaacgaattgactctgcggggataagagatgatgtttgtgatgatattgtatgaaattagattaaaagatgatggtgatttaggctaagatagtgagagtgcagatggatgaaagtggctgaatcaaaagggtttgcagaggcagccactggatatagtggaatggtgcaccttctgtcttccaggtatttaagctaaaagcttggagttatccttaatttatcgcagcattaagtgtgaacttgttaaaaaaaaaaaatcagttttcttatttctctgctcataacccattccaacagttcgatagtttctcatatcgtttttttttttttttttttttttgatggatttttgctctgtcgccaggctggagtgcagtggtgcaatcttggctcactgcaacctctgtctcctgggtttaagtgatcctcctgactcagcctcctgagtagcttggactacaggcacgcaccaccatgcccagctaatttttttgtatttttagtagagatgggtttcaccaagagatggggtttcttaacctggtgatctacccgcgttggcctcccaaagtggattacaggcgtgagccaccacacccagccagtttcccatatcttttgaagaattgaaactcttaagcccctaaaagctcttcccgcttattaaatttataaatcattcccctacaagtgtcccctttagttaatctaagctgcctcactggccttctcccagcattcaaataaaataatcacactacctcatggtattttccctagctgttccctctagctggaatgctcattccctagatagacacttgaagattttacttcctttagctcttggctgaaatagcacctaaacagtgaggtcttccctagtcacttatttccttatgtcctgaccctccttctcggtatactctatcctgtttctctgctttattttctttttagtgtttatcagtatttaacaaagtatatattttgtttagttttagcttttttggcttgtcttcccactaaaataagagaactgggtcttgttatttgtttattaccatatccgtgatgtctaaaatcgtgaccaatatatgttggttgaatgaataaatacatgacaatagttggagaaaggagttagtaccttccagaataaatgttgttataataactaaagttgattggccatttgaaaacaggtcagttgttgagttattggcttcatgcaacaacaacccctgtgggagatgagtctgggtagatagaattgggactggttggaagaatcttgaataccttgtcaagaagtttggacatggtcttatggagagttagaatccattagaaaatttttaaagagaagggtggtgggctgggtgcagtggctcacgcctgtaatctcagcactttgggaggccgaggcgggcggatcatgaggtcaggagattgagacgatcctggctaacatggtgaaaccccatctctactaaaaatacaaaaaaaaaaaaaatagcctggcgtggtggcaggcacctgttgttccagctacccgggaggctgaggcaggagaatggtatgaacccaggaggtggaacttgcagtgagccgcgatcatgccactgcaatccagcctgtgtgacagggccagactcagtctcaaaaaaaaaaaaaaaaaaaaaaaaaaaaagaggtggcatactccccttacgtttttgttaataattttggaaatggtgtgcagcaaggagcttgagtgggtagacattggaattaggaaaaatctgttgaggaaattattgaattgatccagctatgagatgtatgagaaatgttgaagctgaaaattgttttaaaaatagaaatagaaagaagaggaagagatatgggggatagaaattatgagttcttgcttatagtagtgattacttttggatttaaagacattctttctcattaagacaatttctttagtttttcatatccctaattcctcataaagcatttgtgtcagtggatggtcttgaacattgaaatctaccctgagtactctagtaccatttattataaaacaaattatgttactgtcctggctaaagcatctaaaactttcctgaaatgtttttcaggagcaagttcactggatttttagaaaatctccgttctttttgtttctgtcacttaccagacatatgaccttgagtatgtcatttaacttctctaaatgttgtttccttatagtataaaagaacatcttgggaagaggataccagtgacttatattcaaatagccaaagtgttgtcataattataatagccagccttaactgagtgcttgataaatgaccagccttgtgtccatcaaatcctcatagtaacactatcagtttggcatcattggttaaatattcctgttttacagttgaggaaactgagatgtagagaaggtattctgtttacatagggacgcttagttattggtgaagtctggatttgaatccagtctgtctgactccagatcttacacttttaaaagctatatgcttgctggggtagaagtagaagacttgtagcagttccaactgaatataaggaagagctttcaaaaggcagagtgagaacgagctgttttcacagagagtagtctctccctgtcataacacagcttcaagcagagactgggcactcatgagtatccagtgcttccattccaccaagtgtttggcaaggagatccaatacctaaaatggtagctgaactagatggctttgaattccttcatgctttagattagatgctccaaatctgaggatccaggagacaacagcaatgctcatgataatttctgtttcctcttatttgctatagcatttgaggtccatagcaattttctagcatttctcacttaacgttcttatgtttgtagcttattcctctatcaaaattttgaggacagggagtacgtttcattcttccatgttttctctgatgcgtagacataagttttggtcactacaggcttttaagtagtattgtgtatgtattacctattgaaaagcattatgggccaggcgtggtggctcatgcctataatcccagcactttgggaggccgaggagggcagaacatgaggtcaggagttcaagaccagcctgaccaacatggtaaaaccccgtctctactaaaaatacaaaaattagctgggcatggtggcacgtgcctgtagtcccagctactcgggaggctgaggcaggagaatcacttgaacacgggaggcagagactgcagtgagccgagatcatgctactgcactccagccagggcaacagagtgagactctgtctcaaaaaaaaaaaaaaaaaagacaagaaaaaagaaagaaaggaaaaaagagaagtattatgaagaaataatttgtttaattctacttaaatatcagttgaaagaagaaattatttcaaaaattaatggctaaatctgaaaggtcctatcaactggcaactctttcaggatagaaagatggacagatagtgcctatgagattatgatcatggccctttaactgccctcaacgcatgaatgtacctacagaagtgaggacatggaaagtctaaatctcttcatcccacttgagaaagatgaatttacaatgtaggatattctgtcatcttaagataatcaaaaactagacttttctttgttgggcgcgaagaaggaagatggagaacctcttctgtttgcaagatatattttgaaagagtgtgaatacaatgatggcaaatgcaactcttcaagagatgcaccattgaaataaaagtggtaaaagtgagacccattaaatgtgagcaccgttgagtcaagctgcatataattatcacagaagataatacggaagcagagaatgttgttaatgatttctcagagcccaagtggtgtggaaaacaactctgagtgcatttactcctccttttgtgtagcctatcacaatgtaaaattgagggggcacctggcattaaatactgtatttacgaaaatgcagtaaaaaaatcaagatagcatttagtgtattgttcttccacaaaagagagagaaggaaaaaaaattgcctttatcgaccaacgtattccaattatgatgttttatttaaataatcaccaacgggcaatttgttcaaagttatttctatattcccagcatgaaataatcccctatccactcaagtttttttatgactctaagatgggataagtagaaccataattacaggaaaaaaatttgggcgttacgattctagtccaaagtgttggggcattcactttcgtggcctcggcagtaccgtttgtctttgttgaggctctattttccccctcactttagctatgatttccttatggtattttaaattaattatcaataccttttatgcctttttatgtttttgttctatatttgtatggatagctcttgctattctttgtcaaaattgcttcctgtgcctcacgtgcctctgaactacagttggatcatgatgagggtttctttgctggtaactgcacccgcctcaacagaaacaggctttgttccctggagaacagctttgtgactactgaaccagaagcttcagtgttgcaggggaagggtcggaagatgcaaattcatgtttgtttggcagtggacgcttggctctgccccagtttcatccccatgagtagcatgcgtttattccttgggattcttaatgtgacctatcacttcaggaatatcctgtgcagaattttatttgcttgtactgggttgagttcataaacactaatcacacaaaaaaacctaattagcgcaacaatgaaaatggaaagactgaacatctgagtacttatgaatagtctttcagtgtcgttgattccgttagttatcttgtatattttatgtcctacttattacagtaaaataataatattctatagagacacacttatcaaggaagccaggaagagaagatactggctatagaggttatggctgagtcccaaactgaagagacaaattgatcctcagagttacatgaaaatacaagtgataaacgtggtaagaagtttgtttaaaaggtaaaggggaattaaagaaaaaatggatgtgaatttaaaccccagaaacagtagtgcgtggactggaaatttcaaaatgaattcataagccatcaacaaagattaaagcaatataacagtgttatgggcattaagtaaaatggataaagagaggaaaagtaatcagagaaagtctttccataacaggaaaactaggctgaattactaatggattagtaaggcaaatcagagaaaatgggagggggaacactcttattgcttcaggattctagcctcacgcctttctttctgtgagacccctacaactgcttacttcacctcttagcctcgattttctcagctgcaaagtaagcacaatgttagcacctctcgtaagattatttaatgagatgatgttcagataaagttcttaaagcaaggcctagtatatattgtggtagttgttgttattattattatcattattagaaaaataaatattttagattacctgatcagtgagccatgttcttccaaagtctttcaactgaaaagtcattaaaagaaattatatgtccttgggccagctaaaataggacatgatcgttgaaggacaggcaaatggcaacactgcaactgagtagaggacttccagtgaggtggaagagagaggagagttgccagtggccttctagaggatatgtttgttgttcttgtccctttgctccagggggaaggatggggatcaatcaacatgacagggaaggtatgtctttaagagtaggtctcaaaacaacaaggctgcaataaacctgcctcttagaaaatcaaagagatttagagaatctacatcagctttctaggctcatgagtccagtgggtaccttggcttcactctgtatggcagcaatattagaaaaaaatagttcaaatggagttataatgaagacattaagtcagggatatagattaccttgcctacatcagattatgagttgatatacatatgtattttgtaactaaatatatagcatgtaaatatttaaataagaatacactaataaatataccttatatttattgaatctttcctgtgtgccagatattataagtgcttttatgaattgttttatttattgttccaccataccctgataatgcagaatactttcattattccaattttgacaatgggaaaattaaaatgaagacaggttaagtagcttactaaagttcacttagttaggaaagggtggagttgggttctagcccagagtgtctgcaactggccccataatcttaaccaaacttaaaaactgacctttagcagatccatgatcaccatatagatttgactgaatgacagtaaaattttcttaaaatatgccttcaatgttcctgttgaaagaatttgccttttgaaaataaaacaatttctttccagatacacttaatggcataaaattattaagtaacatcgacactagctctacctctttctctgaaaattagagctaagtgacattttcagacttttctaggtagacaatgtacttgctattccaggaattctcattcaatagtgcattttctctttctttgtctctctttccttttcttcctctcttgttttttccttccttttttcttttgttctcataaattcatggaagtctgtcaaagttgtgatagcatgctacgacacattatatttttgctagtcatgaactccgttacaacatattatctggtttgcaggtcatattatttgaaggaacatgctttgctgaaatcttaaaaggataccaaattgaagctctgatttgcaagcattttgcaatcgtcactcaagccatatttgtcttttgaaatcagaatttatggaggacttgtagccttaaaatctaacaggagaagaagttgacagaatcgttgatgatatttaactcaaatttcatagcaagtattttgtgtattgccagatcagaacctctcaggttatcataaatagggcttgactattttattaatagcttggttggtgtagtagtccattctcacattgctatgaagaaatacctgagataaagtaaggaaaagaaaagaaaagatgtttaagtggctcatggttctgtaggctgtacaggcagcatggcagcatctgcttctgaggaggcctcagggagctttgactcatggcagaaggcaaagcaggagcaggcacttcacatggggaaagcaggagcaaagagaggggaagagaggtgccacacattttaaaatgaccagatctcatgagaactcactcactgttgtgaggaaagtaccaagaggatggcactaaaccattcatgagaactccgcccccatgatttatttaatcacctcccaccaggcctgacctccaacactgggggttacatttcaacatgagatttgagcagggacacagatccaaatatcagttggctggctagcaacctatggcttcgtggctttttaggatacctgttttataaacacacacccctgctttcacctctaccactactaccatttcgttttgcatacaaaagaataaagcctagtttatcacagcgatttcacaattagcaccacagatgagactcatctttttttttttaactcctttgtttgaaagatgagccaactaaagctaaaaaagtgacttgtgaaaggtgatacaaatccttagaggttcagccaagttccaaattctaatctttcaaaatccatcccagctatttccaccatcttatccaaacaaatccaactaatcaagttgctggtataatgctagtgtttattaatcatgagggctctccttctgtgtattgttctcagggaccttatgaataaaaatgctggttctcaaggggagtgagatatgttgagctaggtgtgctgggctgtgttcagcaccctgtcagcagtcctaatagagatactatcatgaccccctccctgctttataaattaagaaaccaagacttaataggctaactaactatctcagaccacacaatagtaagtcatggagtttccttgtaatcccatcttattgatgccagactctatacagtgctgcctcccttgtctcatgctagaacacatataaatggtgcctgcacatttacaaaaattcatccattggctcatccaatgttcttttcatttctccttttttttttttttttttttttttccggtcagggtaagggtctaggataaagggtggatgcagtgatttgtagtttctctgttttttgctggctggccacattctatagcaagctgatctcaacgagccctacttgggagagctgcttggagtgtgtaccaagctggggcagccatagcctttgattaagaggataaaaaggcatctctggttcctgtggttttttttttttctttgcttttgttcttgtccacaggagtggtggggatggatactgaagaggctcagtaggctgaatgtgaagaaagttgaagaaagcccctctgttatctaaggaataaaaatcacatgtcagaagtttacaaatggaaatttgagcagaacggtagagaattccaaggctccttatactctttctaatcagcagttacaaagcatagtccagcaaacttaaatgccagcatatcaaaactccctgtcttatcataccctttgagaattcctaatctgaaaatctgaaattcaaaatgctccaaaatcccaaactttttgagtgctgacataatgatgaaaggaaatgctaattagagcatttggattttcagattagggatgctcaatgagtaaatataatgcaaatatttaaaaaaaaaaaaatcggccgggtgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagggagactccgtctcaaaaaaaaaaaaaaaaaaaaaaaaaaaaaatcaaaaatctgaaactcttctggtcctgagcttttcagataagggatactcaatttgtagtgtacgtaagacatacagcagggacaagaaaaatgaaagcaagcaagtttacaatttgtttccccttaacaattaagaaaaaaattaaactctatcaacataattattcacctttattaagcagtcaacattttcaggcagaactagtttgtaatttgacatattcacccgttcattcaagaagtatatagtaactatataacacaataagtaagagatgttttcagccaacttaaaattcaaatacaaggaagagacatgttaaaagctgatttataatgaagaggcataagtgctggaatagagatatccataaaatgatttgggaatgtaaagggggaaataattatttgtaaaaatgttggccaaggttttgcagaggaattgacagttgagttgggttttgtggaatgagcagtcatcttccagaagatgaatgggataactctaaagcagatgaaacccattgtgtgaaagcttgacgttgcaaaaagacgtgatccatggaaggaaaggtagatagttcaaagtagtggggtgatgtcaaggagtggtatgacaaaggaggctaagtgctggccttggaaatgtagttgagattataaaaggttcataccaaaatgtgaccaatttcaaattccaatctcaatatgtgttttattataaatcagtgagattaattttctgtggttcatcattaaaaaaatactttgcaatagtgttaaacaaggttaggtaaaatcaaaagttgttccaaaattatcttggatctgggtagacatttgtaatacaatcttgaaagcataaaatgaaattttgtgatttctcactggattacaaaatcagttggacaatctcataattaaaatgtctatattgttacaaaaggtcaacatgctgtacttattactgtatctggattatatgcccactgtggttattcagcgggctatagcagaacgttacaaagtttcttattattgttgtttgcttctgcttttcctaccctctacccacaggactaaagggtttttgtttgtttgcttcctatatttatttatttccccaccccatggaactaagatggctttatcaaccctaacaatgaaaagtctcagtgatttaaacaacacattcattctcacttacattcgtgtccattacgggttaactaggaacttcactccccactgtccttgctccgacatacagcctgatggaaacttcaccatctgggccactacaagttgcagaagcaattaaaatagaacgtggggagaatcatgatctttcttattaaaggctagctgtaagggtaataaatgttacccttgctggtatttcattggctaaaatatatcacgtggttttcccttcttttaaaagagactaaggcagtacagtcctacagtgtgtcttgagggaaggtaaccccaattatatggggaccacactaccttgcttgctatgtattagttagcatggtcttttgtcaaagaagcaggaactgggtggcttaaataacagaaatttatttgttcacagttctggaggctagaagtctcagataagggtgcagacatgctcaggttctggtgaggactcttcctggcttgcagatggccccgcttttgttgcattcacacgtgacagaaagagagagttctggtatcttgtcctcttgttttaagtcatcagtttcattggctccaacctcatcacaccatttaaccttaatcattccctatttccaatagtcatttgggaagatgaggcttcagtatgccaagtttagggggacacaattccatccatagcattccacccttggtctccctagatttgtgttcttcttgcataaaaaatacattcattgtatctcaacagttccaaaagtcttaactcattccaacaacagccctaaagtctaaagtccaaactctcatctaaatagtatctaaatcagatatgaatgagactcaatgcatcttagaaaaattctctcctgctgtaacactgtgaaaccagacaagttatatgctttcaaaatacagtgatagacagtcgtagactaaaacttcccattccaaaaggaagaaatgataaagaaggaagggctgacagatctctgtcctctttagctgaaactggcagtgttgttaatgtcatctctattcctggtttcctgatgagatggctgattaagtccatgagtcactcccatgctgtctttatcaaataaatggttgtttaaccatactcatagtgttgtcttcagaacaagctttctcattcatttattcttttttttttcaatatgcatgatatgaggattttccagatcttcaaattctggcttctttttatttaaaacttcctttttcaattcatttttttttttattttttgcattttactataagtagtcaggagaaacaaaaccattctgctatggtatgtgtctcccaaaattaatgtgttgaaaacctaatctccagtgcaaaagtgtggggacttttgagaggtgcttaccctcatgaatgaattaacgccgttataaaagggcttgatggagatagttttgtttcttttttatccctctcacttcccatgatgtgagggcacaagcaacacttccctctggaataaccatcttgggagcagaagcagctctcgttacacgctgaatgccagcaccttggtcttggactcgacaacatatagaactatgagaaatacatttctgtgctttataaattacccaggctcaggtattttgttatagcagcacaaaacacactaagacacatttcttcagccctttgcctaaaaattttctcagccaaatactcaattgcatcacttgtaagttctaccttccacaaaacactggaacacagatcagccaaatccttcgtcactttataacaaggacacctttcctccaatttctaatatttccatctgagacctcatcagaattgcccctaacatctgtatttctataatgcacctcaaagtgcttctagcctctatccactaccagttccaaagtcacttctgtgtgtttagttatttgctacagccacactctacttcttggtaataaaatctgtgtcacttccagggtgcaataacaaaatatcacagattcgatggcttaaacaagagaaatttattttttaacagttctggaagtccaagatcagggtcccagcatggttgagttctggtaagatctctctccatgacttgcaaatgtctactttcttgctatgccctcagatgacagagagaggtttggtatcccttcctcttcttgtaagggcacccttctattggatcagtgcttccctctcatgatctcatttaaccttagtcacctccttaaaggcccgctctccaatatactagcactggactttagggcttcagcttatacattttggtgggacaccattcagtccatgatatattttttatgaagattgactgaatgtaaacttggaaatgacactattgaaattatttggtgcacgtaaaagatggattggtgctataatagcataaatcatattaatcatacagacaaaatattaaactgtgctctagaaattgttagttaacaaagtcaagacttattccccagaatattcctgtttggggtttattatttttttttgtaacttatttcaccaggattctaaaaacgacaagtcagaatggagaagaagtgggagcttgctcggctgtcatgctttctctctcctcccgtccctcttggtttgcagaccctcttggtttgcagaatggaggcagttctgctgacaccctacagattcgcattcgatgagaggccaaccctgaagatggtttcagtgttcttcccaggtctctgctgttcctgtttgggtctaactttagactaagtgacaggcgtgccaccgtttctcaaaaacaggtcatggcaggcccctgtgagttgttctagtttaattgtgtgattaaaattagagaaggggattttattttattttatttttagctcagaacctaactgagtcattggtttgtcctaaagataaattctctttcttttctttctgctgctgatggatttttcagtattttttttccaaactaccgggatatctgtgtgaaagacaggcaaagtttatccatagatttgtttacttattttatgtttaaactgaattatctagtactttggcaaaggacaaattttacagcttctttttttcttttcatgtattgttttctgtttatgctttcatttttctctgagtatttcagttagctggtgctactatgttgttaaataattcatacagaggtagggcatgaccatttatgaagtacttcacatttgtgatgattgaaaaaaaatctgtcttaaatgtctgtatattattgttgaagatgaggctgtagatctctttttcttttggttcattcattttatatatattttatatagaatatatatttaacaaatcgtaatcatacataattatggagagatctctcattctgaactaaagaatggctcccatgcctgaggcaaagtaacagttgggacattatttggccaatttagctgggattaaggagagaaaaaataagcaaaatttacatttcaccaaacaatttccccaattcatctccccaaatactcataatttttctcttttacattttgatcaaatttttacaataaactttttattttagagcacatttaaatttcagaaagttttagatgtacagaattattgcagagagagtacagagagttcctgtgtgcctgacacacccaattgtccaggttgctaacatcttgcaatagtatggtgtcacgattaataaatcaatagtaatacattattattaactaaagctcatactttatacagatttcctcaatttttctctaatatccttttctgttccaggaccccatcctggataccacattacttagccttcctctggttgtgatggtttctcagtctttatttttgaccaccatggcagttttgaggagtcttgattaggaactttatagaatgtcccacagttgagatctgtctgatatttttctcttgatcaaagtagagtaatgtgttttgggaggaaagctacaaaggtaaagtgccattctcattatgtcatatcaagggtacattctgtctacatgacttactgcttatgatattaaccctggtcatctgactgcggtcgggttttcaggtttctcaactgtaaagttattctttttttttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccactgcgcctggctaattttttgtatttttagtagagacggggtttcaccttgttagccaggatggtctcgatctcctgacctcatgatccaccctcctcggcctcccaaagtgctgggattacaggcgtgagccaccgcgcccggccaaagttattctttatcgtcctttccatgatgcatttttttttttttttgaagaaagtcattatatgcaactcacactttaagagtagggagttatgttccatctgattggaggcagagtatttacataaatgatttggaattcttctatatgggagcgttcttctcctccatttatttacctatttaattatttatttatgtcagtatggactcctggatatctatgttatattttgggttccaagttaatactattttatttactttgttgctcaagttgttccagctttggttcctgggagctcttgcacctggctcctgtgtccctttgctatacacccatcattgtggggttttttgctttttgttttaagcactttcttgctttctggaattacagggtatatcacctgtatttcttgtccctatccctagaatcagccatttctttaaagggcactggtttctttaccttgaaaaattatactggacaccaacatctgggtgctggatgtgctcctcttaggccaatttttgatgtgatatgtcccattttctgtttgattaggtgttagctttaatattggctggccattgagaacttgatatctctcccatacagtatggagaagaaatattttgttttattcccatttatgctccatatgaactttaggttttgcctccagatattttgctttatttactaacacctctaaaatcagactcatataactttatttaaaaagccatactttgttttagttcaagagaacagagctatcttctgcagtctgcccaggtgttaggaaaagatcagaaatcaaactgtaattgataactaaatacttgtactgcattttttaaaaaaatgaattaacacaagaagtttgttctttaatttaagatcattatacattaaattgctctaagataattatattttggttttattttcttaaaccctaagttatgatggtctatcttttggtagatccagttgagaaatgtcataccatagtgaaaggcagtgggcttgggatgggcaaattcactggggaaatattatttattatattacaaaaattaccaccatcataagatatattcattttagagtggaaaggaaacttaaaaactctctcctctaactaatttgtcttaattttgaataaaatgacttgcctaagttcattcatttatctagctgccaaacaggatcagaattcacttgtcatgagatgagcaattccatccagattagaagtttaactgttcaagaacttatatatcagttatatatattatattatttatatattgctatatgtattttatatatatataaagtagagaatacacacacacatattgcagagatatgaaactgactgcataaagcattttggagataatatatataacagagaatacacaaacacatgcacgtgcacgcacacacacacacacacacacacacacatatatatatatatatatatagatatattgcagagatatgaaactgactccataaatcattttggtgactgaaggcatggccatctgaattgcatttgctatttttaccttaaattcagtgactagaaccaagaaatgttgaaaagaaattcatctctgcttggaaccaaatgtactaaggagaaattaacttatttaaggaaaaaaaaatacacagctaactaggctgcttttgatgattcaccaagaatacatcctttaaatgataccaaaaaatgaaaataaatgttttctaaagaaagccattaatatgcttgcattgcctttaccctttctagcaatcagccaggaactttggatctaataactcaatttctcattcctatggcttctttctgattcttgggattggtgacagggaaagacaccatggaagctagggcacaccagagacttgaggagattcagatgtcataactgctctttaatttcttggaacagccttccttgcttcctggagtccccacagaaagcagtggggcagccacctggtgacccctttatctgaaggtgaaggtgggtaaagaatgcccattttgagcttccaaaatcagcctttgtcttcctggtgtttcagactctaagatgaggatgcagaaagagaaggaaaggaagtacagcctccttagaaggcagagagagaatctctgcttttctaagcatcttcctattgcgttgctgattagaattttatagggaacataaagtctgaaacccttactctccacatttgcctagtcagggctgtttctcttggctttgcactcaattattcaaaagcagacatcactaagaaactcaggaggtgagcccatggaagccagggaggctgacagtcagcttgtagtgtgcagtgtagcaagcaaggcttcacgtcacgattgcatgagaaagccatgcttacaggtcctctctccattcggctttagtggttgcacgtgtccatcagcttgtggctgagcgcaaggaagcatatagctttcaatggggacacaaatgttctcaaaagtgtgtttaactcaccttcaatcatacatcatttacgcacccagggcgttgaatctggggaacatgaacagacagagatgacagaaagaaaattggtatcaaaaagaaaagattttatttaagttatgttttgattgttgttttctttgttgaagatttgaaactgctttatgagtgggagaatgaacagaatacttgaagagagatatgaatacagaagtcgcttttggtaaaaataaggttttttactggcatttacaaatttttattagcagaattttaagtcattcacataggccccactactgcaaagaagctaatatttctgattcctttaaaaactatatttggacaaaccaaaagaacatgaatcagaatctcaatgtaggagggaatgttatttggcaacctgctgaccctagagaacttctttttgagaggacacttttttttcttatctctgaatataatctgattagctctcatcatttaattcaacagagtaacatacagccaaaaaaaaaaaaaaaaacaagtaatcagtgaaaggaaaacataacatgagttttaccaaatatctggtccctaaataaattcttccaaaataatgcagcagtaaatacgacctaaggaaacgtgtaacgacattttgccaggggtgggacagaacaacatggcctaatcatgaaaggtcacctacccaagtccgccaaatagcaagttacctaaagaagtcatttgagaacaaagtatttttatctatttgtttaaagaggatattggactacaggaaaggatctcaacctctttttttcctttcttgaaccaaatgctttgaaaaatgaccgtcaaacaagatgcatttattacattatggttagttaattttctcaacttatcaattacaggtaaatgtaactgtcaaccagaattttttatcagcatgagatagctcctattcatacacggagctgcttttattccagaagagaatgagggaagtaatgagctactttatttggtctgcccagttatttttattaataaacatatgatttatccatgaaatctgttttaaatgtacaaatgttttctcttagactttttaagatattaaaatttgctctcatgccacatattggtaaataggcaaaatagagttctccgaggtcatttcatcctctgataatcagtgataaattgctcttgtagcctctgccaagaactgtgacggttctgagatttcaccctacttgtaagctaacaagtctgccagtttcatggatgctggcagaagccataagcctcctgggtcagagacagagggcagttttgtacgcacagcaaggaatgtagccagaatattggcatttgtgccagttctccaagccccaactatttttttttttcttgagacagagtctcacactctgtcactcaggctggagtgcagtggcatgatcacggctttctgcagccttgacctcctgggctcaagcaatccttccacttcaagccccaagagtagctggaactacaggtgtacgcctccacacccagctatttttttatattttgtagagacagggtcttgccatgttgcccaggctggtcttaaactcccgagctgaagtaatccggacaccttggcctcccaaagtgctgtgattatttgcatgagccatcaccaagctccagcttttacagagaaacacgagaaaagccagatcatacctgtgtgcatagtgaggtgaattacaagagaaaaaaaaaaaaacctgtgtataaaaagaccgaatcttttttaatggatagtacgcatgcctgctcctttgctccagaacagataatatcttgatcatccaagtctgtaataaaacctgtgctttgctatggtagaaggcactatctttgtcttctatggctgtttgctatgcaatttgctctgaaaagatagtccagaccaaaagcagtcagtgcctctgcttgcaaaatgtgcagcaacaaaggagaagcctagagaattgtctcccaacagcttccttatcgataagtgtagtctacattggcaaatattttcattggcatagaaaacacatcagatttattaccaaggaaatgaagttaaaataatgtatttgtcatctgccatgtcccagctactttactaggtactagggttgcagtggtgagagcattctggaaaatctaatggggtacaaagaaatggtaaaataatttctcacatccacttctaaacctccttcttccttccatccttccttccttcctactttatttttttatcctttctttctcccttcctcccttcttcccttctttccttttttcttcctcctcctgtcctatcaatctatttatatttatttatgaaaaaccttctatttatatacccagtactgttgtaggtgctgacaacatagaaataaattagacaaggtaccttctcccttcatggagattgaatcatggtaattagctttcatgcaggtgatgtcacaagactacggcagatggaaacacagagcattacccaaaagaatctacaggggcaaccaccaaacagtccctcatgtccaccgtgccctttgagaagagagaagagaagtgatcgcatccaaaattctgccagcaggcaagggaatgttcccatatgccttttaaactggactagacggcgtgttgttcgggaacatctctattatagtagtcctgctcggagtttgggaaagaattgttcaaatcatacgggaggcagttctttgaaagccccagctaatgttaagagaaaacagatttacaatccgaggccaaacttaataatacataacgaattgcagctctgtttgggaatccccctaggtaccgttcctaaggatttcgagtgtttaattgaaatttcttctgggacagtagtaatcattcacttaagcattatatttatatttgtgcatgaagaaaggaagtcaaagggctaatagaccgactgagtagaatggctgctttcagctgtgggccattgacgagccggcaattctccaaggggcgcttatcctggcgacagcttgcttaggttgtcctccagggactgtgggaggaggacagcactgtgactgacagctgtttcttcctagactgagatagaatacatgatcccagtgtagcccgtttaatcaaactgtttcagtctacaggattaaaaaacctcaagatggaaaagtattccggtagagatttattcttagaaaggctattctttttaccctgatggttaacatagagtgttttaaccccaggggacttgtgccttcatgatttccaaagcaacattaatgagtaactattattctaggagtatttcagccactaaaattggcaatggagtcaaaatgaaagtcatgccgttacaataatactgccttcttggcatcgtcagatttcctatcttctttcagttcgtgatctcagagaattgcattaacttcaactagtttattgcatattctgtaagtcttaagagttgaccccgttgttgtttgctggtttttacaggtacaattttcacctacatacacagaaatacttaaattcaactggtttagtttcttcacagctatattgaggtatagtttacaaattataaaattcccccacttcaagtgtacaattgaattaactttagtaaatttctaagctgttatattctgagttgcgttgccacaatccaattttggaccactgccatcactccaaaaggattgctcatgctcacttgctcccaccttcagctccgggcatcaactggttcaacttcaacctcaccttgtcatggttggtgcacgtcatctaatagatctaggtgtagtttcctcagatgtgagctatagtctgtatgtctgaatacagtagctattattatccttattttataaatgcaaaaactgggatttatagagaccaggaaatatacccaaggtcccagagctaagaagctacagaatttgaacttagtttattctgactccaaagcctctttgcagtgtgccacaccatccctcctagtctgagagtgagctaattgtggatcctactagaaactagagattactcaaaaattattcttgttattattgtgtgcatgtatatatagatacatagtaattctcttttcttatttctcaattatcttattgtaattactatatatacacacacatatactgtatatatacatgatctgtatatgtatatgtacacacacagaatatgcagtatatgtgtgtgtatatgtaaatatatgtatatagcctgttacttttttaattttggtgattgtgttagtgtttgatgcctaacagtgttctgatactagcttaggtaagagttattttctttcacattaaaaaagttatgctatcatctcttttcttatatacatgaagacatctcatcaaaaattgctgtattgaaagacaatattgcctatattgaaaaattataattttacatattggtcagcaagttatttatgtccagctgaatatttaggaatacttgaatttttcagagtttttaaatttatagtacaaataatcagaaatctaacatgtggcatatcagaatggtgtcaaattatatcaatatggactcatacagattttaatagtcagttgtcaacacgtgatgctccagcaaaaggtggaatagggcagtgagaacttttttggagcttccaaaatctgagtttgagtccctgttcttatactggccactttcatgtccttcccttgggtcacttaatttccctggtcctccttgtttgatacaaaaatgagtctgactaaatggcagttattggcatcagccaactcacaataggaagtcaataatttattttttggatcacttagttgtatacctttcctataaaacacaacttcaaacaattcaatactttctgcatcatttgggataaattgaagtgatggaattatgaaaacccatatacatatatatgtgtgtgtgtgtgtgtgtgtgtgtgtgtgtgtatgtatgtcccatatatatggggtatatgtatatatcctatctatatatatacaagatatatatatcctatccatatatatatggaatatatagacaacctatccatatatatgggatatatatagatatatatatgggatatatatatatggatatatatatatgggatacatatgtggatatatatatatgggatacgtatatggatatatatatgggatacatatatggatatatatatatgggatacatatatggatatatatatatgggatatatacatatggatatatatatatgggatatatacatatggatatatatatatgggatatatacatatggatatatatatgggatatatacatatggatatatatatgggatatatacatatggatatatatatgggatgtatacatatggatatatatatatgggatgtatacatatggatatatatatgggatatatacatatggatatatatatgggatatatacatatggatatatatatggggtatatacatatggatatatatatggattatatacatatggatatatatatatgggatatatacatatggatatatatatatgggatatatacatatggatatatatatgggatatatacatatggatatatatatatgggatatatacatatggatatatatatgggatatatacatatggattatatatatatgggatatatacatatgggatatatatggatatatatatatgggatatatatacataagatcaaccacaattaatttcttattcccatgaaatttgaaatcaataatgctgatgactaggtgcatctcctccaggtagtgactgacaacaaagcgtctttcttctggtgacaccaccatcttgaagccacacttgcatcatcagggaaagagaacatggagaaatttcataaggtttttaagttctcttgtttttaaatgacacacattacttctgcttcacaagaactagacacatggcctgacctagatgctatgggttcactgagcaatagctcctgacagggcatagccactttgcagtgacagttctatggaaagggaagcactaattccggtggacagttagttctctctgttgctcaggctaagtctcaaagcagaacatatagaggtgatgaaaaccggaagctgaatggagccttggacatcggagctatttgatattgggggacaaggaatggtgaataacttggtttatttgcctaataatgaagggatggtcctaattagctgttttcaaaagtttgctggccccaagtcattatttaaggggcagctgtaatcaggtcctcacctgctggaggctatcgcagagtccccagggatctgggaacaaaaacaaaaaaacaaaaaaaaaaataaaaccacaatttcaaaccactggatgaaattgctttaggagtccctctctcaacattctctgatttgaggtctttaatatctctctctcctgttttattttttaataaaagtgtatttaagtgatgagtgaagaaaatctagagcaaagactgaagactggcaacttaaaagcctatttaatttggactgtcctttttcaaattttattttttgctatcatttatcaataggtaaatatcacataaaatctagattttaggcttttctagaaacactgcaagatctagcaacataagctccaccttcttaaatgacagaagtctactggagctgaatagcagctgcttttcccaaagggacctgcactctttcctatttttccacaggcccccactgttccttattgccttctacaatggctgagttagcttctttatgttaactgccttgattttgtaagtcatttgaatttgcaaaatgtgatctaatgaaaaattgcgtgaccttgttgaaatttttatctttttcaggtaagcagataattattaaaaacttatgaggaagaataaattgagtctttgattattcttcaatctattttgcatagaaagttttgccacgtgatcctcccctttttggaagacatttatttgtaaaataaatttacaataattgttctcccccattatctgtgttattccctttagcctttgggcttacaggattttaggcttctgctccgaattaatttacgtagtgattttctgttatcagacaaaggatctacatagcaacaatacatatgagaaaagagatgatagcacaatttttataaaaaatttggcaatcttcttcttagagttgtagctaataacgtctttgtgaggttgtgtagtgaaactctgacatatgtcatggttgtcaaagtcggcattaacgcaaaataataagttatttaatataggattcaactttattattttttcaagtaagctgtctatcaccaagttctgaagtggatttctttaaagtctccctgtctccagagaaaaaggggaaaaggcaatgtgtccctggacaggatctatgactcattacgtcaatcaaaccccacttcagaagggaataaagagatttgtatctcaaagcggcgcataacgactcctcggcttttcatttcatatttatgagcggtttactttgaagtgtttatcagccaatgcgcagaaacatgagggaggcttgcccgaaaccatactcatgcctctaatctgtgaaatgctttctgagcagactggctcatcagcgcatgccatgcaaaaataaatacataaataaactttttgttatttgaggtcttggagccatgtctttatataaactataaaaaagggataaatggtgctgaacgttttgaaattggtgtaacacaggaaacttgactctgtaatgtgcaggggggtggtgggggtgcagaaagtttattgcttgaaataaaacctggtagaaagcagacaagtaaaaatacacaaatttttacatacatttctcatctgatctaaggctttgggtccgtccaagtgaccacatgatggcagtgaatagtatatggtgttttttgttgttgttgttgtttttttttttttttttttttttttgagacggagtctcgctctgtcgcccaggctggagtgcagtggcgggatctcggctcactgcaagctccgcctcccgggttcacgccattctcctgcctcagcctcccatgtagctgggacaacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgtatatggtgttttatttaaaagaaaatttttttggagatgttattttcggagtggttggagagagagcactgccaagatgttgaaaccaaatgaatgaaatctgttttataatttttatctgtactagtatcccatgcatattgtaaaataaataaatgtgtagaagaaaaatggaagatgaagaagaaagaaacatagaataaagtatacattcttgatgaatggaactacgaccttttctctgctttcagtctaactgggttatacattaagcaaactacctgtgtgtttattgagcaactactacactagatcctgggtttacatgggtaaagaccagccggaactgccaaggcagatctggcgtgatgggagaggatgccaagtcaacaagtcagtgtccttatggtgtcacagttcctgagaccaagggccactcaattctctacttctttaaattagatctcttgcttttgtgctcatggctcactgattttatccaaaaagaatgtttaaaggcataagcctaattcactttaataatccacaaattaggtcagtgatttgaacagttgttgggagaaaataaaatttaggagtccataaaccattgtcttataaaaaacagtttcatttctgtttgccctttttctatatattctctacaagctttcccttcaccccctcccctaaaccctcccccatcttccagtattctaatgggaaaggggctttatgtctagtccctggctagagatagttaatcatagaagtttaaagctgaaagtctttatattctagaaagcatggcttgtgagagagtatatagcctttgaagtcaaaaaagagacatgtttgaattgaagtttccccacctactcgttatgtggccttaggaatattatttctttcttttgagctgtatgccttcttcatagttttgttctgatatttttcatgtaaagtgtttataagtctgacacataacacacgatcaataaatattaagccagaaatgtttgttgaatgaagaaatgaatgaatgatgccatccttttcatcccatccttttactttcaaaagaatcggaagcctcaggggattaaggacacatatttgccattgagtacaggctctctaaatgacaaagaaatagttacctctcccctacgctacccctgccaatgtaggtggggtgaaaataaaccatcaggaataagatacgatattgtaattgcatatttctgtttatcttacttattagcttatgagatccccaaaagcaaggacacagattttctgtctgtttccgtagttggttcttagcacacctttctgtctatttgtggagccaaattgaacgaagcagtctgaaacacgtacagtggtgcccgtgggtctgtgtgtgcagtataatggcaactattcttggggagacttaagtacaaagaagcatacgacctgccagatatgcaggaaagtcaaccaaagcctttgtggggtgtgtttctgataatgctgatggatagactttctgaaaggaccattctgattttcttatccgaatggagattgaacacaccgcgcacaagagaaagtgatttggagccaattctgagagagaggaagttgaagcaagaaataagtgtttgaaataataatctgctgctgatccctaaataatctgaaatgagagcacaggaattaatgaggctcctaaccccttgtgacacaggaatagcagacttgtgccagtgacacagcaatttccctggtggtctgctcatgagccgcgagggagcaaacaaaaccattgtctcctttgaaagcaaagctattttaataagggaaatgtggcttctcagatgaaagctcacaaagtgccagatagtgcaaatgtttttcataaagcacctggaaaacctcaccaaagagaaacatctcaatagagaacaattgtcagattggatttaattgcccgtcattctagagatggagcagttttgctgagaaaagttggcattttaaaaaagaagcaatctaaaagaaatgacccttaattttttttttttttttttaaagctaggaagatggctgggtgccgtggctcacacctgtaatcctagcactttgggaggccgaggcgggcagatcacctgaggtcaggagttcaagaccaccctggccaacacggtgaaaccccgtccctactaaaatacaaaaattagctgggcatgatggcgggtgcctgtaatcccagctactcgggaggctgagacaggagaatcgtttgaacccgggagacggtgtttgcagtgagctgagatggagatggggccactgcactccagcctgggtggctgagcgagactccatctcaaaaaaaaaaaaaaaaaaaaaaaaaaaaaaaaaattaaaattaaaaaaaaggcaggaagatgcaagagggttgcatctctattctcagctctgtcagagatatgctttgtgacttctggaaagcccagaaacctccctgttttttgattctcagagaaggtaattcttgtcacttcccatggaggatgttgcatcctaaggcagtgggctttgaaaaactctttgataaacctcctctcggaatgctaaatagtagaagatagcagagtcactggattctgggagatattttgaaaaaaatgaggaaaggcaaggaaagttgcttgcaatgactaaacagttattgagccctgggtatgccttgccagaacccctgagaggaggccaggcactgttgcttcacctctgataatggccaaatggccagagtatttgatgtttatgcaggggagtacactgtttgtgcattccaggatgatatcaataatagaacacagtacccatttctcataagaatcctttgaggaggttggtgttttgattcagagtgattttggccttccatacacatgagaattttatggaggaagcatggctgcattatacctttcatgggccttaggcatgtttgtcttcatcaacccctttctccataaaaagacatttaaaattatatttctccactgccttaatatgaaagcaaatgtattgcttttgtatattaaaacattctctctgacctaaaagtttatttcttttgattttcatagaacttaaagcttttccgtgggtgcctgaaagtattgtgggccttataatactgagcctattgtgtccaatggataagttggctctgggaggaaagctttgttcaagtcgacattttttttaaatctaaatgtatgaattccaatattttgaggaaaaaggccttgtcttaaagatgaatatccttatctgaaaatagtagaaatttgtaacgtaatactaattgattactgtggattcagaatttgtagttataacttatacttcaggaataacatggtccacatggagcacagagccctcgttgctttgactttttcccccttatgcaagagccatcctttctttttttttttttttcttgttgcccaggctggagttcagtggcgcaatctcagctcactgcaacctccgcctcccaggttcaagcgattctcctgcctcagcctcccgagtagctgggattacaggcatgtgccaccacacctggctaatttttgtatttttagtagagacgggatctggaactcctgacctcaggtgatcctcccgcctcagcctcccaaagtgctgggattacagatgtgagccactttgcccggccgagccatccttcttaaggacagtgtttccacattgcatttcagattgtcttattttttaaaaactcaatatagtcaccacaatttaattattttatgtgaatcaaggcaaggctagtgaatgatgacttgagtgctatgtgtgtacgataataaatttgttctcatatgtttttgaagtttattaaatttcaagtagtcctttgattctgttcttcagttgtactaaaacgcctggtctatgcattctctcactcttccagatgttgcttctaagcctccagcacctcctcctcatcttcaatcagaaacgaatttcgaaaccacatctaccatccacacactcccagcttctgtgcccacatactccaccttattgcctatcactctaagtgaaaaacttctactgttatcccaggtaaagcgttcacctgtgtgcaacatcacggtcccactggtctattagaggttgctccaggaattctacctgcctgtctcctaaatgaaccattctttgattccttctcgcacaaaaacctgctgttcttttccctgacttacattcacccacttcttctaccagttactgccacattcctttactacaatttgcagccaatctcagaagagctgtctatcacattgcttctgattactctcccccattttctcataaacacaatccaatcagactttcacatatacccctccacataattgctcttgccaaggtcaccaatgattactatgttgctacatcataattgtccattctcagttctcttaatgacccatcagcaacatttgcaacagttaatcactccctcctctttgacatactttcttcatttagattccattctaccatacactcgtggctttcctcccactgcacaggtcactcctttcttctttttttttttctgtttatagttatttgacccttgtggtcttatggtccctctttccatactcctttactgctttctcttcttcactccaagctcttaataggaaagtgacccggggctcaattcttgatattcttttctatctacatttattccaaactggggattttctccagttccacaatgttaaatagtatgtacatggcaatgactcccaaatctgtatctcgtatatcagacctgtctcatatattcagctaactgatcagcattttcacttatatgtcaaacacccaaagtaaactcaacatctcgaagactgaaattctgatctgcacacacacacacacacacacacacacacacacacacacacacacacaccctgctgtttttacagcctaccccatctcaatagatagtaactctctcttagttttcaatccaaaaatgatgtcacttctaacccctctgtttctaccacaccctgcgtgtaatccatcagcaaatttcaagactgcccaccccgacactctttccatccggacgggctgtaatcgtctttcccatgcaatcttaaagtgtattttaagtggtctccttgattcggttctgccacattcctttactactctttgcagcaaatctcagaagagcaatccttttaaaatgtaaattagatgatgtcatctttccctcccaaaacaatgcaatggctatttcactgaaaccaaggtccttaaaatcacctccaaagccacacaggacccaactgtctccttaactctctgatgtcttctcttaaggttgtaactttgctgccttcattccagccacaaagtcccccttgctcttcctagaatgtgccaggcatgctccttcctgagatctttgcaccattggcttcctcatgcagcaggtattggaaagattaaatttcccaatttacttaagtagtttttttaaagtcactttctcactgagctttcctggatcagattattcaaagtattcatgaatggccttgcactcttctactttctattttttttttcttttcatagtacctaccaccttttaagatattacatacttaagtttaattagattccatttgttaatttttgcttttgttgcgattgctaggggcatcgctgtcacgaaacctttgccagttcttacgtccagaatgatattgcctaggttgccttccagggattttatagttttgggttttacattcaagtctttagtccatattgagttgatttttgtatgtggtgtaaggaagaggtctagtttcaatcttctgatatgactagccagttatcccagcaccatttacaccatggaatactatgcagccataaaaaggaatgagatcatatgagccctttgcaggatcatggatagagctagagaccatcatccttagcaaactaagacaggaacaaaaagccaaataccgcattttctcacatataaatgggagccaaacagtgagaacacatgaacacaaaaaagggaacgacagacactggggtctacctcagggtggagagtgggaggagcgaggagcagacaaaagaactactgggcactaggcttagtatctgggtgatgaagaaatctgtacaacaaaccccggtgatacaagtttactcaaacaagaaacctgcacatgtactgctcaacctaaaataaaagtttttaaaaaattaaacccattatatccaagtacttactgtagataaggcactgtatcgccctaaaaaaggtgtcagatacttagacattatgttaactgtttaatgtctgtttatctcagccaaaatagaagctctgtaagggcttgatctactttgtttgctgatacatttcaagcccttagaaccaggcttagcatttagtaagcaccaataatattggtcaaatgagttaatggatgtactagtgaataaggctctttgcctttgttcttccggcccagggtcgcattcttttaggttctatgtctcttctcatgtattcccagctcccatatggtaggctgtctttctgctcatggtatcctccatttatggtgtgagataatgacataacaatgtatgttaagaatgaatattcattacaggaaaaagaacctgaaaatttctcctactggttctgctgctgtttctactacaattattactctgcacaattttctaaaatattttattcaggaccccctattctggttacactgctaagtgttttctagtcacagataacttttatctctataggcttatgaggataggtattattaagcatgtttcatgaatgagaagactggagattgggagtggaagtttaattagagtgcgtactatcaaaccataagtagtggaataggaattcaaactctgggctactcgcttctacaatattcttaaccacagatgtacacagtctctcacctagggaacaaagtgcgtgggtttcctgacagtatatcagtcatattgtgatttggttatgtgtacttttgctccataactttagcccaaattgaatggaacttgaaaagacatacgaatgggggtatttctatgtagtgtaattgaacatatgagcagggacatgctgagtgatgtgacataatagaaaacattatgatatcacaaataatttaaagtatggaactaggatagacttatccaaggtttttattttcaaaatttttaaattgatttttttaaggaaagtcatagaaaagtacagagaagaaagcgagcaatgagtatcacttgtaattaacgagtgttaatattttgtcaaatttacctcaaatcctctttttttcctaattgcattcttctccctccatctccagaaataattgcgattaagaatttgatttatatttttctagtccaaacttatctctttgctatgtatgtgtctataaacaacatatagcactcattgtatctttcttattgtgtttttgtaactggacatttgtaatttgacatctatccctcttaagaccaaggctattatttctaataattctctactcctaaaattgccactgtgtggcaaatgatggccagagttaaaggccttaagttctttttgtcactttttcaggagacttttttcatctaaacatcttttgtaataagcagtatatgaacagtattatttagcacatttaactctgtcaacagttttcagtggatagtgtgaagaccttttttaaaaagtcataactcgatgcctctggatatgctgaaatcctcatgaagctgttgtctctattatatgtgaatacatccattaagtgttgatagtaatggttgtaaggtcctttggtttatagctctaaccacatagggaatgatatattttagtggagaattagtctctggcattgctgaaactgattacttatagcaccactcaccccatgtatataacaagtgctgatggtgtagtatttcagctgtgatgacataagaattttttttaaccttattgagccagcttctgccttctattcttgaactcctttttgactttggctgtatgtgactcaacaactctctgtaagtcaacagctgccagatgctaagtgtaattaaggctttacatgtatttgtaacctacgacatgtgtttggaacacaggaagcaaggtaggaaaggaagaaaaggaaaactcttgactcagtttcaattatcctctccctgcttaatggatgctaacacgcactaggaagctatggtcttgccattttttataagctcaatggctggaggcttagtatggttttagacaagtatctacatcctaactgtaattggtgatgaggcagttgatttaaaagaattcttttacaaacaagagtatatcattaacatttcccctcaaatatttgtggtctaatatacggtgtgattacttactgaggcaaagtatctgctatacatatattcacctgctgatagactgtgatccatccatctcactagatgtcagaatgtagatgagttaattaactcttgagatctagaataattcttctgtgataggaaagtcaaagtgttttcaaaacatcaagcacatgatggaaataggcaccttggtgagtgctgtaaatgcaagtgtcatgtgccttttggttaatttcagtaatgttagcagcgtctctactgatatatcatactttttgtatttttatggaaaagtaagatattgcattacttaatggaataaacattaaatatatctaaatatatgcagcttaactaaaaactgcattttatttacattgtggcagaataagctgaaaatagaaccccatttcattgcttatcattttgtagttttatatttactattaagagtacaataataataatagtaacatgaataataatagctaatatcgatcgacttattggtgtgtgtgtgtttgttacacacacctacacacgtatttattgcatgtgaccacaagatgcaagtactattattcttccattttacaggtgagaaaatggaaacagaagtattaaatagcttgatcagaacaacaacaacaaaacagtcctcacagcaagtaagagaactctccatccaggcagatttaaaacaaaatagaagaagaaataaaaataagcaaaagtcagaaatctgagcattgaattgttagcccacagtaggttttcattgtgagcaaagactgctaccagaactgcaattgggaaatgacctgaggcttagagcaacaaggacatgaaactgagatttctgtagtaagccaggaaacctaaaaagaggtatgtgttcaacactaccacatgcacattgcctgtgtagaatcaaatacaaattttttagccggcaagaatcccagtttaggcctgtgtgatttttgaaaattaaaataaaccaacatatctaaaattaaatataattaagtatgtaaggatgggcacggtggctcacgcctgtaattccagcactttgggaggtcgaggcaggcggatcacaaggtcaggaggtcaagaccatcctggttaacacggtgaaaccctgtctctactaaaaatacaaaaaattaactgggcatggtggtggacgcctgtagtcccagctactcgggaggctgaggcaggagaatggtgtgaacccaggaggtggagcttgcagtgagacgagattgggccattgtactccagcctgggcaaccaagcgagactccatctcaaaaaaaaaaaaaaaagaaaagaaaaagaaaaaagagaaaaaggaaacaaaccttcatagttaagtgtgagcaagtccataaataattgattttgacctttaaagttttaaaacattagaatttatcatttacatactattaactatgtataatagaaaaactaaacaacaattgaaaagcaatatcagttttataaatgaaatgcaaattgttgaaattaaaaaaagtttagtacataacagtgaatatgagttcaagcacaattaaagaaataataagagtaatcataagaaatcagcaacagactgcacagagagaaaagacataaaaatacaacagaagcatttagagagaaaaagggtagcgtaagatcagctgagtttaattggtgaaaagaatagagtatggaagtgaataaatatataaaagaggcaatgactgagactttttttatattaagaaatcatgaatttacagaaatagaggcacaaaatatatcaagtaagattagaatgctaaatagactggtacaacatacgtattgtagtccttagagcaccactaaaaaatctgtgaaaagatagacaaaaagcctagacaaaatttaaatgaaaattttaaataatttattaactgacaacaattaggcaaagaaatacagagggaggaaaatgcagggagcacaaacaggaaaacataaataataaacctaaatccagtcatatcaataattacattaaatataaattgactatcataccaattaaaagacagagattgtcagattacttaaataacaagacctaattatatgctggctacaaaaggcatatgtcaaatgtaaagacaacagaaaagttgaaagtaaataaatggaaatagatgagtcacacgtttattgcttacaataaaaataagaaagctggcttgactgctttatgtaaggcaaaatagactttaagatcacgagaattacaagagaaaaagatgagcatttcaaattgataaaagggtcaatttattctagggatataaaagtctatgtgcctaataacatagttttacagcgagaaagagaaggaataaaagacaaagcaaaattaacaaaaataaaggaggaaagagaaaaaaaaactacagatttaactcttttctcagtaactgaaaaaatatctagacagaaatataggatatagagaatttgaaaaacgttgttgaccaccttgacctaatagacatttataggacactacacacgagaattctcgtatcacattatttttcaaggaaaaactctgcaatatattctatatgttgtgctataaaataagtctcaataagtttcaagatggaaatcctggagagtttgttttctgtccaccaagcatgtaatttagaaatcggtatcaatcagacaagtcccagatatttggaagtaaaattacacacttctaagtaacctgtgggtcaaagaagtagatgagaaatttaaaaattttggaactgaatgatttgcatgcacaatacattcaaattttgggggtacagataaagaggaaaatattataggtttgcaaatttacttaagaaataaagaaaatatttcaaatcagtggtctacatttctaccgcaagaacctagagaaggatgagaaaaaaaaaactcaaattaagtagaaataaataagataagtgcagaaattagggaaatggaaaataaacaatacaataaattaaagccaacagctgtttgaaaaatcgataaaataaaactccagtaagaatgatcaatttaaaaaaagaaaggatccctcatatcaaaaatgaaagaaagaatactgttagagatttacacatattaaaaaaagtcataaatgtttgtgaaattgacaaattccctgtaaaacacaattaatattagaaagcatatattacctcagaagtctttattagggtcaccatatattgatgataaaatgttcaatccatcagaaagctataatgctaagcttacaacaggtacctataaaataaccttaaatagacacagagcaaacattgacaaaacagtattgagaaacacccatcacagtaagaaatttcaatatgtatcttacaattatagatgggacacaccaacagcaaattagtagtaatgcataaaatgtatagcatgaaatgcttataataataaagaagaatggctgaacattaaagacataaaggatcaaattttgaaggtatagaaaacaacaattgaatgaacttaaagaaagaaataatttgtatacataagggtagaaattgataaactaaaaacatacacagacagtaggtagagtcagaaaaacagaattttttttcttttgaaagaaaaaaaattttattggtgaaaccaattcagttaagaaaaagaaggcacaaataaatattatgaggaatgaaaataaagacagtattctacaaacctagcagaaatttttaaaaagcctaaacaatacatggataacctattgtatttatgtcaacctatttgaaagcataaatgaaatgggcacattcctagaaaatttattgttcctaaattttctaaatcaactcatgacaaaatagaaaatagtaataattctatgtaaagaaataaagcaagtttcttcctctgtagactgatgatcatcataatagctacatttgttttttggttattctgatgcaggcaacaatctaagcattttccgctgctttgtgtcattcagtaccctcctccaccctgtgaaagtaggtgctatttttatgtcccttttataaatgaagtcagcagaagtaattaattctaagactatctggtcgacaagtatttttaaaacagacattctaactcctgattttcttaaccttaggctatatggtgactgttttgtagggctgcttttttaattaaaaggggaaactatataaaagcatttaggacagtgcttgacacattttgaagccttcagtaactgtaaactaacctagtagccttgcagctaactcactactctctctttccctctctttctctgatgaaaaaaattgtttatggaggaagagtctcatatagtcaggtgaatgtacatgtttgtaatgctctcacataggataactgattggtatagtttttaatactgaaattgatttttaatttcgttggaattttcatcagcagaaaaccatctccaactagccaggctcctggacatttcatttttatttatgaactgccagtttttcagcagaacccttttgttgtggctgattttgggttttccaaattgggctttgttcagattggaatgggaaaatgccaccacatcagaggagaatgccaccttcacctttttctttgaaagttataagcttacaggaaaacctaggatactggaaactcttctgtcttcactagccatcttggtgtttccttgatttagtatgtgtttattaacattggaatggttctagttacaaattgtaaatgtttggacacatcagaagatatttatatagattaaaataatgagtctaaaagtttacaaatatcaaaatatcaatctcttaggtgtcatatattaaaaaatgtaattcttaaagcacacttctgaaatataaatatttggcttaaacttttatgaataataatgcatgtacacttactctgttgttttaagccagaggattttgggtgaacagttttatcaacatttgggaaaatatctaaatatgtaaaaacagatgaactttaaaaggtcattaaaagagagtttatgtgaagacttttaggatatacaagcataaaacattagtattcataaatacttcctctggtgccttccaaaatggtgatcattaaatatgtaaatatgtaggcttttatatttgtataaaaataatattttagataatgttgataacggttttaaaccgattattttgtatggctcacacatatctacaattggccaacatttaaatataacatatttaaatgcgagataacaatttggcatttcattttgatttgtcaaacagaaataaaattatattttatcacttacaactgctacatttttcttgataactttctatgggcaaaaacttaaggcatcatgtcaaatcacttcaatttctttgataaaaagtactataacgttataatatctatctttttcttaaatatctgctagaaaaaattgtactccatattcattcttgactttaaaatgtacgctctaacatttgcacaagaaaaatgacccatgtttgtttacaagggattctctttgttttaggatgaatgattttagaaaaaggccgcttaaaaaaggaatcaatattcaaaagaacaaatgtttcaaattaaatagtaaaaataatttattgcaactgtatcttgaaaaaaataaacctaattatcaaaactatatttcagtttgtttaatttcatttactattagaactaggcatattttgcatagttcagtttaaatttaatattattcactatttgaatgatgcatattttttttcaaagtgataaagaataacagtttgggggtggggcatatatagtcatgttacagcaaaattgtttgattgtaccacattatatccttccctttaggcttgcattttgcagcaggatcatagagggtcattttttttccaaaaaatacttgatgagttcattaattttcctaagggcttctcattaaccttttatttaaataattatcaagttgagattttcttggtacgcgatatgaccaatgatttttttactatatcctggccaattgaaatattacattatgaaaccctggatcgtatttaaatcttctgttatagtaagcctcttctgacactgagccgatgggaatagtgggatactgtgtcttgacagccaggtggatgtaaaggtgtactttgtgtatactgtgtgtgtattttgacaaggtgaggaagggggtgcagtgaaagagcgctgcttcgtcgcggcagggcagagttgagattttagaaccctcccctacccccaccccaggcctctgctgatgacaacctcgctgagagggagagagttacctcctaccattcccctcaggtcctcttctgatcatggtggtgaaattatatttaacatttagccttctctgcccccagcaaggagagagggagggctggggataaaagtccgggatccccgcgctggtctccacggacaacacttggtcttttaaaattttactctggtgtgtttgtaaaagtgtagggatggggctccttgctacagcaggctgtacttggggcttgttttgtctgctgccgtttccaatttgcaggtttctctagcaccaggtttggaacatatgaggcaaaaataaaccccagggaactcaccaccatgtagttcctgaggctccaggaccctgttaagtctaccttgtcctgtcccatttttcagaaactgcttatgtgatttttgtatgtaatgtccaggggttttagctgtacttagtgggaaaagtagaaaaggggaacactaaatcttggtccagaaccagatgtctgtcaaatcagattttgaagttcccatcgtcgtgaccacactatttctatcttctcttgttaactgacttaattctgttagattttcgttattctgtgacctttttgatgaactattttttttttgcataatttttcttgacttcatgaaaatctgcaacttcccaagctttacaatctaattatagattggcaccatattactttctgctatcagcaagtaattaattacttagacgttgatacggtagttgatgtgagaagagatactaggagaaagtgggcagggatgggtagggattaattttataagtggtcattcgtgacttttcatgttattacaacttttatttctctgtataaaatgacttctcttaaattcagggtgcttgcataacaaacatttagacaatgaaagttttctgtattgcatacagttagcttttatcttcttgcccttgtagtataaaatctgttccaatgctggcattttcagtgctatttgtgtatcctggtattaccatgacatgataattctgacttaactacatatgtgcttttcctagttaaaggttatttcaaagttggtaaaaacttagaaaataaagccatgatcacaatgcaaagacatatctctccttaaaattgcatcccaaatagaattagtgggtcaaagaatgacccttgaattctgttgcaaaatttctctctaaaaaaggcatggaggctgggcgcggtggctcacgcctgtaatcccagcactttgggaagctgaggtgggcagatcacgaggtcaggagatcgagaccatcctggctaacacggtgaaaccccgtctctactaaaaatacaaaaaattagctgggtgtagtggcgggtgcctgtagtcccagctactcgggaggctgaggcaggagaatggcgtgaacccgggaggtggagcttgcagtgagccgagataacgccactgcactccagcctgggcgacagagtgagactccgtctcaaaaaaaaaaaaaaaaaaaaaaaaaaaaaagacgtggagaggatctggattatacactgtggttacgatcaagaaaagacaatttaacgtccaagatatttatcaagagagttattttaagacttgtgttcccctcttttgatcactgaacagtttttagacattaacattctctcccaaccttaaattacactaaaattgctttatgtaaatattatagattgcatgtaatcgtttatctataaaaatattgattctggccttgataatgtaccatggggccacactgggtgagttatcggcaacagccatagagcacatacctgaaataaaatgtattggcacatcatctatatgcacttttatcagtgatatcaggagactggaggcagatagaagataaataatacatatgtattccatgaatactgatatattgtgcctccttgttatctttctgaaagatagtaaagaagaatgaagggttcacggctttccactagaaatcttagcttggagaatcacacaatgagtagtttctctctttcattcaaagctgccacagagcttactgaaaacataattatgcgagatgaattagggcaaaatcagtctcccatcgatgagcaaagtaagtgcaaaacagtaagttgagctagtattaaaaatgcttccatactaatttacattctgagaagtctgtatagaatgcagggcttcttgctgtaagataaaatacatggaaaacaatggttggaaatcaatccatatagaagaatatttgggaaaactgggtatggtatgagcaaactgaagtaggtatgtgtgatagcttctcaatagagtaaatccccagtcctttggagtgttcaccccaaactagatgaacagctggtgaacaggctgtgaaggcatgaggcttccttgcacctccttgacctgtgcaaggcatgaggtcaccttgcaccacgatgtgacctccatggctccctgttttttttttttttctttcttttcttttttttttttttgaaacggagtttcgctcttgttgcccaggctcaggctggagtacaatggcgtgatctcagctcaccacaacctccgccttccgggttcaagcgactctcctgccttggcctcccgagtagctgggatgacagccatgcgccaccacacccggctaattttgtatttttagtagagatggggtttatccatgtttgtcaggctggtctcgaactcttgacctcaggtgatcagcctgcctcggcctcccaaagtgctaggattacaggagtgagccactgcgcccggcctgttcttttcctatgtaatatttatcactgtatggattgcactttgtttatgtgattctttgattaatgcctttttccccgattagactgtaaatgtcatggactatatttttataatgcacactgttatatccctgatgcctcacacagtactaggaacaataaatatttgttgagtgatttaataactggatagacccatttttatttctttctcctgagtatatggctcaccagcttcatatgttaagccagcatacctggaaaaagcttggtccagaacctgttccaggtattaatacttacaatgaggttcctattctttaagttagtggagagtagaaagataccaaactaggaattgtggggaaatggtggcattggcaaggagtgaacctgttggaaagtgaagatgaaaaggtaattttaaaaaaaaatcaatattgattttagaggaaaatcttcctttctatataccaatgtaaacatactcatttagcttttcctggcaaattcagcacagaccttccaattttctttacaatgctgttcctttgtggctcgggggctataagcttgaaggtgaaactcttaaagtgcactttttcttttctaacatttgtggttactttttaaatgtatgcaaatcttacttgattcctgaagacctcaagtttgttttctcataaaaataagatttcaatttcttatctcaagtaattttaactaaagaaggggcactgtgtgtactccatgtcctcccatggccctcagcccactgttacctctggaacccaggccaaaaaccacatgcagtgctcttcacaaagcctcctgtcctcatacaacttttccttctttcctgaggaggtctttgaaactagttctagataatgagatgtgggaaaaccatgttaaaagttgtcttaatacacacccactccattttaaatgggattacatagctacaaatcctcacatgtggaataaaaatatgtgttttagtttgggttttcatttattgtgggaaaatgaagcaacatatcttatgactctgtccagaaggaacttgctctctaaggacaagatggaagaatattaatatcaaatgactttttttcaatgacttaaggatgagaaaagcaacaatagaaagatcttgtaatattgtgtatacacacatacacacatactcagtaacttcattttcatagactactgagactgaaatataaattttaatgtataattatgagacagtaccaaggatgcaaactggaacagaatactctgggcagagaatttcagagagcatgataaactgtacccagggaataaacagcagcacttagcagtgtgctgatggcagagaggacttccctcttcactgcacaggtagtgggtaatcaccccatgctgacaggaacctgcacttgggttagctctccaatgaataagtttcattctgaagagacaattatgtatagaattgggcttgattccatttacacaaccaaattaggctgggaaagctcagtgttcagtgaagacaagaaaaaagctcagaataaaaagacatatgtctattacaaattaaagtcccactaggttaatgtgagctacacagtggtttggtggtttgtaaaataaaaggtaaaaaatgatatcgagtatgtaggctaccatagagtgtcaagttacatcaagagtttagagacagaatgataaggaatgatcttaatgtaatagatatacgtagagtgggtaaactcttggctttggtgttatttatgaggttttctccactcatagcagagaagtacatttcttcactgcatttttttcattgtcataaattggttaaagacaaaagaaatcagcattatacatcagtaagtagagtggaccacatgattctatctgttttgcatggaaatcttaaaacatcttttaaggagccaagtagtaagcacaaataaataaactgcaccaaaatgttgccaggtttgcttttgctggagactgctgacactatagaagcagcacaagttgggagtctgcaggtacagaggtgaacctggatctgctgtgtgcccaggtgtgaccttggacatggtgtttaacctctctttgtaaagtggtgatgtcaacacctaaaatgctgggctatgatggtatttaaatggcataaagcctaaaggtatctggcccattttctgacacctaataacacacgtttatagaacatgacaacgtgttcaataaaaacctattctctttgctccctgtcagatcatgagttccccctataggtccccatgtgcacacattcactttccgtaagtgaggccaacttgtggctttaaattgtgttagcaaagagagattctttgataccatttagaaaccaaaggactagctcttcatccctaggatgctgatttcagtgacacattacatatacatacctaacataacctcatttctgccaatgatggaccacatatacaacatggtcttgtaggattataatactgtatttttagtgtatcttttctatgtttaaatacaaagatacttgccactatgttactttgcctacagtattcagtacataacatgctgtgcatgtttgtagtgtaagagcagtaggctaaacctaagcctaggtgtgtaataggctagaccatctaggtttgtgtaagtcactctgatgttctcagagcaaacatcacctaaggatgcattgctcagaacgtatccctctctttaagcaatgcatgatagcatttattaaaaacgactagtttggcacatgttatatgaggcacacaatcaccctgagaaaattttaagagataaatgcccagatattatagatgagaaaattggggttcgtggagttaagggaattaccataaatgagacttgtcagtggaaactaggacgggcacccaggtcttctagctgccactcgtattcattagagggttaacgctgtatgacctgaaccttaatctgatccctgcggagggatcagatccaggtattgcgaccatcaagatgcatggccttggataagtgccttaaatcctctggtccccggtttcctcatctacaaaaggattacagtaatattatcatcttcataaagttgcaaaacattaaaaaatataaaagttgcaaagtaaaatgtgcacaagtaagcacttggtgtatattagctattttgatacgttccgggttttttcagctacatggagctacctagacaacagggtcaacatgcctaaaaatctctgaaataaaatctgagcattttgtcctatcatcgatatttactttctttcttttgtttgtttttcaaaggtatcccactgtcctgaatactcttgtccaagatctgtttctgtacaccatggtgaatttgatgtatctgtcagatgggaaaagtggctgcttttttgtaaggataaattttaactttgtaaagcatctcacaaattttaatcagcttctctgtcactgtcaccctaggaaccaacttcacccttgccgaactgggcatctgtgagccctccccacaccgaagcggctactgctccgacatggggatccttcaccagggctactcccttagcacagggtctgacgccgactccgacaccgagggagggatgtctccagaacacgccatcagactgtggggcagagggataaaatccaggcgcagttccggcctgtccagtcgtgaaaactcggcccttaccctgactgactctgacaacgaaaacaaatcagatgatgagaacggtaggcctgcttcttaaataccttttaacgttctgtgcactgcaccacgtggggctttgaatgtttttgttttttaatgaagcggcgtcataaaaccattcattttctttgaaatcgaccttgtctacccagtgtgagctggggggaagtaaaccagcaaccctccagcacacaagaaatgagaagagaatttaaaaatcacattctgatgataacacagcattcaggtgtagtcagttggtcttattagcaagtaaattacattgcaaaagaggcggcttgataaactatgacctatacctagaaaatgtcctctctccacaagtttctaggtctttgtattgatttccccttcccagtaaatggaaacctgggttattttttttcgtgacgatctcttaagaatcccaccttatcttagactttcatttccaggcggcaatgcctcatatccgtattgaagatcaaacttggaacaggtgctctggagcttaataatgacaaataggaagagacttgtcttcagaaaaagaattctttatatgtttacttttccccttggcaactatgtaggttaatggtttcccccatcttctgtcacaaatcactattgcctatccatcagctttctaggtggattttaatgaaactttgaaaattaaatccttccgatcattaagcagtaaatatagagaagcctaagcaaagtcattaaagagataaggtgcttttttgtgggtttctgagcaattccgaagtgtgtttagtcaaaaacatttttttaaaaagataaattgcattaggttacagctgatttaagacgaaaacatcaaatgctatgtggtttgttatgaatagatggcatgtttgctaaaagaattaccattaccattaaaatgtttacaaatagatcagttaagaatgtttatataaaatattagaaacttctgccagagcagctttaagtatttcctttcatttaaaaaagaaaaaggaaatttgcaggtggacagcttgttgtgaatgcaaaagcatagctaaatatcatttaatctcaaaactgtgttgaaaatacatcatttcctgggtaagtcgcacatactcaaaaagatgtcacttttttgaatttaaatttatgtttaattttgaaataatttattctacagtggggacaaggggatgtgtcttacttatgcctccgttcatgtagctaatcaaggtgtactctcaaggaaaaatctgtacttgactccttttgaattttaacaaaattctgacacttggcacatttgacactctgaggtgcttatttaataggaaattacttttagaagtttccataaaagcatacgttgaatccatttactggtgtcctttttcagcttcattgtgtgtgtcatatactatttaaatgaaggcaatttgattgcctaataaataaaatcacttgtaatccaagaatttatggcacattttaaacaaggaattttagcaagtccctcatagttggtattcttatacctatagagggaaccgtctatacagagttatttatacatatttatagacctgcaccttctcccatttaagttatatgcatctaaaaaactcatctaataagggagggtttctggtgaagccaagggcacaaaaaatgcttgccatgaatttacctaggagagttatggatgaaaaaaatctgaaattcatcatatatttggtagaccaatagtagtttcatttttttcatattatttgaaacatcgtatttgaataatttttactttctgcgagtctatgtaaatccctgcatactgataagaaataaacccttgatatagtgtcctgattctttcctacagtactagttgcaatgcagtcagaattacatgaagagaaatgtacttagaagcactaagcaactctgtatgtgagtgtggctggcaaggcacaaaggaggtattgaagccagagttcaaactaggtgagagatgcttattttaaaatatacaggtagaatgtctttgtttttctttttaaaacattttttcaatattttacatattcaaaagaggtacataatgtatcttctgttctcattcttggccagaaataaaaataagaaattttacacatcacatcataaactctttaagcaaatacaaattgaagtgtgagcaactctgcaggcagaggtgttaacttcagtaaacttcttgctctttctctctgacaaattctgtttagctcacaaagaaatcaatgctttttcacatcactgattttatgaagtttgggaatgtattatcatatagattgacagttgccccactggttccacaccacggcatggacacttacaaagccatcattaatttctcacacttgtacccagtgatggcttcctccataataaacactgtgtccttcagaaccaaatcaataaccttttaggtatgcctttcttgaagaggaagtaacaggaatctatactttgagaaagaagctctccaatttgattttaggttttaaagatacatggtcagaaaatgaatcttttctgtggggttccatatgttttaatttcatttcttggtgggattttgggataaatggatttttcaccgtgtttacttaaaaatctcccttaaaaaattccagttgtgattttgctaagcatagttaatgagtgaagacagatctcagaaaccaacttcctttttggtaatatgaagtgtatattcagtctgcaaagtcatatagtaaaatctttaattttgccaacagttctccctagatcaatgttgattgtgcttcctacatgctgctgtgacaaaaatgacccattggataacttgacagtcccatcaaacagatgaacctgtctttcttttctttcttcttcttttttttttttttttggtagtgtagacaccatagtgcttcatcctacactcattgatttagcctctgcattaacattgtgctggcttggattgggttgcttcaaatatataaaactctcagattcatgttatcttttcaggttctttaatcctatcttgaagtcaataatgatttggctagaaatggcaatgagagttgagaacagcccggccaagtttttgctgctgtgaaatttgaaagggctttcctagtaactttaaattagagtccatacttttgttcaataataaatgtcccacttaaaatatgtcctctctaaggccatttgtattatatgagttatggagaaaaaggggtagtcagtaatacagaagaataactaattgcctccttaaagatgcaaagcagcacaaactaaaaaatcttgtctatgttctcttgactcccttaggcgatttcttcaccttgggacttaaaaatttccttttttttttttttttccttccagcagaattctagtttcagttattttattggaaatccagaaagggaaaaaacaaaaaaacaaaaaacaaagaaaataaagttggtatgaaataggaagctagaaatggcagtaagtgaaatctggtgttggttaaacatttaagaaaattattcttcccctcccctctccatgtccacccaaagtaaataagtacaatgttcattttcatctgttgtaattgggaaatttacaatcctcataatgtactttgaggttgagatataaatgttgggttaattccattgcatttcacaaaatgcatttataaaacaagctggctctgggcacgtaatggatttatgtaaagcgtatttgtgaaacacagattctattagattgagtccttttggcaaaaggtctgtagcgtatctgtctcctcggcagagttccaacacacccaggtactcactgcttgttaactgagacatgaggaatgaagcctgagggaaggaaggattttccttagcaccggggacaatgtccttagattgttactgccaaccaagttgcattcatttgtcatttaaggtgagttacttaaatttttctcctttctctccagaaagcggcctctcaataaatctagcattggagcgtttcttaagtaaacacaaactaaacatgcgagtggaattctatttctactcccactctattactcttacatgctcaaattaactttgtattttataacccactctactcctttcttctccctaatccctcacgtaaaatcacagagaatgcctggaacagacataaaaacttactaagagctccagacctagccaaaggcccataattttgctgttaaggaagtgaaaagtcagtggtaagaatagtgaaagaggtagctacaaaaagcatacattcatatttgactgtgcttgatgttgatatgggatgatttcttttccagccacattttatgaagccaatttccatggaacctaaagaaaattgtctcaatttcttaaaaacaaaacaaaatttaaaaacataccaaaaaaaaaaaaaacccagaacaaagttttaagccatttggatgacattgatttcaatttgtgtttttaggctttattttatatacctgtacatttaaaagaataccattataaagaagagtatgaaatgagttatcatggatttaaaaaaacgaaggacacagacacaaaatatcataggttctgtgttttccattcctaaatgaaagaatgatctcctttacatttttctaattcaattccctcaaagtccaggtattggaagctatagagaaaacttatttttaaaaagtttattcatgggagtcttaatatatgattactatgatgctaaaacacagctgataataacatacaaccagaggcaaaatgtaagaatatcacattgtcacatggcatgatatgaaagctagaagtgaaaggattgatgttctgcaaatggactcgtatgagactttagaggtttacgtttttggcaaattaagcaattcttacgttactgtaaaggagaacagagtacttcaaggagcgtaggagcctgtgccttatttcagtactgcactttccagattataaactttagtggcatggtctttagttatttatatatttctttctttcctttggtagtttctttcatgtttgttaatgctcccaggggctatcaaggaatggctccattcaataaatacaataaataaaatgaagaactaagccttccttttggcaagggcagcctgattattacatgtgtaatctccaggccttcagggacacattgggcttggtggataatcatttggttttaagctgctgagttcctgatatcagtactttaacttcagttgagttgctctttttactgcgaaggcagtaaaatggtaagaagcaaaatgtttttgtctgttcacgattggaagcctcttcagtcagaaaactctttttttgcttattgttcagtcatttttttaagtttagttgttgtttgtcaatgatcaaattaagtttatctaataggtgggagagatgtgccatgcattgagaattaaggtcataaataagatgagttaaagctaaggaagttgatagtataagttttctacagacaattgaatcagaagaagcctgctcagaaaataatatcaaagtaaacgggttagagaagaatgtatgaggagtaatgaggcacttcaattagccattcggaaactgagacatagcaggtagaagaaaatttcaggtattaataatagatttgtaaataggatggaaattccacatatgtggccattatgtatataggcttatacatgaaactaaaaatgttacttgtgatttaattttgagtattatttaagtgctagctgtgagaaccttctagaaaattattctttcttgctttccatcaactcagtttgagtaatgttaaaggagtttaaggtgtggctaagtggcttatgggatatttaacaacagaagttaccaactgcatgttagtctacaggctgaatccagtttgaattgtttaatttgcttagtgcagtatcaaacatttttagattaacaaccaacattttaaaagtaagagattttatattagaaatttttatttttggccgttctcaaaacataagaagattcagtcacactggttcaggttttggttgggacagatcagattagaagcagtagcagttctggatagattccatgtctttgaggtcacctgatcttcctccaggctacactgttgtttaaggtctgacttagcctttgtagtcccttgagttatcaaccctgacctacatacagtctttatggaaatcagatataaaaattgtagaaagctagaactcagcaattttatgggttcatgtattcagagctagaatgttacttcttttggtaagtttgctccatctgcaaagtgggtttaattttgctctactaaatttctaaaatggttttaaggcatttagatttaaatgcttcagataaaattaaatcaaattacaatcaatttaatttggaaagtaataaaatgattgtatatgtggggggtgagtttaagtgggtaatatgtcaactccattttccgaagtagtagatgccctgaagtactgaaaaattaaggtcagagtatttgatttaacacataattttaaagctattttaatgtaaaagtatttaggtggactatttggaaatagatggagggaaaacctactttaaaaactttagctacttcagctgattgaagaaaaccccagggcttttcaggaggaagccatttaaagaggaggaaaatgactttgtgctaattatgttcagttttgatccagcaaatggtttatggggtctgtaacaatgaagttggagacaataaagcgaaggctagaagagagacatgcagtgatacacgaagacctccagtatgccaagagagaaagacatggagcaatgttagctaatgctgaaatgggaaccagcgagtcagaaacaaacagaacagcgagtgttccacaaaccaggaatgttcttcaaccagtggataagcaggatagccaaggaacattcaggagtgactctcactccccatcctcatttcttatttgtgaagaagaaaagataactgaaatatgagcatgtttcctaaggaaaggggactgaaatatttgagtaggcattctttgaaaaagagtaggttaacagataacctatgcagagttataccattctgaggggaataaaaaagataaacaccatggcagtctttccatctgtgttaatcatgagaaaaggggcctgaactcacttacagtgagaaagttaggcactggaggagttttgggaagtattttttgtagtattttatgcaagaaatagactatgacacattcaataatcaaaaaggatctttgaaaggaatttttaaagaagaaaattggtgtttgaaaggtaccacactatgcttagatatgaacattttaatatgcacacaaatatataaaactatgtgttgttttattcaatattggtgaaaaatagaaaagtactctcagatgaagagttgtgttaatttggggtggggggacttatttctgaaaagatttcaagtaattgctaattgctctgcattggacgaagccattgtgtgtatgtctctttgtatttgtgtgtctgtgttgtgtgtgcatggtggggaaggtgctttgttgggaagagggatgttattgagagggatagaaatcaataaatataaattgaccaaattccagggaaatgaaggccatatacgaaaatgccaaaatgagcaatgtagacattttgtagcatatagttttggggggagagagagaagagaaacctgtgttgaccttcgtgggtcttgaactctatgggtcatcttacatcaaggagcatgccctttaaagccttggatcccttaaaccaatgatgctgtctcacccatgtaagtcagaatccacagaaaaacacccatgttttctcaagtcccacagaagaactcttgcctctggggagctctgaaccagttcgaatctgtcagataaatatttgacttggtggggaatccgctttccttgaaatatgtccctcttcctttcccaactttcgtctttcccccaacatcttccctccccacctgcatccagcagggcctaatcacctactccatgagctaatttttttattattacattctgtcctctcgttaaaactagtgagatcatgtctctaagatatgatttgagcatcatgataaactggtgcaggataaaaaaaaaaaaaaaaaaaaaacttccgtataaatgtaccttcattttcccttgttctttaaaattttaacttttgaatatgttttatgatgcaagtaatttattggtatatgtatatacacacatacacttgcacacacatagcatatatgaacaggttacataaatacagaaatgtatacattggagatgtgtccaaaaggcttatgctgattgttttagaccttttatttcccaggtctaattaagcctaagcaaccactcactcctcaaaatatttggataattcattattttgtggcaacctgtttggttgtctttgtattggtaatgaccgtatgtgctaatgatacctaactatgttatagtaaaatttgtatttttttcttctaattctctctgctgactttcacttcctagatgaatagacaaaaatattgactttgttgtttcttgaagaaaccaagcactcctatgcatttacagagacattcctgtctaacctcaatagggagagaagaaaataaacattatatatgttagcatactggtacagtaagggaagctttgagaaggtatggttttaattaggttgtaaataggggtcgggacttttatgtatggaaatgagatgatggatattctaaatgaagaaaagccagagtgtatggtggttggagaatgggaggtgaggtgaagatgatgatgatttttcaggggacactttctagtctagaaaaaattccaactccagtcaggataatgggaatatagtgatttgattgagtagcagtagaaatagatgaatagatgtgtagcaatcagatgaccaagagctgtgagcttcatcttaaggagttaaagtctgatcaagcagataatacagaactattgaaagtttatgtgagcaaagactgcaatatcttaggaagcatctgattaaaacacacagatacagcgcgtgcacacgcgtgcgcgcacacacgcacacacacacacacgtttggatggaaagtaacaaagttagaagtgatatcagaaagagaagcagtagtccaggtagaaggactccagaaacccttataccacaaagagtctacctgcttcttagcatttcagtagcagaaattaacctctgactaccatatgaatgctgaatattagtaactaagatgataaaattcaaaaagcatataattttatgctgaatagcaggaaaatgggaggaggtacataaccccacactcccgcagtacagggagtgttccttacagtgcaatctattctgcttacatgtagaatacagtattacaacaattagactccagtgtttataatatttaaccaaatgattaaataataaagtagcatcaaatattgctttgcacaaggaaagaagtcataatattatttttaagggcacagtaagtgtgttgtaggtgaacgttggctagaactattccaggttgattaatagtttcttgaatattatttctgcttctatatccttgccgcttcttcatgagtcatattctcatgcaatttgtttaattgctcctgtaactatagttatgtctcccttcttatctctaatcttttatatttttatctctcatttttttaatcagacttgaaagagatctattttttttcaagctttctgcttgtctttatttactttaatttttctttctcattacattcatctttattgtattttttaatttcctcattttaacttttggagtatattgtggggtttttttaggtttaatttttttttttttttacttccataggttattggagaacaggtggtgtttggttacatgagtgagttctttagtggtgattgtgagattttggagcacccatcacctgagcagtacacactgcatcctatttgtagcattttatccctcagccccttcccaccctttccccctgagtccccaaagtccattgtgtctttcttatgcttttgcatcctcataccttagctcccacttataagtgagaacatatgatgtttggttttccatccctgagttacttcacttagaataatgctgtgaaagctattaattcattcctttttgtggctgagtagtattccattatatatatatgtgtgtgtgtgtgtgtgtgtgtgtgtgtgtgtgtgtgtgtgtgttacagtttctttatccactcattgattgatgggcatttgggttggttccacgtttttgcaattgtgaattgtgctgctataaacacgcgtgtgcaagtatctttttcatataatgacttattttcctctgagtagatacacagtagtgaaattgctggatcaaattgtagttctacttttagttctttaaggaatctccacactgttttccttgctggccgtactagtttacattcccatcagcagtgtagaagtgttccctgttcaccgcatctattatttttggattttttgattatagccattcttgcggcagtaaagtggtatcacattgtggttttgatttgcatttccctgatcattagtgatgttgagcattttttcatatgtttgttggccatttgtatatcttcttttgaaaataatctattcttgtccttagcttactttttgatgggattattatttttttcttgctgatttgtttgagtttattgtagattctggttgttagtcctttgtcagatgtatagattgtgaagattttctcccactctgtgggttgtctgtttactctgctgacttttccttttgccatccagaagctctttagtttaattaagtctcagttacctatctttgtttttattgcatttgcttttgggttcctggtcataaaatccttgcttcagccaatgactaggatttttccaatgtcatcttctagaatttttatagtttcagatcttagatttaagtccttaatccatcttgagatgattttgtataagatgagagatgaggatccagtttcattctcctacctgtggctagccaaatatcgcagcaccatttgttgaaaagggtgtcctttccccactttatgtttttgtttgcattgttgaagatcagttcctgcaagtatttgggcttatttctggcttccctattctgtcccatttttatatacctatttttataccagtactgtgttgttttagtgactatggccttatagtatagtttgaaatcaggtaatgtgatgcctccagatttgttctttttgtttggtcttgctttggctatgctgacttttttttggttccatatgaattttagaatttgtttctaattcagtgaagaatcatggtgatattttgatgggaattgcattgaatttgtagattgctttcagcagtatggtcgttttgtaatattgattatacccatccatgagcatgggatgtgtttccatttgtttgtgtcgcctatgatttctttaggcagtgttttgtagttttccttgtagaggtctttcacctccttggttaggtataatcctaagtgttttgttgttgttgttgttgtttttgtggttattgtaaaaggggttgaattcttgatttgattctcagcttggtcactgtcggtgtatagaagagctactgatttgtgtacactaactttgtatccggaaagtttgttgaattcttggatcagttctaggagctttctggaggagtctttagggttttctaggtaaacaatcatatcatcagcaaacagtgatggtttgacttcctttttactgatttggataccctttatttctttctcttgtctgattgctctggctaggacttcagtactatgttgaagaggagtggtgagagtggcaatacttgttttgtttcagttctcagagggaatgctttcaacttttccccattcagtattatgttggctgggggtttgtcataggtggcttttattattttgaggtatgtcccttgtatgctgattttgctgagagttttaatcataaagcgatgctgggttttttcgaatgttttttctgcatctgttgagatgatcatgtgatttttgcttataattctgtttatgctgtgaatcacatttattgacttgcatctgttaaaccatctctgaatccctggtatgaaacccactggatcatggtggattatcttttttatatggtgttggattcagttagctagtattttgttaaggactttaatatttatgttcatcagggatgtcggactctagttttcttttttggttatgtcctttcctggttttgatattaaggtgatactggcttcatagaataatatagggaggtttccctctttctgtatcttgtggaatagtgtcaataggattggtgccaattctttgaatatctggtagaattctgctgtgaatctgtctggtcctggacttttctttttcggtaacttttaaataccattttaatctcacttcttgttattggtctgttcagggtatctaattcttcctgatttaagctaggaaggttgtaccattccaggaatttatccgtctcttctagtttttctagtttatgcatagcgttcatagtagcattgactgatcttttgtatttctgtggtgtcagttgtaatacctcccgtttcatttcttattgaacttatttggattttctctctttctttagttaatcttgctaatggtctatcaattttattcatctctgcaaagaaccagcttttgtttcatttatcttttgtatttttttgttgcaatttcatttaattcttctgtgatcttgggttttttctttcttctgctagatttgggtttggtttttttttgtttctctagttccttgaggtgtgatcttagattgtctgtttgtgttctttcacactttttgatgtaggcatttagggctatgaactgtcctcttagaaccacctttgctgtgtcccagaggttttgataggttgtgtcaggtcattcagttcgaataattttttactttccatcgcgatttcatttttgacccaatgatcattcaggaacaggttatgtaatttccatgtacttccatggttttgagattccttttggagttgatttctagttatattccactgtggtctgaaagagtgtttgatataattgtgttgtgctttttctaactttttaaagatgagtactaagttttattactctcattctcccttatgttatcagagtaagtatatttatcaggtcctatagaatttgataaaaaatattgttctctgtgttactttctaaagatcctcagcccatttggactctcaaaataaaacagaatcctaatgctaccagtttttcactttaatactaacaatttctgaaaaagtccaatttttattgttaaatctttatgctgcccaaagtaagatatctatatgttttatatgcattatttatagatatacgtttgtattaactatataacatagaattatgcaaagcatatgtgcgtatatatatagtgcatttaaaatatatatatatatatatatatccatgcatataggcatgaaaaagaataaaaatcacctataatttgacaccaacaataactatggttaatattttgatgcatatatccttcagtctgtgtgtctatctgagagaaagtgagagggaaattaataattttacagagttggcatgttttacatgccctatatagcattattttttttggaaataaactaaaatcatttccccatgacattaaatattttctccaatatttaagagggacatagtactcctttaatgtaatccatttcctcaatttcctttcattgtacatttaactaatttttattttagttgcagtaaagagcaatgtgatggataaaatccttatagctacattcctgtggacatccctgactgttttcttaagatgaattcctagaagacttagaacatacacagttatgtgaaattgcaatccttttcaaccagtgtcctcagaggaactcttgcaccagcactgtgggaaaatcaacaggcacacggaatccttgagctcaggagtcactgggaatgatcattaatattttaccaaattacggatcgaaatatttttattctggcttcccttcactttaatctgagcaactcttcatgtattcattgtctacgtgtattttttatttcatgatttgtatttcttctccatatggaaagatagtgggacgatgcatctcactttttagtttgtattagctttttacaatgtctacagtgatcccagatcaatgtctacagtgatcccaggtcctattgtaccttattgtttatacaaatgcttaaaaagtgttcacttattggtgtgaagatcacttggctgcattttcaaaagcatgcgacttattttctgtgggatagaacaccaaatgtatttacggagttgatttggtttatcagaaatcagtgctaactagaaagcaatttaaaattgttgcactgaccaaagaagaaatgctagctctgagtagagtggggaatttctttttccatattaagtatgtcagctattgtttggaatgcaggactttatatcagattgttaatttataacaaaccaaggatagaattgcattccacatgatgaaaggaaattcacatctactaagacagtctgcaaggcaccttgaggagacagaatcgagtaaattatgtattaaatattcttaaaacttcctccatctgcggtgcctttgattcaatgaggttagtaatcataaacacagtggtggccctgctattggtattttcacaaaataggtagttctgcaggcaagataaatatctcagtacataagaaaagactctgaaaataagcatgtggaagcaattactattataataagcatatggctctgctaatatacagtgttgcttaataattgatatagaaaaaaaacagtagaaacatttctatattctggggcattcccttgtacatttagaatggaaaagaccccagtgaaatgcagaacaattaagagagtacaggttgtcttccatttccactgatacacatttatggctatgaacaacaaggcacgtcgagaaagcaggaagtatacaaatcaacttaatctgtcccactgtggtatttcaggccctccacaatatagtccaattttatggttttagcccttgctcccacttctcttctaaatatattttcagctccagctcaactgagctacttattttttttccagagcatactctcttcctctgtgtcgttgttcaccctgttctttttggctgcagtggtatccccaaacccacctacccatcacatacctatccattatcaaagaattatctaaggtgccatgtcctctatgaaatcattctgttttccttaactacaggtgtactcccactcctttgaaattttttttaacattttatttatccatttcatcaagaatttaggggaaatggtgtagccttcaccaaagtagagaagtaaatgatttgagatgaattttggagctagagtatacagaacttgatgatagtttgaatgtagtagttgagaaaagaaaagcaagagctcttgggtgggcatagtggctcacgtgtgtaatcccagcattttgggaggctgaggcgagcagatcacttgaggtcaagagtttaagaccagcctggccaacatggtgaaacaccgtctctactaaaaatacaaaattagctgagtgtggtggcttgtgcctgtaatcacagctactcgagtggctgaggcaggagaactgcttgaacccaggaggcagagtttgcagtgagccaagattgtgccactgcactccagactgggaaacagagcaagacttcatcaaaaaaaaaaaaaaaaaaaaaaaaagcactctcaaggatttctaactttagccactggatggattcctaagtattaagatgagaaatacttgaagaagataggatttggggcttattcattttagacattgttaagtaagacaactaagtagaaaggcaatgtggataattgtgtaattattaagactggaacctaggaaaaagatctggactggagatgtcaatttgagaatcagcagcataggagtggcccatatatatccaggaaagtagatgagcttacccaaggggaaaggtagagagagaagaggagggagccaggagcaaactctgagtagtccttaagtgttgggtggagagactgaaatcagtggtttgcagaaggtagttctttgttcattcttgttggtgtgatttttctttagggttccctgatggcttccggtgttggtgtggcttttatcatctctcaacccacagtcttttttcctttccattattctgtttcaaaggaggcaagactggctgagcctcatcagtacaggagaaagagaaaaggaatttaaaaagggatagggtcacaggaacaaaaataaataagataagagttctcatataattgtaaactagtttgatggttgattttatgtgtcagtttgactggaccgtaggatgtccacgtagctggttaaatgttctctgggtgtgcctgagaggttgttgctagaagagattagcttttgaattagtggactgaggaaagtcaatggtctcccccagtgcaggtctgcatgatgccatccactgatggcctgaatagaacaaaagatagaggaaggttgagtttactctggctgattgtttaaagtgggacagcggttttctcctgccgtcagcatttctgtctctcaggctttcagaccaaatctataccataacctctccaactctcaggccttgaaactacactacgggttttccccagcttgcaggcagcagatgggatttctcagtctccaaaatcatgtgaggccatattttataatatctcttcattagatatatattctattatttttgtttctctggagaagcctgactaatatgttgtctgtaatttcaaaatgtatcgagtaattcatggcaataacatttaactacaaacttttattgtactcagaatatttatttagttagttattgggcatctattgtctattatgcttagagtatattcattaacaaactagaaacacattttcctctccatgcgggtggatcaggaggtcaggagttcaagaccaacctggccaacatggtgaaaccccatctctactaaaaatacaaaaattagccaggtgtggtggagggcacctgtaatcccagctactcgggaggctgaggcaggctaattgcttcaaccaaggaggcagaggttgcagtgagccaagatcatgctactgcactccagcatgggcgacagagcaagactccatctcgggggaaaaaaaaggaaaaaaaaagttaatttttattaggcaataaaaaatgaacttgaaataaagaaaaaagagagaaaatagaagagagggagagataaatagaagggagggatgaaggaaataaagaaaaaactatgctatgtagtgataaatggtatgggaaaaagaagacagtagaaatagataggagtttgtgattgtgagagttttgcagtagtaaacgggagtcggagggccaaggaaaactttattaaaatgctgacatttgaatgaaaacctcaaggaacagagaaactagctgtgaaagggaattgactatacagatttcaggggtgtggcatttcagtcaggtggaagagctagtataaagattttaatgcaggcacactcctgctgtatttaaggaagttaatgtgattgcagcagaatgcaaattgggcagaatagcaggaaaccagaacagagaaatgaaggtgaagtcaggtcatagagggtgtcacagattatttaaaatggtggcctttgctctgagggaaataagcatccagacagagttttgagcataagaatgtcatgatctgacttcccatgtaaaaggatagctctggctattgtgttgagaatatagtggaagaagacaagagtagggagaacaggaggctattgcagtaaccaagacaagagatgacagtgtctgtctgggacaatagcggtaggaagaagtgatctgattctcaatgtattttgaaggtaaaggtaggagtatttctggatgtattggctgagaagtgtctgcaaacaattccttgaagattactctcaatcctgtgcacattttaaaataaggctatatggttttctgatattgagttgtaggagctccttatatattttggatattaactccttaactcatatatggtatgcaaatattttctctcattccgtagattgcattttcattttgttgctagtattctttgctgtgcagaagcttttgagtttgaggtagtcccacctatttttgcttttattgcttgtgcccgtgatgtcatgttcaagaaatctttgccaagaccaaagtcatgaagttctttcccaattttttttaggagattcacagtttcaggtcttacattttaagtctgtaatcatttcacatttatttttgtgtatggtgtaaaagataaggatccaaattaatctttttcacatgtgactgattcttctgacatcattttttgaggagactatcctttcttctttttgtattcttggatccttgttgaagatcagttgactatataaatgtggctttatttctgggcattttattttattctattggtctatgtgtctgtttttatgccagtatcatactgttttgaacactattttgtgtgtcagtttgacacatagacttataaataaatataaataaatgtatgtatgtatttatttagttagttagttagttttgttctttggagacagagtctcactctgtcacccaggctggagcgcagtggtgtgatctcggcttaggaggcaacctctacctcctggggtcaagtgattctcctgcctcaatctcccgaatagctggaacttcagactcacgccatcatgcccagctaatttttttttctatttttacagacagggtttcaccatgttgcccaggctggtctcaaactcctgaacttaagtgagccaccagcttcagcctcccaaaatcctgggattacaagtgtgagccatcaggccaggctgtaatgtattttaaaatcaggacatgtgatgcctccagctttgttcttctttctcaagattgctttggctttgaaccaagattatggttctacgtggattttaggattatttgttctatttctttaaaaaatgtcattggaattttggtagggattggatgcattggaggtgtagattgcttttggtagtatggacattttaacaacattaagtcttccaatccatggacatgggatgccttctcatttatttgtgtctcttttaatttcttttataaaagttttatagttttcactgtacaagtcgttcactgccttgagtgagtttattcctaaatatatttttgctgctattatagtgggattttttcttagtttccttttcaaatagttcagtgttagtgtatagaaatattactaatttttgtatgttgattttgtatcctgcaactttactgaatggtttatcagttctaacaggttgtggggttgggatatttttcttttgtctttagggttttctgcatataagattgtgtcatctggaaacggcgatagcattacttcttcctttctaacttggatgccttttattcccttttcttgtctacttgctttgctaagactctcggcattatgttgaatagaaatggtaagagcatgtatccttgtcgtgtccttgatcttagaaggaaagtttttggtttttacaaagaagacattcaaatggccaaaaatatagcaagtcttcacttaatctcatcaataagttcttggaaattgtaactttaaggaaaacaaagtgcagtgactcttgaatgatgccattttgtttgacatccctagggtataaagttgatgagaaaaaaaatgatgtggttatacatcctttcacttaaactcagtttccaggaacctatagataattttaagtgaggacttgctatatatgaaaagacactcaacatcactaatagccagagaaatagaaatcaaaactacaatgagataccatctcatacccctgttaggatggccattatcaaagcagtaacaaaagagataagtgttgtcaaggatgtggagaaatcgtagcttttatatactgttggtgggaatatataaaatgatacaaccactatagaaaaaaatatggagtttcctcaaattaaaaatagaattaccctatgatctagcattttcacttcttggtatttattcaaaagaattaaaatcagaatctcaaagggatagatgcacccccaaagtcattgtagcattattcacagtaaccaagatgtggggagaacttaaatgtccatcagtgtatgagtggataaagaaaatgtggtgtatacatacaatagaatattattcagccataaaaataagaaaatcctgccatatgatacaacatggatgaaccttgggaacattatgtgaagggaaataagccaatctcagaagaacatatacagcatgcattcaattatatgaagtatctaagataatcaaactcataaaagcacagagtagaatgaaatttgccaggggttgaaagaaggagaaaatgggaagttgttgattaaataggggtgtcagtgaatgacagcaagaataagaggtaatgtggtgataaaatctgatggcaagagatgcaaagctgaggatgtctacagagcagtgaagcatcatgctgtatcaaggacaagaagcagtgtgtatctcttttatatattcagtgccagtggcatgagggcacagggaggaaaaactgccaccacctgtaactactccagggaaagtagtgtccttaggaagaacaagatttctactggagcgagaccatgaaatgagcatttggagaaatggttaagacttttttcagtgattgacatacagagggacagtagacatgacaagggcgaaggcagacagtgaaggtaaggctttgaatgtcaagggctagggagagatgcatcttgggcacctttcttaactcctgatgatggatggggttagaagaaccagcaaaagtgtggttcagtcctggtggagagtttcattgttgatcctggagaaatatccccaatctatttctcaatgaaggcagtgataaacttttgatgctggagaagtaatggaatcttcctttaataaaaagagtcaagatgtccttggtgagtgcagagagaaagaagaaacattttctaacacactgtaagaaatcttgaatatagggacaacatcttatttatgtgtgtttccaaaggctaccacgttgcttgtcagaatgagtcacaaaaccatggaagggagggagggagaataggagagaatgcaggaaaatgaagaaaggaaagagaaaggaaaatagaaaggcaaactcaaaaaaaatgaaagataagaaaatattatcttgttaaaaccatactcatcaggagacttaagtccttattcatttaattcaacaaagtttttctcaaaataatcacaaaaacattctgaaaattaactaatgaaagaaaatgatagtgaaatcatttataaaacaatgtatatggacccgtgattgataggttttgttgcaaaccgagcattgagtatgcgtgtgtccatgattcaatataaaactgacccttctcattttgaagagataacaattttcttattttgaagagattaataatgtggtgaattaacaaaccatcatggaagagattgagagaaccatgggaaggtgattatatcataccttgtaaagaaatatgtatcttattcatagggtacaagatactgtttctattcctgctgaaagagtaggttaagaaatggtatctgcaatttgaagataccagaatagcaacttgatctcatatatctttgtttgcttctctgaaattcgcatcaagaaaaagtctctaaaacatgtctcagaatcattttctctagaatccactaagtgggctttacagctttaaaaatatcaaagatttatattactatctctcctaggaaaactgtgcctatgaccatagtcttgtttcaacttccaatgtatttttatgaagaaaatatgagaactatatatactccatgcactgtgatgatgtaacatactaatgggagaggtccaagggcttagtagaaaaagtctagagatgtaatttcttgtcctagctctgcgactaactagctatatggccattactattccaagggcaacagacctaaatctctctgggtgtcaatatcataatttttgatatgaagacaatcgaggctatagtgcagaaattttggagtcagatagacaagtgtttaaaccttaattctgtcctttatcagctccatgacattggcaaattaccaataagatctcaaaacactagtttcttctgcaaaatgtggataataattgtccccttcccttattctttccttctttctttccttctttctttctttcctttctttcttcctttctttctttctttctttctttctttctttctttctctctctctctttcttactattttttttttttttgagacagggtcttgctctgttgtgcaggctggaatggagttggcaccatcttggctcactgcaacctctgcttctcagattcaagtgattctcctgcctcagcctcccgagcagctgagatgctgagattacaggcatgcaccaccatgcccagctaattttggtatttttagtagagatagggtttcaccctgttggccaggctggtctcgaactcctgacctcaagttatccacctgcctcggcctcccaaagtgctgggattacaggcgtgaggtgctaggattacaccagcacccagccccctttcccttattcctgttatgattattaaatgagatgggctagtatattaagctcttagcgaagtgcctggcacgtagtaaacaattcatgcatagtaccgattatttttggtgttactgtttttaaaataatttttgccatatttagtcaatgtagactgctttgaaagcttatagatttatcacatgcaaatgattaaatgtgatttctgtgtctccttcataacccttggctgtcaggtccttgggcagatatgtaaatccctgctcttgaatcgatccgacattaaaggcgatggggattagataattttcacttaaagtgactgtcctctttttctgggaacctgtcacaagcgggagttctgcctcgtatatcaaaaaggaattctagaaggtgatttcatttttgctttcattttgttcttcaaggaaagggagttaaatattaattaagaagtctaatccagtaaatatagagatgcaaccatcccagactcacagagttgatgataaaaggagctgtgaaagggatcaaagccaataataagccaggatgagcagagcgaggagcgagcgagagatgtgggatcaaaatatgcaagaagcccaactgcaggctgtagtgcagagcgcctttaactacagcagaacgctgcagcatcactcattctgaacacaagttatcaaacatttattgaatatctactacatgctgagaactagaaatacaaagataaatttcacaaaatccctgcccccaagtaattcacatcctcagaagaaagtcctaaatggtgacaggaggtggcatagcacaataattaagcacatttctttggaatgagactgtctgggtgtaaagctcagttttgtcacttcctagcttttgggatgtggaaacgacttcatctctctgagtagagttttctgcactggtatgatggaagaaccaagtcatgactttattgtgaagagtaaattagtaaaatatttgaaatgggctcaatgtagtatctactacctggtataggcaacattttacatagtatgccatgattaaaggttgcacaaagaagttaatatttgggcctggctttgagctagaagaacattgttcttgtaaagaaacagaatagatcacatcttaagctgagaatacaaagatactgtaaattcagagctcttacatggtatgatcgggaaataaagaaatagtggagtgagagagaaattgaaagtgagaaaggaaaatactagaaagttaatcctgagccagctcttggaaaatgtagaattgcatagcaaagtattttgactttaccatggaagcaaatgtgggtcaccgaaggttattaacaaaggagtggattgattaaatttgcatttagaaaaattattctaaatgtggaatctacactgagagaagcaggacttgaaccagaaggaggaattagaatgccaagagttgataatggtcccatttgggcaatgagagtgatgggaaggagtgaggtggaggagggaagtttcagaggcaacttgacagggattagcaactggtccaagtgggtagagacaggttcatagagagagggaggattctagagtgggttttaaggactacaagtaggatgactaggttagagtatagtcaataaatgagatggagggtaggaggagaacatctgactgggaaacaggaagtttggttttgaaaaatatgaagtatatattttcttgggcttctgatgaggatgtggaaataggcacttggaaatgtttttatggaaataatcagaacgtgaatctggaaattaagataagaaaaccatcacccatagattataaatggggctacatcaggggatgagatgactggcagagggaatataaaggtaccagggccaaggacacgaccctagaaatgctcccttttaggggacaatccaaggaaggtgagtcagtggaagagatggagaaaggatactcagagaatagaagggtgaatctatcctcttcttggcagaagggactattaagtagagcaaggtcaaccatgccataagccacaaaatatttaattaggatgaagaatgagaaaatgcctttggatttgacactggtaacatctgatggaatattctaaagtgaggtccttgtaggtgcttgattaaaatgcctaacaaaggctgggcgtggtggctcatgcctgcaatcctagcgttttgggaggctgaggcagaaggattgcttgagcccaggaggttgaggctgcagtaaactgtgattttgccactgcactccagctcggggtgacagagtgacactctgtctcttaaaaaataaagaaatttttacaaaacctaacaaagaggagggtataaaaaataaaagctgagcgaacactacgtcctgtacatatgtagagatcttgcattttctgtactaatgcctcatatacagtagacaatcgaacggtgtctgtcccatgctgtacatatgttgaagttttcaacttcactcctttgcctaaggagtgatgctaactgacaattttcatcatattctgtccaggaggaccttgatccagggcaaggatgcttatggacaggagctgatgcttggaattcctcaaattataattctaaaaattgtgtttgttgagaatcatgagcagccagtaagattctcataatttatatagcatttgaggattattattgaacaagaagtctttaaatttttaaaaggacaaagtgtaaaatgttctgaataaaaggctaacacacttagcttaaaaatgtagtgcctctgcaagcttaaaccgtgaattttaatcaaagccactgccctctttgagggagttactcagaagttgcatcagattgttgatgataaataggcttcagcgattcatttaaataatatttttaaatctaagaaaacccctattttccagctttaggtatggaaataaattatcctattagaacactgacattctaaattttgagaaatagcataaaactcacggacgaaatcagtttgtattattgttggatagttagggttgttttcagttgtaactttctcttgtctttgtcatttccctaagtgacagaggagaaaggaaggtggataaaaacagaacttatagaggatatattctccttcccaccccatgtcacctccccaaccaacaaatgcatatttaatggcccttccctcctttactttgattatttaatcatcatatagtgctacagcttttttaacagtccctttaaaataagagaatattgtcagtaccattttttaaaataagagaagcagttggttttgaattgagacagacctgaatttgaatcccatctcttctaagtaaaagctgggtggtcagctgattttttaatctttctgagattctccttggtcaccagttaaatgacaaaagagaatataaatatccattttaaaaggttgttgtgggattatataagctaatgtattatatgagcactgcatcttccttgggttctattctcaaccaggaggtaaaatcataatcataggtagaaacatttacccctgacaaatcccttaaactggctctaaatttgagaatgcatgggttcatgcatgcagtcctattcagtgagaagtatgtatgaaggtttaatgcttataataatacacagaacataatgatgtgaacatgtatcaagtatggatatatttagagttttgagaaacacatatggtaagcaagagttagaaggaaatgacatgtctgacttatgaagagattaatgtctcccatccttcattttggctgaagtgtagattctctctttctccttctcccatcccctaacatgagggaattttccagtgcacatagaatggacatcatgatacaccaaaggcatgccacagttcctagcacataataaatggtaaatagccattcgtatttttaatgtcttttattctcctatagaagggattttcaaacgaaaactgctctgtagcttaacaagggtttaaagagacttcagagccagcagcatcagaacaatgagacatgcagccttgttgcctaattcactcttgggtgaccagtcttaaatgatgcaatgtgaaatcatttcaattaattttggtctgtctctgtagtcttctgagggccttataaaagaagtatatgcttaaagctaatacacaggaaggcctgaaagctccaaactgtgcagcttttggtggatttgaggtaaaccctttatgaggaacaagagagaatggatttgcttatggttatagtttctctctctaaagatttaccagcttagaaaatatgtatatatgcacatatgtgagtgtgtgtgtgtaagtgtgtgtgatagttattattttttttaagcaaaacaaaatttccttaattcatccctgatattgagagaataatactaatacatttgggccatttgtgacttctttctcaaaaatgctttttgggatgccaaaccaagctgaaatgtctgccacccttgatttttggtagtaaaaaaaaaacagtttgaagtagcctgaagacgaaacataaatcaatgttattcatagcttacttatgctatgctaatatatttgccataggcaagaagtactcctaactaataaacttactttaaatcattagttgaaatgtctggatattccttctaatgatttccccagcttagttttgtcaatgcttcgcaggtcttcatgccttctacctgaacgtatgggtcatggtagatagacagaacaaaaaacttttataacattttaaaaactgggattagaagatcctaaaaccttgtctgagtgctctgctgttgatttctcagaggagtaaaatatacgtggcaacttcttcagaaagaacatattaaagttgaagtataaggatttttagatcaaaaggataatgattttttaaaatctttactatgtgataaattattctgaaggcattataaagatgtacaagcttgcaccagggaataacacagaaagttggtggtgactttgaaattagtatagacataacactaacctccttccttccttggccaagtttctttatagcatgatgccacaactgttttttttttttttaagtaattttttcttatcaccaaaagattttctttttcttctttaagtgatatacacaagaacggctgcatgttttaaaacatgtggaacatgataggctcacctattttccctctatttaaaataatggtttcatagagaattgtaaattatttctcctcttaactttcatgaagaaaatgacacttatattttaaaccaatttaactctcaagatgtgccatctgtgcctctcctcttgtctctaggccaagagagtgttattaagcttgaggatgggtagaagagaagagtggcagagagaggcactggaggtgtttgagagaggcatgaggggagatgaaaggcccgtgcaattggggaatttcctggtgcatttccctgagaaaaaaactaatgatggtgatttggggttatgaaaaatgactgaccgtccatcagcataggataagatcagaagattcttcataacgctagatacaggactcctgaaggcaaataatatgattgactatcacatgggtctcatgcaaggagagttcatacgagttaaaaggataaaagccctggtgtagcccactggggagagataaacctttgaaggaagcccttttaaccacattcatcagtaaggccataagggacttccttggaagtttatcacaattgcttttgcatgaaactgtatttttcaccatggtctccaatgaagataaacccagtgctgctcatatcattgaaatctacagtggagatctacaatgaccctctccatgcgtgttggtcatctctttctgcttcttcatgccctgctcatgtttcttcatgttcctcctgcgacttattttttgtaacagcatgattaagacataattcacataacgtgcaattcactcacttaaaatacaaaattcaatggtttctagtatatcacaggcttgtgcaaccttcagcacaatcaattttagagtatttttatcaccccaggaagaaattcagaactcttagcagtcattcccattcccctccacaactgccagtcctaagcagcatccatcaatctactttgtgaccatagatttgcctattttagacatttcatgtcaatagaatcatgcaatatgtagtattttctgactggagtctttcatttagcatgatgttcttgaaattaatccgtgccacagaatgtgtcagttctttattcctttttgttgacaaataatattccattgtatgaatatagcatgtttattttttttcattcatcagttgatggatatttgtgttgttttccttatgggctgtttctttgattttttttcttcttggcatcgtgtatgatttccgaatagcatggtgcaaaataggccttgaagtttcctgcatctgggtgcaaactccagttctgctgctgataagcaatggggctctggtcaagttatgtgacttttgtgatcctttatttctcattttgcataaatggacagcccacagggtactgctcatattgccccttggcccaatgtgaggatataataactattgaacatttttttcatttattgaatgagtaatcacataatatgagccttcccaaggagctcttatatattgtttataaaggtaatctgggtaatgccgggctcttacactctattttaaatcaagcaagtgaaggcttcagagacatctcttcgtattgacagtgtgctctgcaaaagattcagcaaagctccatgagaactgtttctgttcatctcttcctaactcagcctcaccctgtaattttaggacataagccccacagacttttaccttagatatagtgcaattcaaacacacacacacaaacacacacacacacacacacacacacacacgcacacagagatgccaaccattcctgagaaggaacttgcagaatcttccatttcatagcattatctgttgagacagaaataatgtgattgatttgccaggtcatccaggatttcaaaaacccccaaactaagccattttacattttagatccaaagtgttgtttatcataggctgttaagactttctcattttaatttcaaccagagaagaatacattgaatataaacagggcctcttagagcagtcagagagcatactgagagtttctctagtaatagagtcaaaaatagtgactaaccaagtctttaagtagaaatgctacccctaaataaatgcttctaaatgagatggcaaaaacgaatagactcttgtttaattaaaggtacttgtaaagtttgcttagagtttgcagtaatccaccttgtcagttctcatccgggatgtttaatgatgggtttgctttagtttccaaatggaaatcagctgctgcttctttacagcctgacattaggcaccctgtggaaattgtattattctccacatgcatattcatagaattaagtattatcaatggacttaaagagctcaattattttttgcaattgcatgcttagttgcttattctgaagtagagtagattgagtatttcggggcctggtcaaatccttgaaatataaatgtgaatgtatatcagcagaaaatcaccagctttactttatcagttggattgttaagacaattgccaacaatattatcccttgatttatagttcacaaaatgtcttctgttataatgagcatagtttttttcctcacagaactctgtgaacaaaaaagcattctacagatgaggaaactgattgtcatccaagaagaatctcttatctaagattgtataagtactgaagcaagattaaaatctagacattcctgacttctagttctttattgcattttctgcatcctattgcttccctggggaaggtcttatttctgtatgtttggaaatacctacttactttagatttttattttagcttgtgtatgtgtcatggtggtgtcattttaattaccaggccactgaaccacatggacatttggtaatagacagaatgctgcatttccagatgctagagttagtgtaattcttgattaataatttaatagaaaataaggtgtttgtttacaatgttaactaaacattcaaggaaaacacacagcagcaattgagatgagaaaacacagaatgcaaacaggaaaacaaaagaaatgaggatggattaattctacatgcagttgaaatataccacctgctttgcccttgcttttgggacattcaagttcatctctctttctccagtatcattgtcattgtgttagattattactgtggtttgtagagctatagggactttgtgagcagtgatctcaaactcaaatatctataagaaccagactaaaaatataaataactgggtatatgctggttatagatacctgtatctatgttctgcaagtgatggcatctttagcaaactagaacataggtactagttaaaggagctgagctgtgttcccagctggttgttgctctcttggaattagtacagaatttcccagatcttgtaattttccaagtaagtccagatatcaatatattttttaacactgtgaagtctcttactacctgaattaattaaatctaatgaaaaagaatcttttgtagaaaaaaaaatggccagatgtggtggctcatgcccgtaatcccagcactttgggaggctgaggcgggcagatcacctgaggtcaggagttcaagactagcctggccaacatggtgaaatcccatctctactaaaaatacaaaaattagctggtgtggtggcacacacctgtaatctcagctactctggaggctgaggcaggagaattgcttgaatgtgggaggtggaggttgcagtgagcagagatcatgccagtgtactccagcctgggcagcagactgagactctgtctcaacaataaccacaacaaaaaaccacaaactggcagaaattggcctacaggccatttatttccaacttcactcaaatggaccttcctcctagaaaggaaaaccatcctcatttaatattaagggactaaaaatgaaaagaggtgtcagtatatacattctgatcacatccgtacttggaagttcatacaatgaattcatcaaactctcattcttcttctggggaaatatctaaactccattgcatttccttattccactgtggcccattgtggattgtgtgttatatttgaatatatcaaatctagcaaattgacattgaaaaccaaacatatcagagacaaactatagaaacacaatagagaaaataaatccacctctgccaaagtatgatctttccaatcatttcaactcctaaaagtagaaggaagcttggaactggaggtgttaaggagtttgcttggaaaaagcaatgaaataaatattgctgtctttcaagaatatatatgtctaactcacctcagggtttggacctgggtgttgaatgaactgaggatctctttggcaagaagctctagtagatgacaaattcttactcttgttgtattgctcaaagaatgccccctacttcttgatagcatttctgaggtgccagagcttcaggtgataaatgacatttttattcttgacatgttactctttattatatcattgagaaataaagttcaataagtgacttctgataatactttactgcggtctttatgaaagatcgattccattaagtaggtacatttcagttgctattacttcaagtgatgccataatgtacttgaaattcagtctttagttaataatagcaagcttattgagtgtattagagatgtgctaaagtacttacttttgggcctggtatcagccaagacatagtattttagacttgcaggctttccatgtatttcccccaaaatcttatacatatatatatataatttaatatgtatctatagtgtatatatatgtctaatatatatatgacagagtatcttacatatggcatagcattttattatatatgtcatggtgttttagacctgtatgctttccatgtattttctcccaaatctaatatatatatatatatatacacacacacacatacaatttttgaaatgcaaatatgtgtgcaatcattttttagggtattatcatttaatatactaaggtaacctcattgattaaaacttgaaatatgactttactcgaagtcacttgggaaatatattgatggtcatgctattcataaaaatgaactcaagtctacctgtctagaaactgagcaatgtcacttgaaaagaatacagcagtaagaataagaaactaaaccaattatagtttttacaaataattattcttatgatcaggagtaatagttgtgtgcagtgaaaaagggtgtaatattaactaaagactagagtttgatttctctcagcttttagcactcaagaaaatgtgatgagaatgtctgggctaagcaggatggataaactttaacaaaaaagttgtaaaaacagtacaaggaactttcatatcctgaaggggcaattttaaaagtaattgtgaaattttaataacatagggaagtactcattcatctattgttaagttaataagcagcctaaaaattggcttacacattatagaaccaattaagctttaaaaaaacaaagagaaactcacacagaaaggagactggaagcatgtgctcaaaaatattaacagcggcatgcatacataataggattatagatgattttatttgtgtttttcatttttctgatttgttaaataataaaaaattcctgtatgcaaagaaagcatgtttaagtaaaagtatattgtattggtagtgttaaatgtgcttgtgccatttttattcaggtaggggtgtgtgtgtttgtgtgtgtgtgtttctgcacattgataatagcaaaataccagttgtatcagtgatccatgatgaaattgttaacactgatgatgctatttcactgtggaattttcttgtgatgttgagaatcttctttgttagtttttttagaagtaaaagcttatcataaggaaagtatcaaaaaattaggatttgaaatttgtaattaatattaatttaataactcaactaaacaaattacaaattttaggatttcattatgatgtagcttcattgctttagcatgaatttctctctaccatcagaaaataaacttcttacctgtccagtatggagcatgtagacaattttgtggccagcatgaaatttttacagtgatgataccagcaaacacctccaagatataatgtcagatctggttaatcagtatgttaaaatatgtttgaatttgtcttgattagaaaaatagcaatcaaagcattcaactcttttcacttgttgagacagatggcctatctttatgaaggcaaatatccaaaaacaacaacccactaccttatctttcaaaatatggtgctcagaatcatcttggaaaagagctatttaagcctaataagccatatgcttgatgaattgatttattccattttgtagtatagacataaaaatcttctttgcagcatctttatcatatctgcattctctgcaactcatttataaaaattagcaaaacttccaaataaggaataaattattatagagaattcagcttctgtgtcttacaaaagaaaaaaaaaaatgtgtctaagtgaacagtctctgatttgccagatattctccccataaagttctgtgtatttgaagagcaaataaactgacagcttccttggtatgcataaagcaggtctaaaattattccagaaagaatccctcagagaaatgcaacttccctgtcattcttatgtattatttaaggtagagattgaccatgggcatagaagaaatatacaatgtttctgggtcctaaaagaagagagttcatatactttttaattttatgtattttaagatatatgtcagtgcattgtatttagcatggaaaagaatgtcctatcaaaataagcagctactcctgcatgtagtttagtggcaaacccacctattaacctctagccacaaccaaataaccccacacttgaaacctgaggttgattagatgaacctttgttccccataaaattctttaaaattatacatttcattaaaagaggaacatatttggtcaacttagaaacacattgttgtgcaatagaagagcatggctttgttattagatggagatgcattctaaatcggaatccaccatttgcttaactgggaactgctgggtacattatataaactccctgaggctgagagaggataggaaactgtgatgaggtaaaaaatcaaaactaaattttaaaagtaaagtatacttgacttttgcatgggatattatacttacataaatgtggctatttctgatcatctgaggtactggatttccaattattagatcaattacaaattcctttgcccaataaacacataatatttgagaaagtctttctttccactttaattgtgaagcataaacaaaagtgtaacctttgtggagtacgctgagtctttaactgaaagagatggcgtatcattgttagaagagagaccaagaagttggtctaaattatcagtctccaaaggctatgatatttgttacccaagttgtgtctgtgtttgtgtgtgcatgtgtatatgtaggtgagagtgtgtgtgtgtgtgtgtgtgtgtgtgtgtgtgtgtatgtatgtgagagagagagagataatgaggaccaatttaagacttagcttaaaatatctctacaggattccaggagattggatgaagtttaagttatgaagtaatctaggaaacattaataactctctctgttggtctgcaaaatcatgttattaaaactcaaaccatttggcaagaatcatcatcaatgtatcgaatgcacctgaaacaatcacgagttaacttttccatctttcaattatcatattcatgtctaaatacatttgtgttgactgactgctgatcaaactacatgtgtgcggaaaaggacaaaagatagaaatgtgaatgttggaaaaatacttactacttaaatgcaagtattttgataaaaaacattatcagtgagctcaccaaggaaatgttatctgggtgctggattggtaaagaaatatctagctatcaaattgggtacagtgggatttaagggttcacctggaagctctatcaaaagtttgcttaactctagcagaccaccaggatccctctggttccagtgggcttttagaatctccaaagctcttagacttgaaccacatttcgtttttggaaacagactcagaaagaaagaggaacaggagcagctaggaagtgtttttagtaatggttcagaaagtggggtcccaggagcagcagcattatagcctgaggagaaaagagagggacttgttagatatggaaattcttcggccccactccagaccacctgaatcagaaactagggttagcaggccgggcaaggtggctcacacctgtaatcccaatactttgggaggctaaggtgggtagattacctgaggtcaggagtttgagaccagccatctttcagtaagaaacatgattactggaggatgtggtataccacctaggtttgtgtgcaactttttttgccgtgataagattatctattactcaatcttagaagtagcaaaagaaattatggaatgctttttaaggcatacttcttccttgaatcagtaatcaaggaaaaactatggcagggaaaatagaaaggttaggcaatttgtatttcccaatggtttgaaaaaacagtggctgttgcatttctgctaaaggctgctaaatccaaattgatgaaacttttggcccagccttgcagaattccctttgaaatgttttgtcatgtctgtcagtttagtcatagtttaagatgttacatgtttaacttagggagatgagtgcagagtctgaaaatatgtcatcgaaagcaaaaaaaaaaaaaagtgacttcaatttatgacaaaaatacagcagagggactgaattggaatcttcagagagcatgagtatttgagcccctgccaaatgttaatccctttcaatggaaagaaggattagaaatgtacattggccctatatcttcatttaattcaggactactagttatctagaaacatttttgttattgtgtctaatttcgcactatttttggcatcattttcaaaaacctttaccctggtttatttatttattttttggctctgatcatcagtattaattcaattctatttgttttctacataattaaattgttctatgtgagcatcaatctattacagtgttacaagttagttcattgtttcaaggaggtaatgttagtatatctctgaaataacatgtaggtctctgattgagtaatgaaatacgatgtattcaatttcttctctctatttaacctacctggaaccatgtttgtcagactaactcaccacagagtgagcatggataaacttgtatgaggtcaaagcccataccactgaggatactaatataaaagattaccaatttgtgacaccttgctattgcattattatccatgcttacgaggctggttgcagtgagatgtctaatttgaattttctgaaccatgcctttaaggctcacatacctgaggtatttatccaaacacattgtaggtttacctccctcaaatatccagccatccatccgtttccttctgagcagagcaataaaaatcaagccagaccctatgctttacgtatagaaccagtaagatttacagccaggctgagtataaaatcataaaactttcagtacgtggttaatatataaccatcaaaataacagagtgcaattctaaatttatgaggctgaacttaacactgaatatcaaataagaatcacattgatctctgtagcggatgacttaaaaacacattaggtggcataaactgcaagacagtacattgatttaagcataaaatgcatagcgctcaatactttaccacctaacgtttctcagtaatgaacaaagctgttgtatattgatgaaaggaaaattatttgttttgttatattacagtgctcacagagatgccttgtatttaggctaggcaaacatggtttgaatcacatttagcaaagggtcacattggatggacattttactgaatttatacttgtttctcaaaataactgtacagaagcattatcacgatgacagttttctcattttctcttttaacagaggaaagattcataccaggtagatacggactttttgtagaaatacactttactgtaagttttctgataaaggcaattacatggaattttaaggttgatctctctaagtgcatgaaatgatcttgtaaaattaccatattcagaaaatctaaaagcatattttaaaaagaaacaataattttatggtaaatacatattttataaaaatctttactgtagaaggatctttaaaaaattgattggaatgaggaatattaggaaatgttaatagctacaggtgtgtccatgtaatatagatagcaaaatggataaaattggttctgatatggggtgaaaaacaaaagctaacactcggcaagtgatttagggtgatttatggcgtgatttatggaggtagtaggggccctggttcgctagagagagagcacccacttctcagcttcctctatctgattgttgtgtctgggtgtatgaaaatatcagatcttgggatctgcaataaaagtgagacatacagatttatctgtgaagtctcctgattttaaaacactaacagatgatttaaatgggaaataagaggtactgatcaaatgtaacctatcttaggtcgatttccagcactcacactgctggttaaagatcactcatcttcaggcttctgggaacgttgcttcatccagaggagcaagagttatcctttctgttggtggaaaaaataatcagtggaagaatccgatattcaaattttcataatttgcttgggaaatatcaccttggtacatcagttaatattttactaaatgagctgtgttgtattataagtttccatcaggcgggtggtagcttcaagactttggtgagaaaagctcctttgcaagttggttctctttcctcacaagtatccacaggtaaagaattttgccaggactcagagaacagcattcactcactgaagtgttaatggcaaagcaaatctaggtgcaaagttggctgacaggtccgccacaggaagatttctgtctatcaccatttcaactgtaggataggtaagtcccttttcatgaaacagtgctgggaggaaattgtatcattctttccaataagtgactctttaaatgaaaaaaaactactacagctttaactttacattcaaataaatgatatatgcatatttgtagcatgtattttacctgttgtacactttctagcattatgttttcaggctagttttccttcataataaattaacttattactcttcatgacatgcaagatggactgtgatgttaaagaataatgttttctaattatcattgacatttgcagagaagattaaaatttaataaaattaattgtccattcttgaatggcttactttgcagttaatcatagaactctgatttctcttactcttatgaaaacttctgaatttcctgtgtcttattaatatccatagtaaacccagcacttagaaagtaagttagattttttccttctgttgacattgttgaagcaaaaaaaaaagtactgattttgaaaaaattctatggttgaagtttttcaactgaaacctttaccagtaatctcacccatcttattaggaaaacctaacttctggaggttatgttgaatggtgaggaatgtatcctcttcgccgtggtacatctctagtaatataatttgaagtgctagggccccttgcatccatttctgaatctattattagttgattaaattagctggctggatcagtacagtgagaagagacgcagtaatgatattatagaattagtatgctatgatgaattgtcaggagaagtaattgtgacagccctgtggccatatgcacttagccatgcaatttatagtcatttggagagccaaggacttttcagtttgggttaggaaatttgctcctgcttttgacatagtttgagggatatgtgtgtaagagtgaagggggtgcttagcagcgattcaggaagaaatcaaaagtctcacttcttagccattggcatttggatgattttcagggaataagccagtgtgtggatgcctttattgtaacagtgccaattcctttaaatagatttatatgatagtgccgttactttatggttgctgaagataacgttactttgggtaagataaaagtaaatgcaatctggtatcacaatttcccttgttatggaacactgtaaattctcatccatgtactgcatttacagcaatcctgaaaacattgctggggttgttttgatttaaatacatacggggctcctaattgcaagtagtttttaagcaacttaaaatataacgttactttttgtttgtttgttttgcaactatttgcaagataaacggactgtcaggtgcctctaaaaggcttatgatgacagcagttggcaatgcaaatattggcacgacaccacattagggcaaatttattgcagaattaccaaaacatgtataactgtgaagtcacctcagtacaactattatatgagaattactctcttgctgtttttgtttttgtttttgtttttgttttgttttttcattttatgactaccaggctacagtaatattcagtagtacaatgaacatgcttactgacattctaactccaaaccagattcatgcagaaaactactcctttttcttttagctgtctatagatattttctgtgtataatcgatcgcttttatttctcaaacaggattttcatttgattacagatgattgtttcgagatcattcaaatcaatcaaatgatgtttgattacatagattgtttcgtttttcttttcttctcttgtcattgttttatccattgttaactcaatgtcaatatttcaaagataatctataatcaaatattgtcttaggatcttattttatgtcttagccccttctccatgtccctaatcttaatcacccagaattacacatttagaaacacttcttcagtaattctgtagttgcacatttcactttgaaggtaatagaagggtgtctgtcacttcttcatttctgtgtccttccagctcactagcactcttatctgggagttatttttgactctcctccttcaccttccaagtctaatttaacaccaacacttgctgattccttcccagcacagtccatccctggcccctgccatcattctatactggagtgcagtgctcccctcttagtccatctctctgccatctcttcccagaccagtagaacctatatatactgaattgccagatggatctcttaaatttttattatagcccctcatatttcctccatgtgacatgaggccttttgcttattcttattccagcctacagaacttatgtgctttttctctcctctatcttaccctttccctagcacacatagatggctaactataattgtaatttataaatttttgtgccaggtactgtgctaagtgctttccatacattatctagtttaagcatcatggcattcctacgtggtaagtggtgtgattccctttttatagtcaaagaaacagaggtgtgaaacaacttgcccaccaaagtgaaggtgtaagaggaagagccagggcccaaaagtaggtctgtctgactttgtagtgaaaccatcaactaccgtgcagcactggcaccctggctacacgtggttgtgttgctgtttccctggtgtggatttgcattcaatattcatctttttgataatttgtgttcctcctcccctttgtgtacatttggagactgaccccacctttcattttgcattttcatatttgttttactgcattaatttgcattgaataatgtgtcactaagtatttgtgcttgtacacgtacatcctcacctagaccacaatcaaattaaactgctttggagagctgggcacggtggctcacgcctgtaatcccagcactttgggaggccaaggtgggtggatcacctgaggtcaggagttcgagaacagcctgaccaacatgatgaaaccccatctctaataaaaatacaaaattagcagggtgtggtggcacatgcctgtaatcccagctacttgggaggctgaggcgggagaattgcttgaaccccggaggtggaggttgaggtgagccgagattgtgccattgcaacaagagtgaaactgtctcaaaaaaaaaaaaaaaatattgctttggagaaacgtatagaatcaaaatattttccattcttcaatacaatactttggacttacagtccctaatgaaggtggacattcaacttactaattgttcctctttgtcagggtgactttgttgctatattatattttaatattttcatttggtaaattgcaggaaaattagattgtcttctatgaagcttgagaaaagctaagttttgcaaacaagctcctgaccatacagcagtagccagaacaatgaacaggacatgaacaataaagaatctgtgaccaacaggaagatatggagatttgcatacttttaaaaccttatgtgattaatattagattcaatctttacatttctttttacaacattttgttccataaaaaatgtcaagcgtgtgtttgctgggaagaggaagagttcattattcttatggttttcttcattatattttgaaaagccaaggatggggaaatcaacattggtaaaagcaattagtgatgtgggttgaggtgcgggaattacatcctatcccttggcatcaagaataaataccaattattatcatatatagaagtgtgcctgtgtcgcttaaaaaattatgattgcttcaagatagtttaaacattatcatctaataaaagcatattgagaaattagataatttgactaaagtatataactatactaagcaacctaaacttaaaattatgtatatatttacatatacgtttcatatcataaaatacaacatactatatgtatatacacacacacatgaaaacttagatgtgtatgtagatagatagatagatagatagatagataattatttaaatatgttggtaggccaggtaaggtggctcatgcctgtaattccagcactttgggaggctgagatgggcagatcgcttgaggtcagaagttcaagaccagcctggccaacgtggtgaaaccccacctctactaaaaatacaaaaattagatgggcatggtggctcatgcctgtaatccctgctacttgggaggctgaggcaggagaatggctgagcctgggaggtggaggttgcagtgagctgagatggtgccaccgcactccagcctgagtgaaagagtgagacgtcgtctcaaagtaaataaataaatatagatagatagataattgggcagatgggtatttagaacgacaaaatttcatcagcatcttttcccgtttcacttaagcttctgaaaagcccttcttggtcagaatgactgaaacaaagtgatggccttttcaaagttacataatatattttcagcacatcccctgactaacactatgaaaagtgcatccattctagagtcagacaggcctaagttacaattctggatttactcatcactttctgtatgtttttaaatgagttatgcaacttctcttcagtaaaccaagaataaatatacttatgatatgaagttaagattatccgaaaagggaaaactcagccctcatttgaactaaaatcagcttaaaaggcaaattgtaagtaacaagaggggacttccaatagtgagcaagttctaccaatatagtaagcattcctggattttgcagcagcagagagcatgattggaacatttcaatgagaatttatttggcataaagggagttagaattaagttgaacttcgaagtaagtgtaataattaaaataataaacgaaaagaaggcaaaaggaaaagatgtaggtatagagttttatactttgcaaaaggtcaccaaaattcctggtgaccagttgcttaataggaatagggaagccagatgcaggagtagtttgcaacttggaaagcacgtgtccgtgaaaagtggagagcttattgttaccctgtgtgaaggaaattgtaggctatgagaccttttaatttttctagactatcttaaaatccagttctcaaaaacaatctgatttttaaatgatgtcaaattattcaagctttctgggaccaaataaactatgtggactccgggatggtggcctctctactgtactgtgaatgaggacatgtatagctggtaataagtatgatggcaagtggagtggagtgggctttacacccttctcagcaggggagccctggaagttctatgacctcacctcctaccagtattcttctcactcactcactcacttccagccatgcggtctttgaataagccaatcccatttccaatttagggagttttgcactaagtattcttcctgcctgaaatgttctgcctcaggtatcttcatgtctaatgttgtctccttcaagttcagatgtcaccttctcaataaggcccaccctgaccattgtgtaaacttgcaactgccttcccatccctgttttatcatgatacctcgtctttttccgacagcaccatcattctctactatagaatttactcccctatcacaatttcttcttattatcaccctgtccctactggaatattagttccagagtggcaggaatctttgttttgcttactaatatacctagaactaagcctgatatgttgcacacactcaaaatatttgttgcataaagaaatgagtgaaggaaggaattaattcaattgttatttaaagaccatagtaaaaacgtggacacatacttttgaagcacaagactaaactaaattaattggagacaagaggactttaacatttaggattggaggcaccagcatagtaagaattgggaaaggcttataaaattgtaaaggtgttttgaggtcgtggttaaacagtaatacgtctatgctaaaactttaagagtatttgctaattaactaacctcatatggaacaaaacccccacattgttgatatctcaaaagaaatattagtctgacttaggccactgatccatgctactcagtgttgtttttctgacaatagcaataaaggtaattatatttgaatattaatggttgttttgcaaagcattgttctgatagagtagtcacttatattgaaattaacatttccagtgtacacacgttaaccttgtcctcagtcaacagctaacttaaattaagtgcctattagagctccatttaactagagatcagaccagcctcggcatgggtgttgtccctgaggtgtttaaagagagccaagcttctgctcaacaggtggccctcctctttgaacttctagtgagagctccagtgaatatgtggagatacgttcaatgggcattgtaatgtggcaggacagagtgtggacgttggcgactaataaactggatttaagatggctcttccacgtccattagctctgtggactcctagatagttcacaataaacctcagcatccttacctataaaatagacaataggaacatctactacataagattcttgtgaatataacatgagctagtatatacaaaattccttatcacactattttgttggtagtattctgttttttgtttgtttgttttgagatggagtctccctctgtcgcccaggctggagtacagtgccatgatcttggctcactgcaacctctgtctcccaggttcaagcaattctctgcctcagcctcccaagtagctggaattacaggtgtctgccaccacacccagctaatatttgtatttttagtagagacggagtttcaccatcttggccaggctggtcttgaactcctgaccttgtgatccacctgcctcaacctctcaaagtgctgggattacaggcgtgagccaccattcccggccggtagtattcttaagaatgttttgtctaccctctccattaataggatatatttatgacttttacaagtaaacgtcgtatttgtttggcacttgcaatagtggtgattagttcgacaaatagcacaattattctgcttcagtaggatgtaacctcatatcttaaccaaaatataatgtggctagcaattttacaatgttcaaaatacttcagaaatccacaatgtgcagttcaacataataatttctcattttctccaatcagcatcccaggagatctagttattcatgcagatcaacacgtccatgatttaagccgtgagcttttaggaacttcactggcccaaagctaataggtgaaaagatatatacctaacattttaagggattttcaactcttgatgtcttattttgcaaaagagctttgcagcaataatttatcaggcagcctctctgtccacattggagtattctctagaatgattcttatgtttattttacatttcccttccctgcaagaagacaactccaggtaaggagaattgtgagttaataagatgcatgccactgatagcaacagtctatttgatgtctatttccaaaagaaaaatgcaaagtggagtgtgtaatcccttaacgtaagatacctccatgaatcccaatgcctccacgtgaatcctgatgccagagctgcaaggagcatacactgtcagggtacagaaaatgaagacctctctgcttgaaagtttaaatgccctgctcagcaggaagtctagaaagatttgttcaactgaaatgagcttataatcaggctttcatccaaagataaggaaagacaacatccagtagttttatgatgcactcttaccaggaaaacacaaatagttttgtccatgttgtgcagcgttgactcctgtatagcatatttcaaactgcaatcatgaaaatgttccatttccgactaagaagaaaaagtcacccatgaaacttgacaccgtaccttcattttttttttagcaatgaacaaaaaatacacattgttagtgtcacccattctattttttcattttctttttatgatttagaggtgttcctaagacttgcaattatttaaataaaattattgtagcatttttaggggtcattggtacatttactcagcaaagttagctgcctgaaagacagattaactgctaatcagtgcttaatgagggctttgccacgccatgtttgagcacttgtcagtataagaatatcgattagtaaagccaccttttggacttattgttggtaaactgggttgatttctgaggtggataaaatgcatggctagatattctgtccactgtgctgttggcaggctgttgtttatcacaaggttttagtgttcttaatgaactgttaataagctgtcaattatagtgtttatgcaaattagggaaagagacattgaaggattgatgtgcctagcattaaaaatgccttcttgatacgttataaagtaaataattccccttttaataattgtccttaaacatttgctcttctttgccactgaagcattcccacgttgggcaccctggaaaacaatagtccaggacttctttaagcattatactgagaaaacaagacacatctatctctaggatgtactttgctttatgttagcaattctggaatcattttcattcaccctcggccgtaagtgaagttcaatatcaagtgttctgaaattcatgggtagctattctatgattctcatgtggggcatccatttttgcctttcttcccactggagaccatcgaccatggcgaagcaacctcctcaaccccttaaatgtcctgcgctaatggtagctgtcccaagtcccatgtgctttgtagtgcctcagattatctctttagtacaaatcctttgtgtggttataaattgtcaactgaaactatttcttttaaaaatctgcttctctgcctctgtcccggcagaaatacctgtctttggccagaaaatccattaattttctattctgggtttttgtttttttatttcatatgcccttgaatgtgttgacctaacatgccccacctgacgtccttcaaggacctatacaattgtcttgttctctcagtcattcttccggccccgtttacccaggcagaataaatcagttcctttctgcagcagccccagagtactttaaatgagttagatatattccagcaccccccacccctattctgcacacacacacattcagaaattgtgagctctttcagggcttggcctgctatttattcatcttcagaaatcatgtcattcaatgttagaaaatagctacctcaagacactctggaagaaattctgctcagatttccattttataataaaactaaggttattaaatggttcccaatatttaaaaggataataattttgccgcaatctcgtcacttttatttttaattgttgtgatcagaattctatccagatagttattatgggagaacaattcctgaagaatgcttaacctctcaatacaattaaagtagacatcttttaaaggctcttaatattccccccagaaatgtaaaattacatcttgttttgtattgtggaagtcatgttttgattatatgaaattggtattttacgtgaaaaaaaaaatcttctgttcagcttggagcatgaaggtttgtgcagttgttagcacattacttattccaaaatcattgaaaatattattcttgcaggtttggggttttttctaacctcattcgctcagctctgggagttataatgtttcataaaggaagtatcataatctacagcaaaaatcatgcatccatatcagttgaaatgatggattaagctgttttattataagtatatcacaaatgcaataaatatttgccaatgaaatgcagttatcataaggttttgcacagtgcaatttcatgttaatgtccaagtagaatatagatggctttatatgtttggttatagtacctgctttgcagtttgaaaaatttatttgtaagtgttgaaaatataaatatgagagttcaaagtatctatgagttatttctaaataccacttaactcctcccaaggcagatgaggatagtataaaactgcaattctcgtgactgataaatcaaatgaaataatccaataaactggaagaaaaattgtgaattggtcttctgagaggcaagagagcatgctggtaagagcttggactccgaggtcaacaagtatcttgaccttctggcaccttcgtttgtaagtgtggagataacacccagctcctaggatggccttggagattaaatgagtttgggataacaaatagcactcagtgagggcttactatgtgccaggtactatccaaatgcaaatttcaatttctaaattttaatctctctctttaatcaaacatacagcttttgatatttgatatgcattcttgtattttcctcttaggtgcttttcagttatcttcctgagaatttgtgcattttatgtagaaataagataaaatacacaagatataatatcctactggtccttaattccacagcttaataactgtatgaacatgggaaattacttaatctctctgcgtctcagtttcttcaactataaaataacaatgctgctgctgctgctgctgctgatgatgatgatgatggtgaagatgatgacacctatttcatggggctgttgtgaaaattgagatgatccctgttaagtatttagcagagtgcctgacagtgagtgctcaatcacttattattattgctggtaatactgtcgttagcattacttttgctgttattaatgtagtgtgatttatttttaaattagggtcaattgaaggaactgggaatattttgtgagtaagggtttttatgtatatcacattcgttcttctcataacctgccaccctcctcatttttgttactgggaatgaaatcgacttcaaaataaacctaagaacccggactcccttggatctgacactgaccccagacgccaagccacagaggagtatgctgcagtcattctctctttgaaattctaattaaaaatacattttaaaagttttttaaatgcatgtttttcttgaattctgatatgagccatgcaatataaaatggcactgtaacatctcttcaaatatgcgcacttctattcacaatagtattttaaaaagtaatcttacaaaagttttatttaaaaataccttgccaggtgtggtagtgcatgtctgtagtcccagctgttcaggaggctacccctcttgggtttgttttctctaaaataaacctgtccttaattgtcaagacaccgttcatgtttctttcctctttctttaattcttacaggggtgggaagattgcttgagcccaagtgtttgagaccaacctgggcaacatagtgacaccttgcctttacaaaaaaaaaaaaaaaaaaaattctagatttaagcattttggtaatgcttccatttcactgcttctttcttaactgttttggtgtgattgcgatccattttgtagttcactaatttggtatttaactgaactgatctgtcagatctatcaaaacatgggctgttgatacaatttgagctatttcttcatcgtacctgtgtttactttgagagtttatcagcgaatgtttatcaggaatttggaagcctagcagcaaggtgaattctagaagaaaaaaaaatcaacaacatatgctctacatttttttcaatactaaattgatcatctcaaacattattttcactacaaaaacctccatgagtcacataaatagcttgtcctttcaagatcatagaataaaaactacaaggacagatgtgctctagatgtcatttcccagctggggcactgtgagcaacatggcaggggtgaaagaacaacatgtggtcaggatgccttcgtgtgttcagtttttattttcaaagaaaaagtaaaaaaaaggatgaaagaagtggggaaggaagagagggagggagaaagaaagagaaagaaaaagagaaagacaaaacaaccaaaagaaacagaaaggccgggcgcggtggctcacggctgtaataccaacactttgggaggccaaggtcgtggatcacctgaggttgggggttcgagataagcctggccaacagggtgaaaccccatctctactaatgatacaaaaattagctgggcgtggtggtgggcacctgtaatcccagctacttgggaggctgaggcagcagaattgcttgaacccaggaggtggatagtccagtgagccgagatcacaccactgcactctggcctgggtgacaagagtgaaacatctcaggaaaaaaagaaaggaaggaagggaaggaagggaagcaaggggaggaagagaaggaagggaaggaagggagggagggaaggatgggaaggaagggaaggacgggaaggaagggaaggaaggaaggacgggaaggaagggaaggaagggacgggagggaaggaagggaaggaagaaaggacggaaaggaagggaaggaagggacgggagggaaggaagggaaggaaggaaggacgggaaggaagggaaggaagggacgggagggaaggaagggaaggaagaaaggacggaaaggaagggaaggaagggaaggaaggaaggacgggaaggaagggaaggaagggaaggaaggaaggacggaaaggaagggaaggaagggacgggagggaaggaagggaagaaggaaggacggaaaggaagggaaggaagggaaggaaggaaggacggaaaggaagggaaggaagggaaggaaggaaggacgggaaggaagggaaggaaggaaggaaggaaagaaagaaaaagagaaagaagccaacaataataattcctggtttcagtatctggtattctagtgtatttttccattcagattcactaattcagaattttctctattccctcctttttttgtctgttactattaatttatgcaagtcttttactatctcaatttaaaatgagtattttctttctataaaaggcaaaatgctatagatacagagatcatgctgtctcctcaatagatatatgagttttttaaaaaattaattactattatggctacattgaaatgattagtaggaaatgaatctaaattgcttctaaaacaataaagtttaagtgcctcagtaaccctatcctttgaataaatacaaccaaattttagttaggtaaattttgttttgcaaacttctacaggttattgaaattcttaaagactgctattgtgtttttttaaaaataacattttggtcttcaaatacgttactaatcagcagcattcatttatggtatacctaaaacatgctagtaaaactgtaagcttctttcttccttttttattttatatatgctcattcaaatttgactacttcaaagttttgaaattgagaaaaaagaatttgaaatttcacatgtgcctttgcaaaaagtaaaatgattaatttgcctgcaatgcttttacagtgtgtcatactgaaggcttgaaggatgtatttgatcttatcttaaaattgagtggccttgttttagtatataactctgaacaatgaaaaaaaagagcattttctgtatcccaggttgcttttataaatgatatccaccttcaataattgttcaatcgaggccgagctcagtgcatagagacaagaatgtatttcttctctttcttaacagtggtcagggccttacacaaggatgtgttcatgttttgttcctttgggcttcttgaggctcatggtagttcactgagaacatgttccatcactattaaaaataatgtccttcttcatcagtaacatcctaatgtcctttaagtgttaaacccatccctttctgcattcccagaaagtatttttatacacgtgtgtttttttctctctcctggcaaatctataaatggaatttttgaatggaatcctatgatataaatatcttttaaagctttctcatagttttacctgctttgcaatgagccattttctcttcaaaatcaatgcctctcattaagacaacttctggcagggatgaggatctagcatcagtttatagaaaagtggtcatgattttgcctctgggtttgttttaattgttcctctccatgcagcaagctctgtggtttgagtagcagagaattcatttgtaagcttgcctcctatgtttctcaaaagattgttgtgaggactaaattaatccatccaaaattacttactgcacatctcctctgtgccaggccctgctacaggtgctgcagacatccgtgtaaacaagccagtccctgtgttcatggaatgtaatttggaagtagggggagcctgaaaatgaacaagacaaaagcacaagtgaggactgaagaatagaaaataaaatataacttgtggggagagccgtggaggtcatcaggaaggtcagggaaattctctttctctctctctctctcttttttttttttttttttttttgacttagtctcactctgcccaggctggagtgcagtgaagcgaccgcggctcagtgcaacctccgcctcccaggttcaagcgattctcctgcctcagcctcctgagtagctgggattacaggtgtccaccaccatgtccggctaatttttatatttttagtacagacagggtttcaccatgttggccaggctggtctcaaactcctgacctcaggtgatccaccctccttggcctcccaaagtgctgggattacaggaggaaactctcttaaaatacatcatgtaagctgagaggagacttacaaaaaggagatagccacaaggaaacctgggagaagatagcatggccaaatgtcctgagaagaatgaatgtggagtgctggtagaaggaagggaatgagtggctgaggtggagggcagaaaagattagactggtggggagagtacaggggcaaaatcatctaaggctgtgatctctaaggagttttgattttattttaagtggcagagaaaccaacggagaggtttgtctggaagggaataatgtgatatactctacattaaaaaataataattatgtatgtaaaaatctaccaagattgaatcctgactctgccacttacttccctaagcctcagttttgttatctgtaaaatggccatcacgatcaatcaaactcgtacggtagagattaaataaaataatcaacgtaatgtgctttgtccaccataagtattcaacagaaggaggtgttcatttaggtttttcttagaagtccccttggttctccagcctgggccgttcattagtttattttgtgctctcctcctgtcccttaatatctgaaatttttgacaattttctctgagattcctggcatttgggcttccggagatggcggggggtctggtttgctgtctgttaattttagctattctccgctggaagtgccatcacaactagaataaccagagagaatgggaggtggtgcagcctattaagtggccccatggggctgccctagcagcaaaaatcaaaacaaacaaacagaatcccaaaacaggtttgggctttaggggttttgaaaaatggacatttttcccattaataacatatccgttaaactctactgtgacagctctcacaaagtttcttctaataacaacatttctaatccaaaatcattcattctgcctacaaatgtcagagccaaacaatacctagcagataatttggtccacagttttcaagaatacagggagtagaaaatagaaataggtaatctactgctatgtcatatttccaatgtttctatgcaagccaatcactttatggagcctgaaaaattcaagaattttaatgattcgaaatatctagttgaatggctggtaatcttctctcttatttggggaatcccaaagctaaagttgtacataaagaaagaatttaaacctttgaatatagaacaaatgatctacgaatctttattgttagcctagccataatattactatgaaattttcatagtgagggcataacatttagattttaggtcattaagacaattatcaatttctttttatctgaaccattacatatggaagaaaatgatgtaccttatttcattgcttggttaatatcagcctgtgaaagagaaagatattttcagaagagatacaaaatgacttaggttagttcccccatatttaggttgatagcaaagaaggcaggaaaaatatttttagaatgttaaagctgggacaaaagtgtatcgcaagtaatttgggtatcaaggggaaaaacattaaaaatctttgatagaaagtgaagaaaattattttaaaaatgagagtacttcttaacaaccaagattcaggaaaagtttgaatgaaaggaaatttaagacagttgttttgcattacattattatatctctcctttctctttgcctagctaatgttgtctaaaaaatagattgcattcaatcttgaaatatatatgtatacttccctatctacatctatctatatacacaacaacagacatttatcgatttatatatccatgtacatattaatcataacttaggaatgacaagataaacttgtttttcctaccacccagtgttttttaaaaaggcgttctctgttaatacagaataactgcaaataatattttcatgactatgtcatatgaataaaataggaattttaatcatttatgtatttacagtgagaatcattatgaatttatgattttacatttagctcatgattccaaggtgtgatatatatatatacatatatatatacatatatatgtatatatatatgtatatatatatatatatggaagttcaatgctttctgtaaactggaattttaagtgtatatctacacttgagaaaaataatggtcaagataagagaaaaatatatggaagttaaattctaatgcagtaaaaacccccctggaaacaaactgttacccctggtcaattactcacttgccaccatagatttttaggagagattcgcaatatgggaaagcacagtgagtggtttacctccataaaacagctcatcatcaacgtgaactcgtatttaaatctgaattaccagcatctgaatttttcagcatgaggcagcaaaagattgaaaagcagtgttttctgatattgctctaaattatgatttccatagatataacctttatcatttcttctccataccggaaaaataaaaaccggttaaggtaaccccactgcattcttttcttctgcttgttgtacacttcacagtcacagagtgaatcagctttgctaaacgcattcattagtgcccaatttgtttctcttcatctctttgaagaaatcttgcaagctgttggaacgcttattttattttgattccacagtggaaaattgtattcacataagtaagcatataccaaacagcaataaatcattatttctcagatgaccaatatcagcaggaatctcatatacttctctgctggagttgatttccaaattcattgaataattattggtgctgcttttcataagtgaaaaacattttttcctttctattccagttaacttttaaatgctacctttctccctcatttccaccgcacatctgagaattatttgtaaaggagggaaaaagtcaaactttgtattcagcaaatgtcaaggtggttagatggaatataacccttgacaactgccccaccagccctgaaatttagacgttcatagtatgtactttggtcaaagattgaatatcatgttagactgttgataaatgaaataaatacacgttattgctttaatgttttaaggaaaatctgagaatttattagagtgctttaaaatgcaacatttagactagtaaatttctgttttcttttgctctgccaaaagacaacaatttattgttgtttcacttcccaaagtattaattggattttggtaataaatattgaatttttttttttagtaacagacacatgcatttctgtattttttccttaacaaagtttattaacagcaggtaatctgtatactttgacctgaaaatgaatttataaaatatctgttggtgtcaagtccattttaatacagattaaatatcgtggccatgttctacaaagtgtgagttctctactcagtatatttttaatggcttctgtacacactgtattatgttaggtgttgttataaggaaacaaccaaaaaagattttaaaattaatttcagaacttagacttgagaagggtaacagtatcaggtggagattaagactaatatgtagattctttctgtttatgctgttactctttcaaagattattttcccctcttatgctttttattgctgttcttgatttttttgagctactaattgttagctaagttaaagcaatttaaaggatatatatttctaaattggtttttttctttgagttaaaacctgaacatagctaatacttgagcataaagtaatgtgacatttgtactattggtatcgtcctatcaagtatatagtctttctattaatctccacattgatcttttcctcctaaagtgaaaatatggtataaatatttacataattcaaaaaataatgataaactctaagaaacattttcgtgtaaaacatcattgttcacattatgatcttatctttttatgaggaaagcctcctaatctttaaattgatatatttacaaaaagcacaatatagttcagatctttgaaccatccagggtaagtcaatatgatatttttaataaaacggtatagatgtaactacaaaattatcaatgtaacatatctttgtattatcttgtgttgagatcctttagcttctacaaaaaaatttaatatgaaaatgagttttaattagcataataaacagcttacatttcagatatcctactacatcttaatataactcttattaaataagtatatattggaatcatattaattcattcagataattagggctgggcgcagtggctcacgcctgtaataccagcactttgggaggccgagatgggcaaatcatgaggtcaggagttcgagaccagcctggccaacatggagaaactccatctctactaaaaatacaaaaaattagctggatatggtggcaggtgcccgtactactcaggaggctgaggtaggagaatcgattgaacccgggaggcagaggttgcagtgagctgagatgtgctgctgcgctccagcctgggcaacagtgaaagactctatctcaaaaaaaaaaaaaaaaaaaaaaaaaagacaaataatttaataatataggaaaacatttttaaactagacaagacaaaatttttaatgtttattctcaaaatactcaaccaaattgttttcaaaataagtattttatatttcagatgtaatctcaaaaaatgaatttttattcaattatggagcttctgaacttcatacattcatttaaaaatcattaaaaatgattaagaagtccacaacacaatactctgtcttgtctgaattttatgtggatttagtataatgaaaactttagaagtatatgacaggacattaaattcatgactccatattaataaagtagctaaggcttaaaatattagaatatacagccataatatattattatttatggacagcatctattctcatgcaaagaaaatacacacgtagttcaaattctgtgagtttctttgaccttatggaaaagaagaaaattatagattcagatgtagattagttattgagttgaatatgtcaaattacccaactaccttcttgttcagaaattaacaaaatagcagatagaaccacttgactggagataacttatctagtagttgatgccaacgtagtggcaatatatatagcattccaatctagattttctatacctcatttatggatcacctgtttattttcttaagcaattctccaataagcagagtcattttctattgtacatcttatcagtagtttcatgggggggaaaggaataatgtaatcagagagatctggagaatactgtgtagtcaatgccttagatactgatatgatttagctgtgtccccacccaagtctcatcttgaactgtaactcccacaattcccacatgttgtaggaggaacctggtgggatgtgtttgaattatgggggcaagtctttcctacgctgttatcgtgatattgaatgagtctcacaagatctgatggtttaacaaggagaaacccgttttgcttgactctcattctctctattgcctgctgcgatgtaagatgtgcctttcaccttctgccatgattgtgagggctccccagcagtgtggaactgtgaatctaattaaacctctttcttttgtaaattacccactctgggggtatgtttttatcagcagcatgaaaatgaactaatacagaaaattggtaccagtagagtggggagctgctgaaaagatacctgaaaatatggaagcaactttggaactgggtaacaggcagaggctggaacagtttggagggttcagaagaagataaaaaaatgtgggaaagtttgggactccctagagacttgttgaatggctttgaccaaaatgctgataatgatatggacaataaaatccaggctgaggtggtctcagatggggatgaggaacttgttgggaagtggagcaaaggtgactcttgttatatttcagcaaagagattagcagcattttgcccctgccctagagatctgtggaactttgaacttgagagagatgagtcaggatacctggtagaagaaatttctttttctttttttttcttttttttttttttttttttgagacagagttttgctgtgtctcccaggctggagtgcagtggcaccatcttggctcactgtaacctctgcctgcctgggttcaagcgattctcctgcctcagcctcccgagtagctggggttacagttgcccaccaccacacccggctaatttttgtatttttagtagagacagggtttcaccgtgttggccaggctggtcttgcctcagcctcctgagtagctgggattacaggtgcctaccaccacacccagctaatttttgtatttttagtagagacaggattttcccacgttggccaggctggtctcgaactcctgacctcaagtgttccccccacctcagcctcccaaaattctgggattacaggtgtgaaccactggccagaagaaatttctaagcagcaaagcattcaagaggtaatttgggtgctgttaaaggtattcagtttcaaaagggagacagcaaaaaagtttggaaaatttgcagcctaataatgcgatagaaaagaaaatctcattttctgagaagaaattcaagctggctgctgaaatttgtataagtaacgaggagcctaatgttaatctccaaggcaacggggaaagtgtctccagggcatgtcagaggtcttcaaagcagcctgtcccatcacagacccagaggactaggagaaaatggtttcatggactgggcccagggttcccgtgctgtgtgtagtctagggacttggtgccctgtgtcccacccactgcagccatgactaaaaggggccaaggtgcatacagctcgggctcttccttcggagggtgaaagccttaagccttggcatcttccacgtggtgttgagcctgcaggtgcacagaagtcaagaattgaggtttgggaacctccgcctacatttcagaagatgtatggaaatgcctggatgcctagggaaaagtttgctgcaggggcgagccctcacggagaacctctgctagggcagtgtagaagggatatatggggttggagccccctcacagagtccctactggggcaccgcctagtgcagctgtgagaagagggccaccatcctccagaccccagaatggtagatccaccgacagcttgtactgtgtgcctggaaaagccagacactcaacaccagcccgtgagagcagccaggaggggggctataccctacaaagccacaggggtggagctgcccaagaccatgggaacccacctcttgcatcagcatgacctggatgcgagacttggaatcaaaggagatcattttggagctttaagatttgactgccctgccagatttcggacttgcataaggcccgtagccccttggttttggccaatgtcttccatttggaatggctgtatttatcgaatgcctgtacccccattgtatctaagaagtaactaacttgcttttgattttacatgctcataggcagaagggacttgcctcatctcagatgagactttggacttgtggacttttgagttaatgctgaaatgagttaagattttgggggactgttgggaagacatgattggttttggaatgtgaggacatgaaatttgggagtggccaggggctgaagatatggtttggctgtgtccccacccaaatctcatatggaattgtaactcccacaattcccccatgtcataggtagaacccggtgggaggtcattgaattacggctgcgggtctttcctgccctgttcttgtgatagtgaatgagtctcacgagatctgatgatttgaaaaggacaaacccatttctcttgattctcattctctcttgcctgctgtgatgtaagacatgcctttcaccttcagccatgattgtgaggcctccgcagccacgtggaactgggagtcgaattaaacctctttcttttgtaaattacctaatcttggatatcgttattagcagcatgaaaaccaactaatacagatacattgaagttctcagagttccaacagagaacacatctctttaacacagtgtctcccaaaatataatttaataatcattacttattaataatccacagaataatgcagtgtttgagattcctccatataaaatatagtctactatgaactatctgataatccaggttaatttgtaatctgctttcaatccatctttccgactttagtttcaccaggaagtctatactccatccaaaatgaactatgtacttttttccgcaaggatccaaaaagtgttcctctgatgtgcctttttttgcttatgttttcttcctctttatggaatgcctatcgcctctccctttttacttttccatgttcaaaaccaaaagtgcatgtaggcacttcacagacatatacacaaaacagtttacttacaaaatggtgttcttctaggtgttcagctttgcaatcaacatactaaatggagcttgaacaggctggagtgcagtggcgccatctcggctcactgcaagctctgcctcctgagttcacggtattctcctgcctcagcctcccaagtagctgggactacaggtgactgccaccacgcctggctaatttttttctttgtattttttagtagagacggggtttcacgctgttagccaggatggtctcgatctcctgacctcgtgattcgtccgccttggcctcccaaagtgctgggattataggcatgagccaccgcatctggcctgaacaaacatttttaatggtgtccgtgcaaagtgtatctaagtagtaatcatgtcaggtactgctatgaggaaaacaggtaagcgaagttttttgtttgatagtttgctttttgagacggaccttcgctcttgtcacccagactggagtgcaatggcacgatctcagctcactgcaacctccgcctccggagttcaagcacttctcctgcctcagcctcccgagtagctgggatgacaggcgcccaccaccacgctcggctagttttttgtatttttagtagaaacgcgtttcactatgttagccaggctagtctcaaactcctgacctcaggtgatccacccgcctcagcctctcaaagtgctgggattacaggcatgagccgccgcaccgggccgccaagtttttacacatatgccatgtgagagagttggtattgagtttttcaaaggaggcagaggtgatcaggttagttttaatggagagggtagggcctacatcatatcttgatgaaataatgtaggctgataactttttgcatatatgattagaagctttaaagtcattggacactgctctggatgggcagacttggaaaggagatggtttgctctgcagagatgctcaaccttttttggcttagatacatgaatggcgggttgcttcctaatacgtgatttgatgattgaacaactgttaagggcaccaaattcagtggtgtaaacatctcaaatcgaatcctgcctttgctcattgttacttaaccttcctaggctagtgtcttcctctgacaactagaataacaatgccaatatcttaaagtcaaagcatgaattaataatacactgcatgtattcatgcatggaccctaggatatatgcagtgtattattaattcatgcatgaatataatacactgcatataataataatgaattaacatgcacgaataatacaatgcacataataatacactttacataatagattggcatgtagtaactttctatatgtggatactgttatttacattatccttcttcatctgtttgctactcctcctctcagacaaagccaggaagaattctatggcattttatccatattcaccactttgaaagtcatgaagcattcttaacaacctatatattttatgaaaagaataaaattataaatcactaccgtggccacattttaaaagatataatattttatctatattgcattattgccaattcaaatttagttatataataaaggaattatataatttaaactgttgaccatctcttgtagctggaaaaatgtcctgttttacatggtagccctaacctttcccagattaccacagtctgatgttttcagacataattcatttgcagtaaatagattttatttttaaaatggtctatccagccctttatatgttataaccagatccagttttaatgagataactatagataatagggtcatattttcatgtctcttaaataatatattgagatcattctacttataacaatgtaatgaaaataaatgtttttttgttattgaatagaatttccataatacaatgagtttcctgagataaaagcttcaatgctaagtgaaatgtagaactaggacaatgatcctaatggagagatggctaatagtgttcatccaatgtgccaacttcagcccattggaaatggcttcctggatccccgcattgaaaaggattatgaagcataatctaggcttggaaacaaaatgtgtcacattggttattaatataggagctgaaaatgagggtcttctgtacatatcatttctgttcaaatgaaacatatatataatgtccataataactagagcatgaaaacaaagaagaaactagaatattttctattcaatattgtggtaaatattggacatcctgaaaataaaaaggcactatgtaatatgaatcctgggcaacctttgatccttcttttaattttcttttccttatgtcttctatcttcccagtctccccccatcctctcttctctttccttcttctgctctgtttctgggtctctttctctttcttttctcctttttccttccttcttctaactttttgtgcatctacagtgtgcttggatactaagccaggagcccaagtaagtcaacagtctgtggcagattagaaaggcagcgcagcactgtttggttgtatccaatcggtcatttgtaattagtcctgatcacatagaggactccagctggcttttcctgaccagcatatggatgttccaaactgctatttgctaacctcctccccaacttcccagcaagctaatgacccaggaggcagccatttcccaccccactcctagaggtaatggagagcaggctgcgttgaaaatgcctgcatgctcagccatgcatagaatctttctaggactgctctcattcatggagagttaattgtcctttgggtttcctaggtattaatctaatgtctacctgaatattaactcttttttcaagcccagctaaaggcaccttttgccataatactgagcatatgctaaaagtaatctttatataccagtttgaagggaggcaaagtgatattccaaggaaatttagcattaaccactggctgttacccatctctacattagccaaagctgataattttgtatcgtttggattccctcaattcttcatttttcaagtaaaattgctctataacgctattgataaatgtttttggaagtcactcatcaaatatcttgcatactttatcagcgtgtgcttcattaaatgtaatttgggtttattcaactgtttttctgcttttctatcagctgaaacccagaaatcctcttttatcatattcaatggggaaaatcaattgcaaagtaattttgcttcctatttcatctgcagataagttgctgttgctgatatgtagtcctgtggtatggtcttaaccctttctcttggatggaaatgagaggaagaaaaattacctcccgctttcatacgtatgttgatgaagggctgaagaagtctttctctacttcataataattttatttttctccttttggaaatgagtttatgtgcttctcttgcgatgatgggtaaggcagtgtagaatatcttctcttggaaggatgtgcaactatagagaagggtcacagctggagcatcccttgctgagtttgcctagaatctggtgtcttctttgccacctacttggcatgtgttcttgggtaaaccccctaagctttctgggcctcgggtttttgctttaaaaatttgtttatgccaaagaaaagaagagaaattttaaaaagaaaagaaaagaaatgcattcttctttttaaaattaggatgttgttgaactattttctccaccatgaaatcttgcatttgaaaacccaggccccttcctcccctttcaatgggaaattattttaataaatttttatcattctttgactcttttttcattcagtgatattttctgagatctgttcttatcatgttgacacataactagatttgattacttttaactgtttctagcattacattacataaatgaatattttattcaaccagttactattcatactattatttgcaatatgtctttattatacaaaatgctgtgataaacattcttgcacatgtgtgtgagtgggctctctaaacccataactagaaatggattctagattatagaacagtttttaatgtttatatatattgcccaattcccttctaagtagtaatatcactcaagttcccaccagcagcctaggaaatgtccatttcccatgatcttaccaacacttgatattgttgataggaaagttgaacttttcttgccaattttatcagaaaaaaaaaatccttttaactagtatttcttatttccatttttatttaaatatataaagtggggaaattaacttttctaataaaaataatgaaaattgattttaaaaagagcttaaaatttattagagatttaagagttctctgaagcatttttcagaaatagcattgtttgcctgtgtcatggaattattcattcagtaggttaaaaaattgcataatatggtcaaattttcagtgagagctctcactcctaacatccttagtgcaaggggtctgctatttatgtgaccgttcctgttgaatttatcatgggtcagttatgaaaacacaggaaccctgctccaattattcagaagtcattgacttggagttgctcaatttgcttatacaggaaagagttgttaaacattatcctttctgggctaaaaatgaagttgcagtgtgtacagaagtttgccaatgcacaaaaggtcacactgattgatgggctttgaaaattggccatttatgtcaagaaggagatgatgataaggtttattattctgtgaaagtcttccaagtggtgaggacatgtcaatagcacaactttttctccttttgctttatcctttgaaataatgagtcatgaaaccagagagttggcatgcagtatggccggcttcctcatgcacttcataatgctgatctagtagtggttggcaaattagtgctcgggtaccaaatccagcttcaagcctgtttttgtagataaagttttattagaacaaattaagaaaatcccattcgtttatgtattgtctatgctttcttgtcccacaaagacagagttgaaaagttctaacagaccatctgatgctaaacttagaatttttactctctggccctttgcagaaaagggttactgatccctggtggaacctgccgtagacttcatttgaaagtttgattgttaatagctatgtgaattctgtgcttttattaccttgaaacatttaaagaacttttagtaattctcttagcagatggattataattgttggaagcttataatgaaattctaagtttataaaatatttttgtttgtcctaaaagaggtgaggataatagtataagtacttctgaaatatgttttgcctcacagtaaacattaatttaaaccatgtattttgtttcctatgttttctaatttattattaaaataatgtcacctttaacttgaaaacaggggacttattttacacagtaactctttaacttttaaaattaaaaaagacagttaaattatggtttatggatttttgtagtgtttaatttaatggtaagaaatctgtcttatgattacgcaaaacatctgtttttttatcccagtaagttaattcattaagttcaaaaagtcttacttaaaatagccctaaaatattagcatattcattggcacataaatgtttaataattatattttatatttccttaatttgtagtgactattattatggtggtagataagtaagatagtctccagagattctactgattcaagaaaatactacgagcctcatattttaatagcatgtctttgtcataaagaagaaccaccatcaaagtcttgagaaacacaatattaactttcttttatatttctacacttccaatatccagtagatatgtctcaaagtcatacacatttgcttatgcacacatgcacacatacacatacacacacacacacacacacacaatccttaattctgccatgacaaaaattacattggtgactttcacatgtaacaaatgaacaagctgttaactaagaaaattcagacatttggggacaactaaaagtcagtataaaactaatgaattgctggaaggcaaatcagaaattactgttggcaaatatctaaaataagaacagaaataatcacacctgaaacaaactcaagttgaaagatgcatccctacttatacttcacgtagagaaagaacctatagaagtaggttactgatcctacaatgaataaaaccagattcctcttccaaaacttgttgcaattcaccaattcattagtttttactatattgtttgtagtaattttatgctagtaagagtttatgctgaaccaggaatatgatgggaatctgtgtcttttctaatctgtagcctacgtacctggcactgggtaaaagctcagtaaacttttgcaataaatgagcattggggcaagtattaaaacagattattatactgaaaatacgattctaggaaacggcccccaagcaagtgtgatcaaactcagtacagacactttattatacacattttctcatcacttacacatcaaagtgatcacaggttctaagtctgtgagcctgttttcccatttggaagaataagtacaataatgttacctatttgctagggttgatttgagcattaagagttattatatattaagcacttagaaaagcctggtatgtagcaaatagctcaatattacctgcttgtaatagtagtagcacttgtagtggtagtagtattgatagtagtagtatccaaaagcatcttttgatatccctacatttccccatttaatgtgtaaataaataataccaatattagcaaatgcattgtctagagcattcatcatcagagataagtgtaagccaatcatgtttgttcattccgaagatacttactatatgtcaggcttattataaaccatatgattatatatatatatatatatatatatagagagagagagagagagagagagagagagagagtgtcaggtgttgtcttgttgttgggcaggtagattggagatgagtaaagctcttgtcctgcccttgatgtgcatgcagcccaggaagggaaacattatgtaagcaagtaatttcaaagccgcatagcaattttatccaatgcaaagttatagactatgagaagtcagcagcaaataactaaaaattgttttaaatggaacttgtacatacattttatcctcccaataaccctacaatatcagtctcacctatgagaaagctaaaaggttgagtcacaaccctagaatatcctataggcagtgtaaaaaaggcaggattgaaccaggtcttaagagtccacagcctgtggttttccagcccctctgccattgcttgtctgggagatggaaagttttggctgggacatccctcactcaatggtgtaactgcccaaaccgtccctggtctggacgccacaaatggagcagaaagagaaagggagagaagccatttcattgtaggactcttgaccacagtctgttcagtctggcctggtttcttcttggtgcttatgtacgtgctaattgccatggctaaatggtgtcattgtggataataatgctgtgatgaaatgtttaatctcccctagggtttggtggacattttcagctgctgatctagtgataagctgggcaatgggagggaagctactccacttcaaaaattatcttcttgtttccgggtaatcacttgttggcaaatatattaaataaagactgatatttaaataaaagtgctttgaactgggataaaatatttatacacagtttgaatttagtgttttgtcaaaggtttttctcctcctggactctgaaaggcgagtgaacactgaaagactgtctctctcatctctcacctattgatgagatccatccagaccaggctgaaaaatcttgtgatcagtgcatgtaagcattccctcctggtcctctacctctaaagcctggaagagatctacacatacaaatagtggcccagcaccccattttctctgtttggcattgattaaatcactccttcatctagtttggaaagtttatcatctaaagctgtatccacacatttcttgggccagttacactgttaatttcttataccattctaatatgtgacttggaactgatccgttgctgtgtataagaagtccagaaaactaccttcactttgttttattcttagtttgcctgaactgttacccataacattttatccccaacatattttgttatgaataccttcaaacatgcaataaagttgtaaaagttatggagtaaacctatcaacttttttggggggggggatttgtacccatgtgatgtctaacttttgtgacttagctagtgtcttaattttttactcaccccatctcagtttttgaaacacgcacacacacacacacacacacacacacacacacagacatacatacagatactttctaggtattagttatgggttgagtatcctttatttgaaatgcttggagccggaagtttttcagattttttataatttttagattttagaatatttgtataataccagttgaacatctcaaatccaaaaatccaaaactcgaaatgctccaaatgagggttcctttgagcatcatgtggtgcttaagaagttttggaattggaagcatttcacattggggttttcagatttggaatgttccaaactgtataacaaatgactgagtgtgtggaatttatattgtactatacctggatctaaagcttctgtgtgcctctaggttagcctcagagcctccctcagcctcaatttctatcctatgaaatacagatagcaaatcccattctaaagattattgtttgaattaaataaagcaacatgtgctaagaatctggcacaaaccctggccctagccctggcacttaataaatagtagctgttttaaattattactatatgatgtgtacttggttatttaaatatgttaaaagtacatttaaattattctacattaatgtgtattaaaatagtttggacctgggttttgttcgtttgtttctctttgcttgtttggtttttcttttccgtagagaatttaacaattttacttgatccttgaagaactactgagttgttacaactttgacttgggtgaggatctcttacgtgaggctcagccagtaaagttttatttccagtaaaaggggccaaggagtgctttgcaaacctgaagagtaacacctgaccccattcataccacatggaactgcttccccctggaaattctgggctttctcccaaatgcttcatttgaaggtgaatgccttgtgaaaaatgccacatatgtgcctctctctctactaaacagttaatgtagaataccagaaaagatcccctgcccatgctgtctttcttaatgaatggtgacaatgcactaatttaagtacaattggcccagcatctctcattgtgacagaggcgtttccaccgaggaaagtggcaagggtactctgagattgtgggcttgtccagggctgagtttgatttatgaaatgagacctaggagcctggattgaacagattggcttgcaagagacagctgtactggaggagctgctgccaggtatgggtagtggaaatagagaaaaatgaacagtgggataaaaattcctttcccagtccctacttatcaacatgaaacatctgcttcagctacagtggttcccagtggcagtcagaattattgatatggcaaaatcgctgcttatatgcagcacaatggcatgtccccccacccctactggctgcattgtaataattcattactgtaccagtgcgaccaaagacaccatggatgtgaaaggggagttagtgccagggcaattgtgcaaatggtgagggtggtggaagaaagttttcaccacgagcaataaatttctgcctgctgttctattttattgtggctcgacacagtgattatactggttggaaaataagcaataagcgtctgtctgtctccagttgtttttaatattcttgtttaatgggagaacatagcttttatttaaactaaacataacggatgcattttaagatttggatcggtttttgaaaaaaaagtatcttgctatctcgtatgttaggtaagcatatgctgctataaataggaaaacaaatatgcttagttcagctttttgttagataaaatttgattagggatgtgcaaaagctgatgctgtcagccaacacatagcaccaggaagcaatacatactatgttagaatgaaaattaaatgcatttattaccagggaaactggttttgcaggaacgtaccgagaaagtttacatgctcaaataaataggaactcgaattccttaatttcagtaatatcactttataatgcatgctggtaaacttgtgtatgagtttccatggtggctgaaggatgattagaaaaagatttgctaagccaagttcttgtggttcttaacctattctaagaagcggggcaatgcaaaaatataaaggaaaaacaagagcccacacctgtaaagatactttactttcatatgtgtccttactgtttttaacctataaaggaattttagttgtgccttcttatctctgtgataaggcatttatttgtttctaaatgttgacagtaaaaaaaaaaaattggtatgcaaaaatagaaacttttaaattaattttccaaataaaattgtaatgtggccaatttagatgtaaaagctaaagcttgtaggcaagtgtgatatttccttgctgcttttcctgcggtacttagcactagtccttgggatgaaaaaaatattgtttgatgtttcagacaacaatgaaatgaagcattggcaaattaataagcagatcttacctgacagcctggtcactgaagaggttaacacactccagtgctgacaacatgataatgaggatttatggtgagcaggaggtgaaggtgggtgggatgcttccaggctcccatgtgcggtggctccagccccctgcagacataacgcctcaacaagagtgaaggttaccttctggactgtaacaatggctgagctatgtttgtggcagagtgtgcataccctaaagatatgcagatagatagatagatagatagatagatagatagatagatagatagatagatagatagataaagacagtttttaaaataattgtagtcttttatagtttggtgctttctaatttcacatgtatactgagtgaaaacagaattttataatgaaaagaaaagaaatggggccaggtgcagtggctcatgcctgtaatcccagcactttgggaggccaaggtgggtggatcacctaaggccaggagttcaagaccagtctcaccaatacagtgaagccctgtctctactaaaaatacaaaaatgagccatgcatagtggcgcgtacctttaatcccagctactcaggaggctgaggcaggagaatcgcttgaacctgcgaggcggaggttgcagtgagctgagatcccgccattgcactccagcctgggcaaccagggtgaaactctgactcaaagaaaaaagaaaaaaggaaatgaagcattccctttgttgaatataaggtatacagttggtgggtggatggatgaatgcgtggctagatggatggatggatggatgatgggaaattagtttacataacttttaaatatctttatattctttcccctgtctactgttctaattttaaatattatctctcttcttttttctctctatttaaaaactacttttattttcctcaaaaaatgcatgctcattttttgttcaagggtcttggtacctgctttcccctatgactggaacattgttccctggattttcataagacatgttttgatagcccttgagtagacagttcaaagtctcttccacaatgtcagtatcccttaacacatgcagtcatatttcccttattgtttattatttccagaacatatttgtttgtctgttaatgacctctctccttctagaatataagccccataagaacaacgactttgtctaatttctcgttatttcacttgcaccaagaactgtatctcttatttgatgctcagtaaatatttcttgaattcatggtgggtatatatagaaagtaaaactctataagcttattctttgacttttttatatatgtctaccttatatttgaggtccatggatggttctaagttagttaatatttaaaaataatgaatggagggaggattagaaaaaaaagcaagtataatacttctagggccccaaatgatctcagctcacaaggaagcctcaggtttaaatcagcatgtatgttctcaactttcccctcattctcagtcagcattagctcagtttagttttcatgactttcactctgtgctacattagataccttactgggtggtatgacttattagtcaaaagctaaggatgtttctctgtgggatattactattaatatcacatcatatttcactgttctgactctttaatgtgttgatatccgttgttaatatgatattttgcaagactgtacagtctcttatttttttatcataaaaatcattatttcaaaaattgttataactgttacctttgtattacaaaatgaatcactaaactgtttcgtaaaatgtatttccacttctgtacaggatgtccattaaataatgaagatgtacttggtaacagaagtatttatctgcacactctaaattcaagctagttctgttttccctgaggaggcaagttggtgtgccgtttctcatatttaagcgacgatatcttgaccccaagattgtcagagcctccccacaggactccgccatgagattactcagaaggagcctgtaatgagccctctgcacacaccacatggtttcaattacagttttatatgactagacagtgtggtgctgggaaggagcgattgaaaacgatgcaaagggtctttgtcttcgtgcttcagttacctgggcctctgctttcagaatgttcttctacttaatattattcagatttatcttatctgggtgaaggaccagtttctgaagttagggattctgtgttgaaataagagaaacagaaaagaatagtccaggccgcattcctaatcttgtcatgctattcccctttagttttcacacttgtccgagacctctgggatgacgttttctatctcaagggtgctttcaggagcagatgccctatagcaactgattttttttttttttcttgagacggagtctcgctctgtcacccaggctggagtgcagtggcgcgacctgggctcactgcaagctccgcctcccgggttcatgccattcttctgcctccgcctcccaagtagctgggactacaggtgcctgccaccacgcccggctaattttttcgtatttttagtagagacagggtttcacagtgttagccagaatggtctcaatctcctgaccttgtgatccaccctcctcggcctcccaaagtgctgggattacaggcatgagccaccgcgtctggcagcaactgattttttaaaaaggtggtggtgagtgaaagtttcctcaaaattgggggagaaaggtgatggagttttctataacttaaaaagaactatatcagagcataaaacattgcctacatagttctttgtagataaataatagtgacttattaaaaaaataaagtttagacttaagaaacgatctaatagaattggaaatattggctcaaatcagctatgtacttgcttctggcttctgagtggggtgacggacaacttatttcaacatttcctgaaaagctgactctttacaaatgtatgtttattgaatgttagagatgagtgtggtcctagactggaaggttccgtgggaggagggtctgttatggctctcttgtcttctctcactagtgcattatacgcaagtcagggatatagttgtcagactcatgagtaaagaaatgcccaactttacctcttctcttatggttgggaacagaagtccagaggaaagatgtgggtttcccagggcgacagccagtttgtggctaagagaagcctagaatccaaggatgccatagttttccattgcatcagtgacaattgttatgtgatgaaagtgcagtgttctgagaattggaaaggagaactgaatgtatgtctttctcaaaatggccttcctgggttactgagaacaagaatgcatggttgtttctagtttaacacctcttttatgacattcaatcagattcactaataacgagctcagattcttattaacacacaccgggaattgaacaatgagaccacttggacacaggaaggggaacatcacacaccgtggcctgttgtggggtagggggagcggggagggatagcattaggagatatacctaatgtaaatgacaagttaatgggtgcagcacaccaacatggcacatgtatacatatgtaacaaacttgcacgttgtacacatgtaccctagaacttaaagtatgatttatatatatatatatatatatatatatatatttaaaaaaaaaaacactggtatggcagctgtagacatgtaaatgaattcctgtagctgagtgggtagttgaatgagaaggtgaagtttttgacagcatgtcagatttccatggatgaagagagagagcacaagaaaagtggggtgagaaatagaaaacagcccagagagagaacctgacaatatattgtaactgcctttggaagcttcagttccttacataactgagtaaaatagaaaataggaacaacaggttaaatacttttttaaatggagtttttaaagctttccagttcatgtagagactcaaaaattctctttctaatgcatttgttttgttgaaatggcccaatttttatctaagaaaacacatcttccaccaatctgtcatctcctctaattgaagaaagaaatggttaagcatgcccagtcactattgtttgagtaaaaaagacttacttgtccctttcccgggataggaagacatcacattgtgaacatctgtgaatctcattatcaaaataaaagacaggaaacttgtgaatgattgtatcatccactggttgtgtgactttggacaaatcatattgcaccttttcttgactcagtttcttcatttttaagaaaagccattaaattagagactttccaaggtttcttttacctcttttgtcctcatttagttcatagtccagggagagaacaggctctagagttcaaatttgtcccaattcaagatcaaaagaatggataatgtagggactaggcccatgaactgtaaattgagccaatgtgtaaacatcaactcagttaaaacatccactcatctcaacattcgattttcttctgtggttattttggcatgcaggaattcagattcattttggaatatttgctaggtgcatcacactctaacaaattactagcatgttttaaagtcttcctgcattcctgtctataatggttttaagctttataattttccatctcttcactacttagggacatgggtaatcaatgaaaatgtgtatttcaagaatacgcatgtcccccagattatagtttatcaaaatcacttttgaatcattccaattgaattttcacttcttgtaaatcatcagtgcccataatcatattatggggtcacaggagatcaccaagaaaggtatattaaaggcatgacagaggagtagcacaatgcccttgaatcattcctcagtaatataagaacagaatttgttcttggaaagctggtgagggtgggaacattttctttcctttccaacaggcatatactgctcattctcaaatctgtattgctgtactagtcaggatgtttactgtttaaaatgagaagaacagcagctcaaatgatcataggcatgaaagggaatttgttggcttatgtaattaagaagatcaaggggtcaatatggatggcttcaggcatggcttaaaacagagttaaaaaaataatggcactagaaataactgtgtgtgtgtgtgtgtgtgtgtgcatgtgcacacgtgtgtatgtgtctgtatttctcatctctgtgtgtgtgcatgcacacccacacatatttatgtgtgtgtctgtatttctttgtgtgtatgtgtgcacatgcatgtgtatgtgtgtgtgtctgtatttctgtctttctctctctcctcgccctgccccatctctttcccatccactcaaccgttggttctattttcctctatattaccttttcttccaggttgacctttctcaggagctttggctaacagttacatcagatctgtattctaccatatttcccacaaaagtccagggactcctacgggcttggtttcagggactattcacctctgaatcactatggctatgatgatccaagcctgagttacatgtccatgatgaaagcctgtgatggagttgtcctctcccaaatgatgttgactaaaccagggcaagggatgcttcttcaaggggaagtgaaatgctgttaccagaaataagggagagagtagtgaaagaatgcatatcctccccaaaaaagagaatttattcttttggcccacagtgttgtgaagcaaatcaatatatgatcaagaattaatccatagattcctttctgatcttaccaatgttcaaatttatctgttcttcctgtcttcatgccatgcttccaagtgttgtgtagactcattaatgtttaattctttattttgagaagcaggaggaattccttcttatatggagtttcttgttcaccgagtgaacactagaacaataaaatacctaaatagtcaaacaacaaatatacagttcatcatttggattttgttctgagctttgaaatgaaaatgcagctcttctttgaaacaggtatctcatgtcaatccaaataaaatatcgaatttcctgaaaaagattgtatgatgaaatgcttcatttctaggagtcattggcctggattatccccttgttgttgatgtatgtgtagttttttttttttttcaaatgtatctcctgggaacattaaaataaaacatttcattatccatcttcttttttattttttttccaagtgatgtctctgccagatagggaatgcatgtaattcactgttgcttttaatttgtcagtacattaattttagttgataaataagttaactgaatatgctgtcccagttatctttgatcattcaagttcatttggctcttgcttttaaaggctattctgtgcctccccaattctccttgggtttatatagcttttaagttgtcattgaccaagagaccgttcaagggtgattatagttttcaagcttgtttgtatgcaacagccacgaccttttttcaaaagacacccagctgctcttagctgcaccttgacctccaacagacatttattacaaatcaatttcatagattgtccatataataatctagagtgtctctggtagcaagatgatgagagggcaccaatttattgtccttatgaggttcaaaagagcaacaaaatcatgaattttgaatgaattttgagaggtcttactaattttttcactttgactatccttaagagggactatcatgctctaaattttagagacaacgtctctaatagattctaccatgaagtctaggtagaaagggatagaggtgttcactcttggttaatgactctaaaaaatctcaaaactggcagtatggaacaggacacatccttggaagagatgacccactgtgtccagttacttatttacactccagtcaataggaaccccaaaccactttgagcattctggggaggaagaggagaacttaatattttacattacttaattttattccataggtagttaatgatctttatgttttattctatagcaggaatttacatgtagttggtatctaataagcactgatgaatcaaattgaacttaatccaacctctaattcttttccaagcaaaaataattatctttactaagtccatttcttgttgctatgaatacacacacacacacacatctggtttttaaatgtactatgcctttattccagaggttttactgtgtattttagtaaaaacatcattttcagacaaaatgtagactagctagaggtaactgtgcttcaaagaatttatccactaggatattaatttccatttcagagtatttctttttacacaagatggatgttctgctttcaatttattagctacataaatgagcttatctatttctaatttcgacttaatataaaaagcatcaaattttagttttcatccatctaattttcattttgtatatttatttgtggtaagctgattttggtttatgccatctgttcatcaggttcaggcagataatattaaaagtatatgttctccaatatgtgaatatccacattcataagtcatgctgcagctccgaaaagcgctgtggttgatttaggctgctctctgggagaatgatgttaccacagctaaatacaagcgtgagaatttctcagtccactctgctgtttccagtcgtggtttgaagcagatggcttcttctcaccggcctttcttaccttagacaaaaatgtaaaaattattttgatggcttctttcctccttagcctcagagccatcttggaacattctctcctctctcctttgatatctctatcagtcccctctaaaatcataagaaagtagaaagcctcagttacattaggaggtgatttagttagtagaccaatcattctaaaacatatggaatcatattgcaaaaccttataagagttagataatttaagttcactgacctgctttttattttattttattttattttattttattttattttattttattttattttattttattttatttttagacagtttcgctcttgttgcccaggctggagtgcaatggcgcaatctcagctcaccgcaacctccacctcccgggttcaagcgattctcctgccttgagtagctcctgcctccctagtagctgggattacatgggtggcatgcgccaccatgcccgggtaattttgtatttttagtagagatggggtttctccatgttggtcaggctggtctcgaactcccaacctcaggtgatctgcccactcggcctcccaaagtgctgggattacaggcatgagctaccacgcccgaccagccttctgcttttaaagtctcttctctgtctccccaaacctatgcaaaatgacaaagtacttcttgaaagaacccactctccagcaactttgaaaacaatctattttataccatacacaccaaaacaatgacaacatttctgttctttttctggtaagtaaataaacatttgcctcagagactttaatctgagttagtgtaacatcccattcctaagtcattgagagagtttttactttccaggaatcttttaagcaaaatatttaccaaacatgcatatgccaataactacaagcattttcaaatgcagtcatttgggaaaaagagaggcagctaaggcaacttgatttttttttaatacgacattttactaattgtcttagacttggtgatatagctagtttttcaggtcagagaagtcagtgttgctcttttggaatggttctttacattcccaaacttttaaattatttaaaaataaacattgttatacacaataaataagaaactaaaactggtaatttttatcatttgtttaaggtcagtcaacattttcagtgccaggcacggtggctcacgcctgtaatcccagcactttgggaggccgagacaggtggatcacctgagatcaggagttcgagaccagcttgggcaacatggtgaaaccctgtctctactaaaaatacaaaaattagctgggtgtggtggcacgtgcctgtgatcccagctactcaggagtctgaggcaagagaatcccttgaacccgggaggcacaggttgcagtgaactgagatcatgcaactgcactccagcctaggcgacaaagcaagactccgtctcaaaaaaacaaaaaaaaaaaaaaaaaaaaaagacatttttggttataatgctgagtgatttcaaaatgtcaaacaagtgaaaaggatttttatggccatatctaagaaagtaaagctgacgtcatgcatagaaaactacatctcaacagaattttattagtagtaaaaacactgataataacaaaatacaacactaacaacatgcttattatttgccagacagttttctaactgctttattatataaacacattttatccttacaacacctctatgaagaaaatactattattatcctcgattcactgatgagaaaaagaagtcacagacagtttaaataactgatccaaagtagcacactgtgggtgaaagctggagccaggatccaaaagcaggcaatctagttccagaatccgtcttcttatctgctatgaaatactgtttgcattaaaaataacaagtgcattcaagttcaagtccaattttctttctttttaattatggtaaaacacataacataaaatctaccatcttaactatttttaggggttcagtagtgttaggtacagtcacattgttgtgccactgtcaccaccatgcatctccaggattctttccatcttgaaaaacaagcccttcacccatcgaacaataactgccctatttcccccttcccataccatctggaaaccattgtctgctttttgtttctatgaatttaactcttcaggtaccttatgtaaagggaatcctacgatatctgttgttttgggtctggtttatttcactgagcatgatgttctcaaggttcatctgggttgtagcacatgccaggatttccttccttttgaaggctgaagaacatcccactgtaggtataaactgcagttagtttcttgattcatctgttactgaacacctgagttgcttctttctacctcttggctactgtgaataatgctgctatgtacatggttgtataaatatctctctcatactctatattcaatcctttggggtatatacccccaaatgggattaccagaccatatgttatcagtgaattgaggataataatatgtttaattttttaaggaatcgtcatactattttccatactgatcataccattttccatacccatcaacagtgcataagcatgccaatatctccacatacacaccaacacctgttattttctttatttaaaattttctttaaagtagccatcccaatgggtgtgcagtgacaaattttcttttgtaatcagccatgtaaactgtaatacacacattgaaaacataaccaatgtgacccataagtaaatttcctaaatatttgcttacttcttatttacagtttgcaaatctctcataaactagataggtcctcagaccattctgcatttccttgtatataaagataaacacacacacacacacacacacacgcacacacacacacaacacacactcaaacgcatatatatatacaaacatcaaataaacttttgtgtcttttatgaaaaatacgacacattgagtggaaggatcatatatttcctcttccatttctaaagcatttcaattttgaaagagcaatagagatacaccctctcacatctgagtttagaatactgaggtccagataggttaagtaattggtcccaagttgaaaatttagttagagccacatctagcctgaaatttttcccaatgcagcagcccatccaatctctaaagcgcatcatccaatgtttgtaatacattatgtttatgatatcttaaatgtatagcattatgtattacattatagatattaataaaatactattggtttaaaaccattttcataccccacatagaattccaatataagccatctcccactatttttccagctataccatttgttttaggtagactggctttaatattttgaattgagatggggattcagcttaaaaactgtgaagggttcttttaaaattttatttgcactgaagatgctgagtgtgaaagacgtaagttcatctctctctaactctccatagttcttaacatagagatgatgaccctgacatgtcactgatatttttagaaataatggcaaaacgtcttttttttttttctcccttctgctgaatataccacagacaaccacagttcattgggctggagagtttcagctgtataactaaaaataaatgcctctgtaaaacaccaacaaagacaatgtcagtttccctaaaccactgaaaaatgtgctttaaaaaatcaactgaatttcagttgggtaaatgtctactccatttgcctccgggctgggcttttaagggactccttttattttaatcccttttgtttttcagatttatcacttaaggattgtatgattggtgcaactcatactattaaaatgaactgcagttgctgatctactcacaaagaaatgaaattgtaaactccactttggtttcaaaccacaaataagcgactaataaattagcacaaggcatcttttgataggaggagagcctaaactgaatgtaatttttagtagtaaaacatgggactcactatagcgccatagtactattttaagcattatgcgtcaatattggttttttgaggttttgttttgatggaaaaggtttaaagttattttgttcatattcatatatactgtggtgtttttaaatattaagatatatagaaacccagaaagttgagctcttttttttttttaactttcttttttagggcacttgaaatttcttcagggatacaattgctcttttcacacatttagaagagaataaaagagagagaataactcttttcctttatagaagccacattataattcattccttgtggtccatgtactagatggcctcaagagacagctccattccaggaggctcttctagcacttagtgcacagcccccaccctgactttgaagactcacagcaaagcctactgaagtcactgttgatggagaatggtctgacactgtgatgccaacgtgctggttacctcccggcagtctttcatagatatttaatgtttataagagatattatactgtcccgaacttgggttatttagcaacatatctacatagatggacactcagtaaagctttataaataaacagtgcccttctcttgcatgtatcttaattctgtcctaagcacaatattctaaaatcagcaaccaaggctctatgtcaaataaataaacatatggcataaaacataagcaaatgcatcactattgtagagtataaatttaactatttctggtaacatgattctaatttatatatattttgtttgcttgtttcacctaaaagttaatattcttgctaattttaggtaactattgcttgttgatcatattagtggtttacagtatatgtgatactaatttaatctcaacagatttgagggattaatggtttgtgagaaacataatggttgtaagatagagatgggaataaatcgcatcactcaaaatcagtgcatcttcaagagacagattgacaatgaagtttaagagccaattgattgatcagttttacatgcacatacatacatacatgcatacatacatacacacatgcacaaacctcttccttaaattttcttcagactaatgcattctgaaacgggagagttccctgacccccaccccccccccccattgcaggacatgcaacaggggtataacttgtctgtttggctgttgtgcactcaaaccccttacaggagggggagcatgcagacaggtaggtgcaggagccagggcaagtgattttgggctctggccccatggtagcatctacaggtgggtgcctgtgacatctgaagccccagtgggcatgttacagtgctcttttagctcttctgttcacagacggtttaagtgttaaccagctcagtgccctcttggtacttgggttcttgtccagcgtccaggaagaatcaggtcacacggacatactaaaggatggtgaatgtggggaatattattgcattgccaatggagatgactttcagccacgactgggatggatggggagctggaaaggggatggagtgggaatatgatcttcccatggccaatctcttctccaactgtccccagcagaactcctctcaaagttcagacattccttctctactgtccttctctgctgcaccactctgctgctcttctgctcttccgttcatctgcttgtggagccttgggtttggggtttatatgggtacagggactgtggcgcgtagagggccaaaaggcaacatttgagcacaaaaacaggaaggcctgttctcatttagagctgccagtttccaggctggagggtggagcgtttgctggagaaccgccttcttctaccaagtatttccgtttcctgtctttatcaattctatagggcactgaagtaaatgacaaatgcaatgaactctatagtcttcaatgagccaaaagcataacagttactagttgtaacattcaagaggatattggatgctttttctcctttttctataccgtaaggtgctactctttcatggaaatgtaagtagagataaaaatgtaaatagagatgtttataaggcatataaacatattatatttcctagttcagtatctacagattgagacttaagtttcaaaacagtgaacaataattctgtctttttcagtatcagtgtcataaattgccaatataaccatgtatgaatgactactgataatagtcattagactagtctaatgtcataaagatggcaaatggcagaaccagaattccaacccaaggttattatttcattctggaccatcttcgtcagatggtttgtgaccattgtcagttggctagtaattgcccatagaagagtatttaccccacagtaactgacttgtactcaaaaacaagttatgtcttttcagcaattatgtgtatgtgagtattttttgaatactagaagatatttattttattttatttttttttgaggcagagtttcacttttgttgcccaggctggagtgtaatggtgcaatcttggctcagtgcaacctccacctcctgggttcaagcgattctcctgcctcagcctcccgagtagctgggattatgggcatgcaccatcatgcccagctaatgtttgtatttttagtagagaaggggtttcaccatggccaggcttgtcttgaactcctggcctcaggcgatctgcctgcttcggccccccagactgttgggattacaggcatgagccactgcgcccagccgaagatatttaatgttatacatgggatattagttttatttaaactttgcaagagtgttagttgtttagtttgtttcttaactattagaaggtttcctttcatagaaggaaaaatttgaagtttgaatttagaatgtttgctgtgctgatgaggaattgggcaggtgcatgagagctctgagtttgagtctcactgaaatcttaggtgggaggatgaagatcgctgtgtataaatttccagagagatgctccaattcactgctgaataaatgggaaccagagctgcctcaggggacttaatgacaatttctcatcttcattgattgtgtcagatttaattgctgactcagaggaaatatttgttcttaggagacttgctgcctatcaggaatgagttgaagagttctagccctgaggaaaagtttatgtgagctgaagaaaagatgctttagagagagagagagagagaatgtgcattgttttcttttcttttttcaccctctctcataaagggagtagggcaatgttaagcaggtaaaccctaataccatctacaacctcgtattaccatagagtatatcttcgacaagtatatagatagcctctttgtacagatgagtaataaagaaattcacatctgttgtaatctaatcatctatctggatacacagtttttataacaggaaggggcaaaaagtaaaatcccttaatgatgaattgctgatgtgagcctgtatcacgaataccatattaggtttttctttttaatgtttcttgctatttagtattacttatagaagtctttgaattttcattataacattaagggtgaagagctataaatgcactcacctcagcaaagaaaaccaaaatatttataaatttattttcagaaattaaagacagaaccctggaactgcacaacaggcctgactgtattaacttataggagattatggtaaatttctattgtaggaaataattggatattgtttcagctttcaaatctgtttcattagtattagcaagagattaatttctctctaagtaaattttctgaaaaaaagcacttcactatgcatttgttgaaaatgtgctgaactattccaatttaattgagataatcagcatgcatagtatgtacagttaaatctaacttatggtccataacttttccaataaagtgtctcaagttcactacatgacattgatgtgtttaccgtgggaaagttttaaagcaccgttctcaaaaaatatttcacatctctctagtttggatattcacacattactagaggtgtttaagttgcaagtgatgtcaagtacaatttgtctaatatcggtcctaagcagagatgttccccacatttgatgttaggtgctaatgcatagccagaactctgatttggtgaatgttcacatatatgactatttaagcattctaatatggcttttttcccatgtaacggagtttctggaatagtgtgagatgctattaaagatgaatgtatcttattttgttttgttaaaacaatcaacagctcacacactctctcgaagtcaccttttcttcctatccttaagtgagggggagagatggggcaaaggagaatcatgagctgaacttccactctccaccaagcaccatgctctgcaatctccatgatctcactgggactctctatccatcctatgaaagtattattaatctgatttgacagatgaagctcagcctggataagaaacatgcccgggccgggcgcggtggctcacgcctgtaatcccagcgctttgggaggccgaggcaggcggatcacgaggtcaggaaatcgagaccatcctgactaacacggtgaaaccccgtgtctactaataatacaaaaaaaattagccgggcttggtggcgggcgcctgtagtcccagctactccggaggctgaggcaggagaatggcgtgaacccgggaggcggagcttgcagtaagcggagatcgcgccactgcactctggcctgggtgacagagtgagactgtctcaaaaaaagaaagaaagaaagaaagaaacatgcccaaggtcacaaaactacactatgagaaacctgggatgtatgggatgtatcagtatctgccttgatccaaagtccatgaatgtccagggcacatgactgaatattgattctggttcctaatgatactgacccaaatgtaatcttccttaagaaaaaagacctaatggtgactgacttcaggtttagacttccccctctcccccctcagtctggctttatcatctactcttcacactatatgaagtcattacaatcttcttgaagaggagataaagctcgttcctacgaatatggtttcccttatgtggcccactgctctctgaaaggtcctaaggatagtttgctatttcaatgtccagagatagctgaattcctcctcctccactccttgctcctctatagcacacttcccaagcatgggctcacgaactctcctccctacttgtgttgtcaaacacagcctcactgcttcaagttcaattgggtgttagagacacatgtcatacctatagctaacctcatagtcctacaatgtctaatatacataacagaaaagtaaattgaattaaggcagtccaaaaatctacatgtgtctcaatgcatacaatgaaacaaatttatgtgtgctactgttttcgaggtttctcattcattgcaattatcatagtggctgatatcttgcaccatgataacatcttttgaggaatataattttattgataactaaacatagttttattatgcctgatagttaaaaatacttaaaatatagtaaagttttcatttataaatgtgttgacattcaatattccaaaaatattatttttaatggaaaatgatttttccaaagtgtatctttaactttgttttgtaggaacataaattacttattcaagtaatttgtataagtaatacaaatttggccgagttctgacttagtttgtaaactgttactaatgattttctcacgtaagcaaggtctccccacgtactaatactgtgtataaggaggctccaactgcacagtgattcacctgaagtagttcggacttcgggtgctttgctgattttagccatatgtcatacactataatcaaggcatgcagcatacaacgaaacataagttgcccagccaaattggaggaaatgaatcctaattttggattcagcagtaagtttaataaacttggtccttaaagctagactcactgttatggcttggtagtatccccgctgaaatctcatcttgaattctaatctccataatccccaagtgttaagggagtaacctggagagaggtgattggaacatgggggtggtttctcccatgctgttctcgcgatagtgagtgagttctcacaagatctgatggttttataagtgtttgacagttccaccctcacatgctcacagtctctcctaccgccttgtgaggaaggtgactgcttccccttcagccatgattgaaagttacctgaggcctccccagtcgtgtggaactgtgagtccattaaacctcctttgcttataaattacccagtctcaggtagtatctttacagcagcgtgagaatggactaatatactcaccttaggtaaaataaaatttacaataacaaatgaaggtaagataggtcattattactcttgtttgagaaaaaaaaaaaaaaacagtaaccttgtgccatttcagagggatcttcaaagatgccttttaaattatcccacatagaagcccttctaaatttcacgaacccagagaaagatatttgttcctttccatatttgttacagtgaaaataggactggaattatgatgaaaataagaacatattttatagaacaccgtgatactgaataagctaaattaaaattttatgtggtaggttagtctactagccctgcttgatttatgtatatggtagaaaatttcatacaatataacatttaggtatgtatattatagtagattaagtatttggttacctcatatatttgtggatatttctggagaaatgttcgctagcaccttgatcagaagtataaacctataagctggcatgtattctattcacatatatatatatatttttgagacgaagtttcgctcttgtcgcccaggctggagtgcagtggcacgatctcggctcattgcaacctctgcctcccgggttcaagcgattctcctgcttcagcctcctgagtagctgggattacaggtgtgagccactatgaccagctaatttttgtatttttagtagagacggggtttcaccatgctgtccaggctggtcttgaactcctgacctcaggtgattcaccttcctcgacctcccagagttctgggattacaggcgtgagccaccacgcccatcccacatcttgttagagaaagttttctggaaggatggcccatgatgagcacaaacagaacttctaggaattcttgagttttcagaaacagtaatattagtctactttgcaacactagaatgtctgtgcatgctactcttagaagttaagcataaggtgaattttaataattagaaatgggaaaaggaggaaaaacaaaacttcaggtgttcagaaactgtccatcatgtgttgaaaatgggaatgaagtaatgaagtgctctgtaatacatttacatatatttttgatagcaagaataatgtgcctatgagggcatcattattattttttccataagtcttagaaaggggaaaccaaaaatttgcagagcttagaaagctagcaggcaaagttgtgtttaattctattctaaaatttatagcaattctctttttatgatggaaccaaccatcaaataccaatatgtacttctctgataccactttctctcttagacaatttataagaacctttatattgaatcattgattctcaaatgaaatatgtgctgtatgtatcccagctttttatttgtagtattcaaataattcagcagttttaacatgtgatatgcacaggaagagaaagcacagtatcattaaaaaatgtgacacttctgtgatagaagacatttctattgtactcaattgaaggtctacctttcccatgttcaaatgatgccacttgtaaacatctctgtcttcctgaataatgtgtaattaagtgtattttaattctaactttgttttcctatatttaaaagaagtacctttagatttacatagaaactttaaatgctatcttaataaaactattctgtgggatacgctacatggagtgcttaatcttgaaacagataaaaagtaaagtttgtgggttttcttttcatctgaagttaggctgataagaagatcatcaaactagggattagtcctaacgctgcatcaaaatgcatattttcatgtctatgtaattaggttttaataaacatgtttgatggttacttaaaaaacatatttttcaatgcagaaatggcatcttgtaaactacagtataaagagacttttgcaagactatttgttttttaattacagcctgattatgataagcatttgttattttcccaagtaaagattaaattaatgttataaatcaattttctaaatttaggcttaaatgcaatatgttagacacaactctggatgtctgctatagtaaattatggcttttccgacattttctagaatatttgttattgtgtataaccttttaattgtggccacagtttttaaagtgcttatgaagtttataatgcaagtgtttggtttaatgagtcattagccattaacaaatcatttctgcagttacttttctgattgcaatttaggattttatttaattctttttcctttacatttttatttataatccatttttattagcaattgaaatcctagatttttttttcagaaaaataagacatgagatgaggattttttagctgtgtgtgtttattaaaagaaactaaataatggagacagcatgggagtagtcataccttgcatcttacgtttattgttctgaacaagaaatttcttacctttcagaaaaattgcaaatgtgttttgtttcatcataatcttataaatttaccatgttagtagtgtccactatcttcctttatcttttctctatgcacatataatattttccagatataactcacttcaaataatttctctttacgagttgaataaagtccttttatatccacaataaaatgttgcaatgatcagcaagcctcaaatagtttattggaaaaagatcacttgtgtcaatcatttccaaataggaagttttcagaatgaaatggaaccatttggacagtcaggatttctaccataatgaagctttaataagccagtaatagaaggttttgcagcaatagatgatgacccagacataaatcacattactagatcttaagcaggaagttatgtttgtctatactgacaaatataattgcctatattttgtgactccagttcaattatagatcaccattttacttccagttcaattataaatcatcattttacttcctaatatgtcagtagaacctttgaaattgtaacatgattctgaaattcaaaactacagagaggtatgggcaatgcttgcttttttttttttttttttttttgcttatggaaggctattttcctcaaaatctatttgcaattaatttagtctggcttttatttttgcttttaaatttagaaaaatagattctttctgaactgtaggattaaggaaagcattataataatattttctcactaatccttggaagtaatggtctgttccatggaggtggaacttgaagaagttcctcctctactcaatgatctgaaagaggccaaatcaagaccctggtatgctgtcatacatatcacatgcctggtcatggagttgtggaggctgaggcaagcaacacaagcgaggtagccatttacaattcagaagaaaaggatcctgcaatagcatccagaaactgttcattctttaaaaatgacttatagagacccattgaaggaggtctgtcatctatatagggtttggcagcttagtatggaaatttgatgaaagagcaattgaatgatagccaaagggtctgtgttctttctctccagcctcattagataactgagtggttttaaatcagtctttagaatccctggaccttagttttctcatctgtcaaataatgaaagatagtttaaaaaataaaagtctgaaatcctgaatctgcaagactgcggcttctctggcgaggatcccctaacttagaaagcaagtaatctatattatgaaggaagatgtggctactttatgacatgcccttgcttcccatctctacatattcatgagaattcttccttgctctgttgtacactgaagggagactaaggtccttatgagttagatctacaagtacaatcattttgtttccctttggctaggagctaacattctttcccaagctatggctgtgtaattaagtagagttctctgaatatttgtaaaagaggaataatctgtagcagttttctaaaaaggaataaaataaaaataaaaagcatggtaatggagaagaaggagttaatacaataacaaaactctaagaataaaagtaacgaaaggtacaataatgtaagaattcaagtttaatcaggtacgctgaagtggcaatcttcaataaaaaaaatcagttctgaagaatacagaatattaaatttgataagataattgcaattttattatttcaagatagttgtcatctcttagaagtgtcaaataattaccatacacattcaacagaacagcgtggcagactatataatacgaatgtgtcctatgacattcccacagctcttgttagacaggtaggtgtgtggtgatagacgcagaagtatggtatctacatcagtgcaaaaagtcaagagaggctttacgttgaaaatctggagaggggaaaaatgtaatctccaattcacagcattgcagtatagtggaaaaagaactagattaagtgtcaagaggctgtggattgagtcctggcagtgtggtataaggtaaatccttttctttctctgagccttctttttgagaatctcttccttggtatgcaacgccattgccagttaagctggcttgagccccaggttgctcgcctatcttttgctccttagaccattagtggtttctggaagttaatggtaatccagccaaattgagagtagaggctcctgtttttcactagtctccctttaacttccagaacagacacttcctgcaatttttgtttccactgaagacatccaatttggaaattccacttccagctctctgtggccctcatttgagcatgcaccttttaaaaatgagagttgtgagagagaaccttaaaggaaacatcttaaaagttagctccctgaagggttttcaccaagttaagtttcccttttatacccattattggaaattatagccagtgttttaagtgtaaagtaaaatactcttcttaagcctcctttcacaagcctactatttttctagccgcaatagtttaattttgttttgacagtggctagaacactagaaattgttgggtttttattttatagtaatgactgtcctgaatgactaattttcactgctatccatcatgcctaaaattggctggtttgcttggctgaggatgttatacatcagttcaggaacagaaaaggtcttgccttggttgccttagagtgaccgggaaagaaaatggtggtggtgacagggaagtaatggcttcttccctttccctcgtatctctagtgttccatttatcttcatataaaggctttatctgaagaaaaattaaaagttagaaaaaaaaccttcgtgctaaacagacagtttaattggttctgctatttttggaaactgaaagataaatgctacgtgtgaagttaataaaccataattggaatttgcttaagagcattctttcattccacatggactcatacacttcaggaagccaaaagacctagctgggccttaggaatacataagcccctttcccaagaacagctgtgactttcagtgtgaccttgaggaatttaataacttttctatgtccccactggacaataaacaaattggggtgggaattgaaaaactaaaaacaaatacactcagttaaaaaaaaagaaactggaaactttttcagttcttggatgataacactatcgtgtgtgttgacatttgccattttcccagctctgtgtagtgcttttttccacaaaaagactttgatatttttatgattaatttttgtgttatgtacatacctatgtaggcttatcattgtgagcataactgccctttaggttttacatgttatctagatctgaatgtcatgccatccaaattatttgacaaacataatcactcttactcttattgatgttaacaatactgtttttttgtcattgtttctttactggttatatatgtggagagaaatgaatctgatagtcccaggcatggtctggcactttcagcatcatataacttttccctagacatatttaaacttgagctaaatagcacatttctttaaagaaccaaggacgaaggaaagttcattctcattctgaatttttaaaaatatatttgaaaatatcttttcagctatgcttttattgccgtatattctacctgaatctttgaaaaggaaagagtggcttatagttttcgatctgctacttgtttcatagaaatgcctatataatggtggtgagattgagcagatcgtagaagtgttattgtagattgtgagtcaatgtccagtagggggttagagtaaggacactgaatccagaacaggatcacatgtcagtgcagctagttactaattgtgtgatattggacacatctgtttccttatttagaaaattggatcaaaattgtacctatcttatggattgatgtgagaatttgatgacctgagaatttgtggttcaggactggagcagtacctgtaccattagatactcaatgagcatcatcaactcaagggaaaattggagctttgcaatgggcctgagttttaatcccaattagcatgcttactgtaagcaggttctcaaactctctgatattcagttttccatctgtaatgattttttcctagcaggatttatggattagattaaaaatctaatctaacctaaaaataaagctatttcaaggaaacgcctaccccacttacccaatgatgaaattttttaaataaaaatgttttttgtcaagtccattatgaaaacttttagagatgtagatgaagttgtcaagtatttacttacagtctaatttattagtatagttatacaagattttaactatatcatatatttgctcaaactgtaacacaaatttaatgagatacttttgtttaattttacattcatattcaatatcaacgtttttacctaatataggtgttcagagctttcatcttcacctcagtctgagggtttggggatacagcagttcatgaattcatgtatggtgttcattttattccaatccacaagaacctgttacaactcttacttttcccattcacccaataagcaaatactaatctccatggtaggttttatactagactgtttttttaaataagtagacttttttttttttgagacggagtctcactctgtcgcccaggctggagtgcagtggcgtgatcatggctcactgcaacctctgcctcatgggttcagggaattctccctgcctcagcctcccgagtagctgggattacaggcgctcactaccacacctggctaatttttgtattttttagtagagacagggtttcgccatgttagtcaggctggtcttgaactcctgacctcaggtgatccgctcgcctcagcctcccaaagttctgggattacaggcgtgagccattgcacttggcctaaaaagagatatttgaaagatttattggcatgcttatttgaaagatgtataaatccaggacaaagaacaaaatctggactgttttcaaattttgcctttcttcatttttatttactgatttcggtttaatcagtgaaccaccaaaagtttgcaaacctagtatatttttagatgtttcaggcagatatatctcctccaagtatattatgttgtgaaaaataataaaaattgtcggagctaaccataaaaattgaaaacacaaatatatgcaatatttgttttctaagggatatttcctttgagaaggattgaccttatacttaggtatatatagaaatatgtttaatgcacataacataacttatactgaaaattattgaataataccttaactgttaaagaattaaatacgttgaagaatatcacatgtacctagaacagccttcctcaaaatttgggctgcaaggtatctttacactcttagaaactattgacccaaagaagtattgtttatgtacattatacctgccaatatttactgattaaaaataaaactgagaaatcatgaaaatattttatttatttattttaaaatagcaataaacccattacacagtaacttaaataacatatttaaaaatttatttaaaaagcatataatttttttttgtttgtttttactttaagttctgggatacatgtgctgaacgtgcgggtttgttacacaggtatacatgtgccatggtggtttgctgcacctgtcaacccatcatctaggctttaagccccgcatgcattaggtatttgtcctaatgctttccttccccttgccccaccctgccccacaactggccccagtgtgtgatgttcccctccctgtccccatatgttctcattgttcagctcccacttatgagtgagaacatgcagtgtttggttttctgttcctgtgttagtttgctgaggatgatgacttccagcttcagccatgtccctgcaaaggacatgaactcattctttgttatggctgcatggtattctatggtgtatatgtgccacattttctttatccagtctatcattgatgggcatttgggtgggttccaagtctttgtattgtaaatagtgctgaaaaaaaatacatgtacatgcgtctttatagtagaaaaaagcatataaattttttaaagtatttaagtgagaagaataacattattttattatttcccaaatatctttaatgtctgacttaatacagttgggtttgttattttcgttgaagtatatgaagaaaatccagcttcatacagatatatagattgaaaatggagatttttaagaatagctttttcaggtgattatggatattcttattcggtcttacaaaaattccattagtggtagtttcttaaagactatttacagtgtagaatctttttgaaatcatatcaatgaactttttgtactaaaatccattgacttttcttgcagtttcaatggtctttttccttgtgcatggtcttgtaacagtacactttggtcattaggaaaaatgttgtttcattgaggtatgcagatcttccacatgtggacacatttcattataaaatgtcaaaaaatcatatttgtaaatcaccatcaagcttatcagaaaggtcttgaagtgttgggaaactattgtgctcatgatggcaaactgaagtcttacacaggatgaatttttgcttgaaagcttgaattgaatcactggcaacaaatactgatatagctggtttttgtttttttgtttttttgttttgaggtggagtttcactctttgttgcccaggctggggtgcaatggcatggtcttggctcactgcaacctctgctgcctggattcaagcaattctcctgcctcagcctcccaagtagctgggattacaggcacctgctgtcacgcccagctaaattttctatttttaatagagacaggttttcaccatgttggccaggctggtctcgaactcctgacctcaggtgatctgtctgccctggcctcccaaagtgctgggattacaggagtgagccactgtgcccagccaatagctgatttctttaaagtgactaagtctcttgatttattttctagagaatgttaaatagactagtctgtatggccacagttgtctttcagagattattttagataaaaataatgttccataaaaaaagtgatggttcagctcagaactaaaacaatcatacaaatacttttcctcaaggcaactatgatactttggtttccaaactaaaatgctttatgcatacttcccatttgatcacaaagaatatattttttaaatgtactcaagggccaagatttaataaaattaataatttttactgcttcgccaaaagcatttttcagtgaaactagaattttttttttctgtgagtgaataatagtaaaaaaaaaaaaaaaaaataccatgactagtaaaacaattttctgctatgcctttgactcgtgctaaggaaccagccgttttcctcttcacaaatgtcaacacaatgaaaaagacaaaaatgcataaacattataataaaaatagttatgatctccaggccctgttggcgggtggggggggaggtctcagactatgcttgaggaaccattaacagaggaaattgaataaatagtatttgtatgtaataataatagctgacatctattgtttacatacagtttcacattattgcattgttaaatgttgttatctacaaaataagtttggttaccagtcacctttttagtattcctattcagtcaccagttttctcaaagtggtaatctgcactggaccttcatgtcaaaagtgttgattggtgaggttctactaggcttattggtaagatatatttttaatatcactttttcttccttctccactttgcccaccaaaaaaatagaggatagatagatggatagatgatagacagatagacagatagataatatattaagatggaaggaggaaaggagggcaataggtgggaaagaagggaagaaaaaagcaaccaagcaagtaatgaagaaaaaaagaaggaagatatgaaagaagtaaggaattgagatgaacaataaaatgcttgttttgaagctgaagtttagttagggaattacggttcattcaatttagtagttactcataatcaccttgctaaattaaacccaggtgtagtgaatgctgttgcattaaatatattttcacatgcactcaaactgggaagagcgaaacaccaggaaaacatgaagttgcagtgtggttcttgtatatcgttgaaggactgaaacaaacaaggctcaatggccatttctttaaaaatactgactaatactttgaagaaaataaaacaatccaaatgaaaacatggcttgcaggagctgcttctgtttcctcatcttcttttctgtttgcttttacatagaagagtacagctgtggtttaactcattgtgataaaactgctaaacatgtgcctgtaactgaactccaggagaaaactctgccaggaaactgtctcctaatgatacaatctgcatattttaatgatgctggaaatgtaggaaacggcatagactctggactctgctcattctgggctttttcccctccttgtagcttgtgcattgtttgccttcattaacatatgataactggaaatgggtttcctatcaccatccaccagccggatatggcttgacattttcagagttcagatgaaatacttgtaacctttctggggttactctatattggacttattttaatgatgtccattccatcaatgagaagctggcatggccactgttttaaatagcacaaaagaaaagttatgtctcactacaaaaaagcacagctatggaagatattagtagcaaaccatttttaaaacattttgcaccttcctctctcgcttttatgatatgacttctcggttttgcatttttctttgctccaacctcaagtgccttgttctcttactcttactttatcttagccccaccccttaatgttcattgagcacctgctatgggctgagttctttgctaatcactttatatgtattattttatttaattttcacaatattgcaaaataagcatgattgcatatgactactttatatatatgtgtgtgtgtgtgtatacaggtacatgtgtttatgtgtgtgtgtatcatgtatgtatgacagtgatatcagtttggaactaaattgagtatagtagatataagcagaaacaaactttgtgaagttatattagttgtccaaggacacacagttagaaagttagacactggaccaaacccagatttatctaaacctctgagttatcatggtttttttgtaaagaccagaatacttggaaatataagcctttgctggattttattctactcaatccctaaactactcagttaaattgcatacaaaacaggggaaattccttcataagttattggtctgaagccaattatataaaagtgaaagatttggggtcctactctcccaaactattgaataacagaaatggaatagaatagattaagccttcaaactaagaatttttaaaggacaaactcattggcatccagattattttaatatacattgttcatagattactttttagaaacactgtcaagtttatagtctaaacaaatagattttaattatgaataaggaatttaggatttaaaatattattacctggaaaatcatctttaaaaaaagcagattataatactccaaaggaaaaatgggccctttacttgaacataaagttttcattttcacttttcaatgttttcatagcttcttagatttattggcatcacgttttttactctgcattgtggtagcatatttacttactagactgtaaacttgaagccatcattgcaagttcattccctggtatatggaaaccggaagcatagtaagatcagtaaaatgtttggtgaaatgcaaaatttaaagacattgaacaattcaaaagaaagaacagaatcgtgtctagggagtgggccattttaacattttaatgcatgactgtttgaatggtttaaaatacagatttctggacacactgcagggattctgagtcaacccgtctgggaatggtccaggaatctgcattttataaaggcgtctaaggcatttgcaaccacacttcaaggaatgtggctgaactgtttacagttttaaaaagtaattgggaatggttctgacttgtgccctgctttgcatatttgaatcccatcttccagcaggtaagctttcatttggaatccttgatccaatagtcagttatgtcttcttttccatcccagcctaaggctttccctggcacccctcttaactgactgcttacttcccctctctcttcctcactgattgtaagacattcccataataggagttacacaaacggctgcctggcataagcactggttaatgctcgtaatgtttttataaagactgtacacctttttatcaggtacaaaattatttctccaagtattcccctgttttgtagaaatttccatctcataaggaggtgagcaagagttgcagaattatgcatgtaaattactaaagaggaaatgtgaacatgggatgctttgcaaatggtagctattcggtgttttcctggaacaacttctgaaactctagtgcaccaaagttagtgctcttagaaataacttaggcctggaaatctgcattttgacacaaaatctagatgattgcgatgtaaatgattcatacatcacttcttaatgaactttgcaccaaggatatggtcaaagcaggtcgttcatttattttaaaacacttttcagcttctttaagcttctatcaagtattttcttgctcaaaattctccctaaccctttagagcatcttttgtgttctgctaaaggcctcaagtagccagtcaggggagaaataacacataaacataagatagagagatgaaatttgagtaggcttggtagttttatttttaagattctaaatatttgatgttatttcttaaaaggttaatataagaagtctgtttaacagcacagtttctgaaaaccaggaattcccataaaaaattcataggtctgaaagatacaacacattttggatatcggaacccttaatttctttccgattctacaagcatatcctcagaatgtcttttcaatattttgtactgtctggttgtgtagtttcttcacccataaaagaatctgtgaaattagagacgtcattttatataaaggcatttcagtttttaaaaaggatatataattacatccagggctatcacatggttgctgctgaagtttacaagagatgtgtgcctacttctagatcagggattggcaaactgcagcccacagaccaaatatggcctgctgcctgttcctgtacagtccatgagctgaaaatagatttacctcttttttagaatcctttttttagaaaaatgttgtttttatatttttaaatagctgaaaaatcaaaactggaataatattttgtaatatctgaaagcgatttaaaatgtaaattttagtgttccataaataaagttttattggcacacatccacgccattagcattgtctatggctgcttccatactacaaaggcacggttctgtagctgcaacagagaccatgtgtgacgctccctgcttggcacactataaatcacagtgaagcagttataactcgacagcgtttcaagtgccacatgtgtcacgtacctgtgtgaacagccattttcaaagatgaaataagtatgaaatagaagctcactctagatcagcattcacagatggacatttacaataaatgccggtgatagtaacactgactttgagcctcaattaagcaaactgttagcatatacatacaaaaagaatttcagtcttttcattactagactggtattacaaaaaattatgctaaattgttagtattatattttgaatttcgccaaaaactgtgggcatttgttttctttcttgttatgtgagtatgcatatattaccgtcaattttgcagcttcgcctgcaaagtctgaaatatttcctatctagacctttacagagaaagtttgctgacccctgtgatggagcactgagtgcatgtaaattatgagatggtattttagttgtaaaaaatgtttcatcgctatagagttatctttcaaaaatgtaattttcccctgattacaaaagtcatatgtacaactgatagaaaatttaaaaactgctgcaggatataattggaaactctccttaatttttatcacctggatatgatgaataaaccctgctaacatgttagtgtattttctctagactatttttttaaatacttgcatatgtttgaaaccttactctaaaaacaattttcaatgtcacttaaactttgagaagtagtttcccatattattcacaaatctttgcaaacgtgatttgtatggttgaatactatatattcatgtggatgtgccataatctgagtctcctttggtgggatcattgaagtttttgggttttgaacccccctcctttttaataatattatttaaaaaaattatgctgactaatttatttgcccaaccttcagatttttttacagaattcttttaaatggtagattactttcattccatatgtaattcagttgagaagttggataacacgccctaatttttatcaacacatccttttgggtaagtcaagctactcttagttgcttgataaaacagaggttgctttatcttatgacagcctaatcgtacagcagtatttatggcacacactctagaacaagcctggaggctttaaatcttaactgtgtgacttaagtcattaagctctggaaattggaaacaccagtagaacctctctcatagggcaacagttatattaagtgaggtaattgacatacagtgcttactcagtgtctgacaactagtaagagctcaataattgttagcagcaatataataaagtagaaatatccagctctctcctccctcaaactgaggaatatccatttcttcagaaaaacctgtgactttgagaagaaaatctttctttcactacgttaaattcagcttctttcacttttcaaaatatcagattttcgaaagctacagctataccacttatggtatttacgtccttgacccagtcacctaatctctattgaattctccttttcctcacttgtaacataggagatcaaagtcacttactttattggattgttgtgagaatgaaattagagcatacatgtaaaacacttagcccagcccctgtacagagttagccggccaatttcctattgcaggctatgataaagacaaacattgaaaatcagtgattagacaaaggatgcttccttgcccctggcagccttcgaaaacttccctcaccttactgtggatagcagcattactcctttttactggagaaaaagatagtctcagatgcataatcagatgaatggaccatgcagaaacgctgattaaattagttatgtgtattttctgtgtgggtatgtgtgtgtgcacataaaagagcaaaaaaagagtttaaatgggcccaaaggaaggcatttaaatttgaagcctatagttgttccatggttcctcttggcttctgatatcagttcctcctattaaattattaagtgttaagaaaagaaatgtttaaacaaagccactattagtttttagtcaaattctgtgtgtacttctgttatattcaaacaagctaatgagtacattctttttcttctgctcaacttgaaaaggttacaaacaaataaactgtctcaaaatctttattctctctggaatttatttttcagaaatattaactcaccttattttttaagccaaaaatttaagaagtttattataatttgttattctaattctgctgctgagttggctgttttatttaacgataaattgaatacaaaagctccccaaggcaggaagacagagtaccaagctctgaaagtttggcagtttgacatttcatggtagcctcagacagaagttaatttcgatgctaattatgtatacatacttaagttgttgtatgggctagtgggagtgtacatacatgtacatatatgtatgtcttggaggttacactacaactaaatttagagtcattttgtgcagctgggcgtggtggctcacgcctgtaatcccagccctttgggaaactgaggcaggcagatcacaaggtcaagagttcgagaccagcctgaccaatatggtgaaaccctgtctctactaaaaatacaaaaattagcagggcttggtggcgggaacctgcaatcctagctactcgggaggctgaggcaggagaatcgcttgaaccccttattacctcagaatatggcctcatttgtagacagagtctttccaggggtgatcaaattacagtgaggtcattagggtggaccttaatctcactgatgtctttataaaaaggataatcttgggcacagcgctgtgcatgaaagaaggacaatgtgacgagatctagggagaagatgtccatatatgaatcaatgagagagacctagaacagacccttccctcccagcgctcaggagccaacccagcagacacctagattttggacttccagcctccagaactgtaagacaatgcacttctgatgtttaaactacccagtctgtggttacaacagctctaccaaactagtacacattcccttaaaggaagttcgtacagtgtcttacaacaatgaactacattaaaacacactaaagaaagtaagacacaaagggagattgattgttcccatatactgacatttgaaaagatctaatacatgggaaattggtcttgaatcaactcataacatagagttccctcaagagtcccaattcatcattaacatccatcaaaaaaatcaaattcctcctaaaatgcttaagatgggagataggaaagatattgcatgctaagtggaccaacttgtctttaaataaaatgaaaaacttatctctcagacatgctgaattacattacatacactccattgcatatattccagtaaaataaattcgtgaccagtattctgtgtaagtacagtgatatattctgtagcccagaattcataattttactttaggcagcttaggtctcttaaaatatctcccgagggttgaggtcttcatccagccggtggccctattaggaagtagactagaggattataaggctttataaatcctaatgttgctggggctggtaattcacaagtagtagatgcagaaaccacagggagaagctcagagtgctgggagaactgaagacaggaaagtaagaggctctagaagcctccagattaatcttcccaggaagaagcggagacactaatgcttgagaaacataaaaacagactacaaaaagcagtaaggaaaaaaccacattatagcttttacttattttgttggactgttattttcaaatcacacaattgtctgagatgatttaatacacaattacataaaaaatgaaattaacgtgtctttaaaagcataaaagcaactgctaaataaagccataacatttttctctgtgctaccaaggtaatgaaccatatttttcatctctaactgtgcctctgtgtcatgagtatggaatttggggcaggaggggggcagggaaatatataccttcgctactgagagatcgtctcatagctccctgggaggtggttcagagtgcagtgggttgaagaacaaaacagcaatacttatgaagaaccctgccactatgacgccaaatgcctaaataccccgacaagttgcaggggaaagacaagagccaatggaggatggcagagggttcacattttgtatctcggtacctgtttggctgaataaagctgacttctgaatcaagatgctgttctgttttaatgtagaaaagtattgtcactgaaaacctatacaaacctaggtatgcatatatgcacacatatatggaactcgatagggcctcctgccttcatctatgtgcacacacacacaaattatacatacacacttgtaaccacatgttcgtattagaacttttcccagtgtctagtagaaatacctccccttagtagtcttttctgtaaggtattctccaagtttctgagaaaaaaaaaattatggaagcatatcttattttcaaaatgatttcacagagagcctgttccaacgtactgcaaaataaaagtaaagattttactcaaagattgaataaacataagcatacatagaacatctgccatactccagaagtggtgcttgtgttggggatataaataaaacaatagaactttgctcctgccctcagggagacaacagtctgacaataataatagttattatttttgccatttctttttcttttctttttttttttttttcttttgagacagagtctcactctgtcgcccaggctggagtgcagtggcgccatctcggcttgctgcaagctctgcctcccgggttcacgccattctcctgcctcagcctcccgagtagctgggactacaggcacctgccaccacgcccagctaattttttgtgtttttagtagagacagggcttcaccgtgttagccaggatggtctcaatctcctgaccttgtgatctgtctgcctctgcctcccaaagtgctgggattacaggcgttagccaccgtgcccggcctgccatttcttaaataatatctaatacaagttactagtgcactgatatatgcctaaagaatacatcactagatgaaataatgcaatgtaatgatttttttttctctgttactcaactactgcatggcatttggttgaggaacctgtacagattggaggtgacaaccccatcactacatgcttgctctggaaagatgagctttaatcgaaggaccaaatctgtgttccatggacacttgtttatattttctatgatataaaatgggtagggagaaaaaaatcaagtgagcaattatgtttcacatctaggcttaattaaggttttatgtaaaagtacagcaaaaatgtacatatgtacatacataaatatcaagagattgtttgttgtcctatctcagtgggggaacagaataacatatgagatggattagacttctgataggcggatctgaaggcatcttgttttacataatggtgcggtatagtggtctgtggagattttctttgaggacgcaggccataatctagtccaattctagttatctttggtttggggcctgggtatttgtgtcactttagggagttgtctgacaattttggttatccaggatgatatctgaatttgcacaatcatcagggaaattatctgtgggaagaggaagcactggagacaacaaaaggcctttaatctaaaccagaactagatagatttgcatgtgtgtgtgtgtatatgagtgagtatgtgcccgtatgtgttttcttgtgcatttgtttacatgtatttgtgtgtgtatgcttgtatatgtatgtttgtatttatgtgtttatatatatgtgtttttgtgtgtgtcttttatatgcatgtttatgtttatgcacatgctacgtgtgtgtttagtgtatatgtgtatttgttagtgaactttctgtgtatgaatgtggtctgatgtcttttcagccagctctcaaaggtttctgggtttgggtttttggtctttcattgtaattaactaatggaatatctactttcactaattaattcaattctgttaaatcttttggctggttaagtatcaaataaagagctatgttaaatgtaaaaatgtgagacaaaagctcaggatcatttcctagtattgtcattcttgcaaacttcaggtggaatactgctcccaagtctgggttgccaattttgagttcaatctttttctttctgtatttattttgtcagtatataatgcaaaatttaaaggaatgtttcttgctttctcacaaattgttaacctcatattttctggtcatagaaggtataatttataaaattattgtaaaaaatgttttgaaaaatagagaaaatggagattacctgaaaccccacagtatcctcaggtaatatttgaacaggtagatagaattgcacccacatcaataagaactgagtattagatcacataacactctttctcctgctctaatatgtctctccaggaattctactgtttctctccttcatcataaattattctgtctttcttggatcttaactgtaagcatagtgtgtactgctctattgcatattattttttaaaaaatcgattcttgatcccactttctctgctaaaaatgaccctaactcttcccttttctttatagaacaatgtcttgaaatcattgtctacattcactgtctcttgaaacacactccagtaaagctttagaacccacccttccaccattccaccaaaaagactttatcaaggttattaattactcccatattgctaaatccaattgcctattcttagtctcatcttactggacctataagcagcatttgacccagccaatcactccctccttcttgaaatatttcattccctggccttccaggatggttttgctcgtgactcattaactactgttcttcagtctcctttgctatttcttttcttgtctttgacctcttagtgctggagctcaccaagtctcactcttcagacacttcactctatgaaatcctgcaccccgcccccttctacccccaccacatccaaagtgatctcatccagtttatagttctatttttatgagactcaactttacatgagatttccctgatctccagacttaaatattcagctgcttacttagtatgtccagttggaagtctaataaatatcccaaccttgacatgttcaaaatggaattcctggtcttacctctcaagtggtcctagctatagccttcccaatctcagttaatggttacttcatccttcattttgtcaggtcaaattcttagagtggtccttgatttgtgccctgtctgcctgccaccacttcatatccaattctctccgttattatgttttagaaatatttcagtaacctaactaccgctgccacgtccactgctctaactctggtcgaagccaccaccatcactccccctgggtcatcgcattggctttcttagcaggttgtcctactttgattcttgcccttacaatctttgttcttaaaaatggcagccagaacaatccttttaaaagataaatcaaaccatgttgacctttatttcaaatccttgcaatggcactctgttgcactcaaagtaagggtctaatgccttacaatgacctatgcaatctggctctactgacctttcactcttctttcccattccttctgtgatgtagtatactggcccccttgctggttctagacatccccaggcatgtcatcatctccaatcctatgttactttctgttctctctttctggattactcactccccagaaagccacaaggttcactcccacactatcttcagacctctgctcaagaatcactttgtcagggagtgtttctgaccaacatatttacaatggcaacactgcccttcagcattctctccctccctatctcctgccttgctttatttatttatttatatttgatgtcacttagcaccttctaagatactctacagtatgctagtttactgctgtaattttattctagactatatgcttcattaaggctgggatttttatgcattttgttcactgatgtctatatcctcagtgctaagcacagtatgtactggatatacatgcttttcgtaagtgaatgaataatatgattgccattatactatatatgttatgttgacatgatttttacaacttagtaatacctgagaaagttcttattttgttaggtatctgacctctgatagcatgattgtttctggtacaataatattccatttcaataatattaatattccataatttattagctccctattactggatatgtacataacttcaattattaactaatataaagactactacctacataaatatccacctacataaatatttgtacaaccttcagattattatcttagcattacttttctgcaagaggtaaatttgaaccaaagcatatgctgattctacagatttagatatatattcccaaattaacctctggagagttagcattcattttctcaaccaccgcagttacaaaagtacccttttcccagcacactgagccacactttatattgttattaaattcttgtcaacttgatccacacaatgcatataataagtttttttaaataaactttttatttcaaaataactttagatttataaaaattgcaaagacagaagagtcttccttatttttaacatcttatataatctttgtacatttctcaaaacagagatattaatatcaatatgttactactaactccatctaataatgttttgatttgccgtttttcttagttgaatatctctctcctcatttgtcatttgcatgtcttctttcatgagatgcgcttgtatattgcattccaggatttttattgtataatgcatttttgatgaattaatatagtctgttttatatatggtacacagatctctggaaggaagcaataatttatacccacatgtcttaaaatatctctcatattattgataatttttctaaaattagtagacattatgccacaaaataattgcattatcataaatatttgagttaacattgatatagaaaacaggacaaacatgactttttaaccaagattaattaaattcaagttatttattgatttattagttaagcctctctactgcaagtgacaaaaagtctaactcaacttccttaactgtcaatggtaatgaattaatgtgatgggataagtcccaaggtaaggtagttaagttcaggaatccaaagttgtccttaagctttgacaactctacgtttctcagctctgtatgttgacttcatttatcagaatcttcaggatggtaaaaacagcttctagtaaaaatcgcatgggtcatgtatttgtctaggaatcaatcacagtgacacaaggaataagctatgatgattggccttttccagaggcaagtgtccactctctcagacagatggaatctcatgtactgagattggtagaaagtatatctctgaattaaaattgtgaaccattactggagtaagttaggcacacgatggaggcaaacaataaatatctagtattgttagatttcacacatgattgttaagaaatccattttaatgtcgtatgaagccatacagtattccacaactgatctgagcactgcttccaattacctgtgaaataaatagaataaatctttttaccttattttttcctatggggaagtcagccctatgatatccagttaattggtgctaaaagcttgttcttaactttattcactgatcattctttccatctgtaacagaaaatttaacactcaacatcagtttttatagtgatccaccagccactatgccaattattaatgccctttgttcaaatgttctaatgacccactgtccacagtacatttcacaaacacattggaaaatttttgaggctttcaccaaaaggttgtccgctgttacccaatgaactattgcttagatctcctactgtgaatcttctggtctttcttttgttttgctatatacctacactgttgtcaaggatacccagctctccactctcttgtttgaacagtccacaaggtgttctattaaaagtcccaattaaatgtgtacagccattcacctgtacattcatccctttactcccttgcccacccacatacaaccaactacgtgatctaaaaaataccaacaggtcaaaagtcatcaagcgaatgaacaaaatacttggaatctctaggtgtcacataatagccatggcaatattatctcggataattgctgccctaacaaagcagaataaactcagattgaaaagatgtaaataaaaggagagcaatggaaagaggaacgctttttcaattttataactattgcattattagtattttaaaggttaaaagagtttcttcaatgtaaaacttattgctctatgttgagcaagagagaagttgttgagataagcagaaaagcatttatatcatataaagttatagaaatagttggaatttaaattacattacatacttagtaaatgtctgtttttatagaggtacttcttaatttatgaggcagtatagggtagtggttaagggcacaggctttggactaagagagatattatcattctcatcattcctgcttgctacttgaatgtccttgaggagggcataaccctatttgggactcagtttcatggtctatacaatgacattattaaaattattaataatagcacctatgccatggcatctggcaaggatacaataagataatgcatgcgatgggctgagtacagactttccacgaagaatcaatggatgttagcattcattaaataatacacaatgttattaaggaggttgtgagcaaacaatttcttttatatttaggcttctgtagttttatagaatttatatggctattttatagaatttacatggctatttataaaatttatatggcaatttttaatactttgtacaatgctttacatatttccattgtgctatgcctggtgccatgcaagagtaaaacaaaaaggcattcaaaaaacctggggacacaacctatagaagagcaggctcaatggtgacatggtggtggccaatgtgaggaagaggttacatgtatcttgtgccatgatagggaatagaaatagatgtgtgaatggaatgttcaggaaggcagattttgattgattataaaaaggaatggctcaccctgaaattcagaaccagtctacaatgctaaggtatactgctggacaaaatcagctactttaaggatttccaagcagaagcttggcaaaatgtcagccaggaaatcatagaggagatgcatttgaagaatagagtttgagcatggattaggtaaggtaattgttaggaacccttcctgctgtgggattctgtgattcttattcataaataaaagttagatttttttaccctgataggttcatattcattgaatcattcattcaagaaacctttggtggcccacacgtgtaatccagcactttagaaggccaaagcagaaggattccttgagcccaggagttcaaggatgcggtaagctatgatcttgccactgtactccagcctgggtgagagagtaagaccctgtctctaaaaagaaaagaaaaaaaagaacagaaacctttattggcacaatgagaaacaccatcaggccatatttattatgagcatggaccatggagcttaatatgcctgagttcatccctggccttagcatttaatttattgtgatgttatgcaaatgactaaatttctctgaaggcttcattgattcatataaaaatggaagtagtcatagttttggctcatagaatttttgtgggtatcaaataaaacatagaattgaataaccatagccccattattggcatcaagtaagcactcaataaatatttgctatgattactattaacagtgaatgaatgaaagtactgagatatggaggattgaaggtgaattacatgatatcttagttcataagaatttagtcagtgagaaagtactgaacatccgtatctagaatccaaggtaggagataatatatacacacgtttctgtaggggtccactcatttattcggcatatatgttcatatatctataacaggaaagaaggagtatttggcttcagggagttgacgtgatgttgtgttggaaaaaggaatggcaaacaaacacataaacaatataaaatagggtggtaggcataaagagtggcatgggtgtagcatgtgcggtcaggacccacctggctaaggggatgatatgatcgtatacttgggtgatgaaaagaaatttagagggaggaaagacaatttccagatggaatcattaaggtagccctcatggggaaaaataatattagagttgattcttgaaggatgggtagaatttaatgatccatccgttactcaattcacttagctagtacttaaggagtatgtgacagccagtggaaacagtactggaaatgcaagagagcattctcatgtggaacttcagatggagaacacaagatgaccgctatcaccatcaaatggaagacagcaacaatagtaacaaagataataagcacacttcttgcagaagatataacaattaactgatagaagaaaaggtgtaaaaaaaaacttacctaaagggttgaaaggtttaaaatttctagcttgaggacaaagaactttgtcagtagacaatagggagttgctaaaaggtcttttgagcaaggaggtaatataatcaaatgtttaaaaagtcaacccaagggcagttagaaaactgtttcaatacttatgcgtgatattatagaattgcttgctcattcgtccattcactcattcattcattcgacaatcactgatcctatgtgtccagtccaatgcaagaagattagtaggagaaataggaaaaaaagagttacatatacaatcaagtatgaaacaaacatgtttgaagccaccacatgaaaaggactataatttcaagtgaagtaaaagtttaaagaaatagctgtaaatgtgttttctctatcctttgttagaaaaatagaatattctttttaaaaatccaattatgccatttttctaactgtctaccttagtctgttatgagcaagacttgaagttggactgaacagatgaccccagataaaaacactaggataagaaaaacctaatatattcaaccaactgcaataattcatatttttaagatttcatttagactattatgaataattttaatatacggcctctaaaatttatgaactgtagttagatggcattttcaattcacaaaggcaaatgaatgtatttagatgatatacaatctttctaatggtggaactttttaatataaagtttttattgtaataatttaaaatgaacaccacacacatttgtggagaaggcctcaagatcaaaatttgcaaatgccaccatcggttttgtaacctaatgcaaacttgtagttaaataaactagtaagaaatcatactgtttccttttaagacccaaagtaatgtaaagttcctttaatgttttttttgttttgttttttgttttttttttttgcatattgagactatagacaaccagaattaatacaaacatggacacaaatttggcaacagcaaaatgggaattatgcttgaaaattctttggggctgtttcctcagcctacagtggcaaccccttcttcaacatagtctccagtcaaaagatcacaagggttgaacaagagtagtgaggtgtcttttatgacccaacctccagcccagccatgaataattacagcaggagcaagatacatgatccaagctggattttgcaaattctagcagattttcttctgcaaatgtgggtaatgggcattgggaaataatgcatattaaggaagtgccgaataattgctggcaatatactatagtggtgtcttgatttctgtgatttctgagatccggattgttcttctcttgtgtggatttttttagaggaccagtatctctgcagtaaaatttgtcttgttcaggttaattttaattagcgttcatggtgtgctacctaaaaacaaaagaaaacaaaaagactttaatctgaacagtcattttacaattgcagtcaataaaggtttaaatgttttaaattactctaacattatatagtcagtataaaatattttgcagctcaagaaattatgtcattggttaaaaactgattctcatgactttgaagccacacttaattttatggtgattttaagatgttgcaaagtattacagattctctcatgctttcctctaccatatacaaaaccagaatgaagaaaattcctagtgcaagcaaaggaaaggcagccacaaatatatatgatcttgaactctaaatcaattggaatagattttaaaacagaactaggacaatccttttagaaatgaagttagggcagaaaatggtacttccagggtagtgttgtaatttggatgtgattcatttcagtccattgcttgaattattcgcaaaattttccttcctcatttagttccccgaacttttcaaggatatgtttatcagcagcaggaagaaatgcctggtagctttagaagattgccctgtctctttgcattacttctttcaactctgatgtttacttcgatttttaaaatgacactgagaggatctgtaggttcggatggattttgttaagagaaactcaatgtcacagagactaaaactcctcctgaacaacaacaatcagttagtaatccttttctctttctccattacatgtcctccttttatttgttgttgtttcttgctttagtggtacatattaaaaattaatggctgttacatgattttagaagggtatccacttttcttttattagcaggtgtaattcatgaaaagtatactgcagaaacctccattacaatgccgctttctgatagaattcaattgagagatgttattgctatttattaattgctcggtctgcactgtcatggttgatgatgttagcacagaccctccattgagttacattcttgtattcaattagggatgtgtattattgtacatgttaacactgtagaaccggggatgctagccatctgtagatttgattttttttcccttcatagtcctcaaaaatggagcattttacatcagcactgctagagagacttacaaaataaaataagcacataagcacatcagttgcaggtttaaaaacaaggacagtgtaaaatttaaatttgaagattctatcaaaagtatttgcataattagaatcactagacattttcattttaatcattctaggtggtcgcatatctgaagaagagtaagatcagaaatggtactggtttatcctgtcagaatgtttttctctggctaaatggaggaccatgttatgatattaaaagatcagagtgactaagataataaaaccaagtgtgctaaaacttccccaggtgaagaagatgcgtgaattgcaaaccagtcctaacaggacatttaggaggggaagaatgctacctgctcctcactttcttccctcctggtaccaaataactgctgatacttccaatatagagcaacttttcagaataaagaaacagaacaggaaagctagctggctggcagcagcgtttaatttctcagactcttttcatgaattattctaaaaagatgttctctgacaacatagatcctttctaaggtacctcaataatgcattgccgtggcagcgcaatcatttacctttgatgactcgacattcaccctggtcagttttgtcacttaatgtcaatgtggattgaagatctgcttttgaacaatcatggccttctgtttgaaaacaggaggcatacaccccattgctctggccaaattccaggttaggtaataacattctgttacctaaagaccccccgcagtttcaattagaaaaaatcgttgtgccttactcctctacctgtggagctatataagggtaggtatcgcactgctaaacagcaaacttgtttcaccccagaaggaactgccctttatcatcatccttaattaatatttattgggtacccatagggtgaatgacttgggaaaaggcgacttagtaattaaatgtttccgaatgccggttgtcccctccgagaatgaacgtggaggaccaaagtttgaacagtctattcattatcacagaaatagcatctatccttgtaatatggtacttcctcgctcgcttctgatatctatccatctggtacacctctaatcaaaactatttttcacatcattggatcctaatcgcctcagaattatgtcgagaagctctttgtggggactgaccaaagagtatgagttggcctcttggctctgaccagttgcaaattacaaatatctactcttctgcagggcagggagggggtgagtttgttgtcctaatgagcagcatgcttttaatgttgaaagaagacctctgtgtttctaggattacattgtcgtctgtgccatctgctcttcttttttgctatctagctctgttcacaggatgcagaggcgccgggaactcttagaaagaattgggtttagtgtttcctttctctgctctccagacattgtcttgatttgtagactgattggagacctgtctagtgaatgaattcttacgtcaatgatcatgcttccttcttgccctgtgcctactatgctcagattctcaggatttaatattttctgacataacttccaagaaggtatgacattgccaggggaagtaaatatttcagggatgaccctgctcaaccaaaaaggtctcatccctctacttgaggcatcgaccctgaccctctggtctaaacgttttgttctgcacaggtgtacattcacacatcctgggcacagatgccagcagatacaggagataaacaaaacagtttctccttgagcttgcactccagcactgaacagagagcccccaccccgtgcggcatcacacaagatgcatccttttggctctctcaaggatgatgacaaaacatgaattaagaaaaaaaaatacacttttcatgcttatttttaaaattttatttcaaattttcaaatgtctcaccactttcctcttttttatttcaggagaggatgatgcgtgtgggagcggattactgagatgatgacgatattctctgtataggggaattatcttataaaaacatgtacaattgcttgtattttgttacagaaccaaggttaagaactgcatttacaatggttgtgataagatttagcatttaaaaaaattgtaacatataccaaaatatgccatagctactagaatctagtgacgttgtttccatgtgctttttcttgcactctcttccttccctcagttgagctcatcccctttcacacctagcttcatcccaatgcaacttctggtcccttcctctgtgtcccgtgggacctttttctactgctgtgatatgtccttgtattcttagcattctcttagaaagtatcctttattgccccaccataaaggactttttccatgtactgtatcaggtatccttccaaggttgcaagcagcgtagaaaactctggagaagttgagcaaaggggaacttagtggaaggagagtgggagctcagagaatcactaggcaggctatagcaccagtgctaaaaatgggcatggggaatgtttcccaaaaaaagtccttctgttttagagatgcatactgaaatatttatgactaaaatgatgctttttctagaagttgctccattgtagggtgggggtagataggattataaaagaaaccagaatagtcatgagttgatgagttttgtagctggatgatgggtacatttgagttcattttctgtcctcactaatttggggcatgtttaaaattcccatggaagaagacaatcagaattaaaagatgtatccaaggctggttgtcctgagagctacccactattgtacattaacagagatggatgtcgtgactctcccatagatatgaaatgcatgctaaggtagacacacttggttcataggtatttgctccgctttgattcagtcaaggggtctgtgtgtgttagtgtatgtgagggagtgtgtgtgtgtgtgtgcatgtgtatgtgagggtgtatgtgtgtgtgtgcatgtgtatgtgagggtatatgtgtgtgtgtgtatatgtgtatgtgagggtgtatatgtgtgtgtgtgtatgtgtatgtgagggtgtgtgtgtgtatgtacgtgtatgtgagggtgtgtgtgtgtatgtgtatgtgagggtgtatgtgtgtgtgtatgtgtatgtgagggtgtgtgtgtgtgtgtttgtacatatatatgagggtgtgtgtgtgtgtgagtgtgtgtgttctacaagatgtgggtgtaaatatatgaatgcctgcattctgaattgtgtgtatgtgtgtgggtataggagtgtgtgtgactgtgagtgtgaaatagatctgccagtgtgcaaagcctgagagcagacgtggcagagttgaagggcctttgttgtctgtagcaggtccatcttgtatttagttgacaactgttctgtctgataattcctgcagcctttgaagtttccatccagtgaatataaccctaaaatatgaatgtccttttccccaaaccaagtatgcttcattattatgaaggcatgatctgtatgctgtcactcagtgcagtataacttaaaaacataatctgcagtgtagctaattgtcaataaattttctccattatatctcaaaatttttaaaaaaataaaaagaaatggataggaaccaaggtgacctagattattaggaagcagaaaagggagaaaatcgtgagatggtgaagaactgcctgataagggagctgcaggtaaaatgagcaattaccttattttcatctctatcactggactgaagtcccaattccaggtaggcagtgtgtgatggaatgagcttgcttttctgcctggtttctagctgtatctagaagatgacaggaacgttctggaagaaaatgggatcctccaaaggtgtgatgaggtgcaataggtgtttgaattcaccagggccaaggactttgggtctagggaagagaggtagttcctcaaagggaaattagcaagctgtttggagagggaagaacaataccggtggcccccagtactaaatgtcctccttagtttgactccaagactcacaactgctcatttttctctttagctttaaaatctttagtaagattttaaagaacaaatttgagactcctttagtgtgataaccaagtgtgggccttcaggaacagccccaatttatgtttcttgttttcctctggcctttttagtccacttgcaggctacaaataccagtcacacaaatactttctttcttgaaacatgctgctttcttccattcgcagatgccttggttcaagattctccttctacctgaacttcctttgattttcttttttgcgttacaggtatttacttgttcctctcaatccaaatcacatggcctgtgttcccattacactgcatttccatgggctggccttgccaatggtgttatggtcagtgagggcatggccctctcttcaggttacagggtggggcacttgaaaacaggaagcatgtccttcacctttatatcttctctaccgtggcaaccagcaccatatatatcaagtagaaggcacccaacaagacacatattttgagtgaccctttcatgctttggtgacttgtttatgttgattgtaatgttggcagagatgcattcacaatgttgcctcaatctacatcttattagtgatggatctgtactgacttctccctccctgtccccattccccaaatccttcttttatctccttgtttctcccaaactctgccacttttcacattacccactgaaccatcaggagcaatagtaaggactctctagttgccctgaatcaggttgagaaagtgtgaggacttgttacctcaattggtccctgaatctttagttagaagatttggagacactgtaggtagttgtactttgccataccctctaccttattttttggtggcagtcttagaaattaacatttattgaagtaatcaattattgcaacagaagcacaagtaaaagagggggtggtaggtaaagtagaaatatatcaagagaaaactaacttttgctattatttgtataattgccacaaccctaaaaagaaactatttttctaaatttaacatttgaaaaagatagtgggaaacttggaagtaaaaatgaaaaataacaaaaaaaaaaaggtactaggtcatgttgcttgctctagatagttttggcatggctaagatgtgctagaaatatttcattttgacatgaactctgaccacttttcacttgtaatatcgccagcatacatatatttactcaagacgggatagagtttgtgataacaatagtgggatgcactgtggccatattaaggattcaactcacttatttgagctgagtgcatgggcagcctgtagtgaatgaacttgagtgacctatttcttcttttttgtttaagaattaggactataagcagccaaattatgaatcaggaactaatagaatgaatagatgcaagaaaacagcatgcaacaatttaatgaaagagaaatgtattatatatgctcaagaaacaagtaaaatgccacttttagattacagtttttccaatctgtttatttgcctcattttctttaactgctatttcactcaactacaacttttaatattcattgggtaaacaatatagaaaagcttggttatttcaaatctgtgttgagctccttctaacttatttttatatttcaccatctataatggagtatttacttataataggacactacattttgcatggataagttatttctcttctttctaaggtgtctaagaatatcaggttagaaagacatactggttaaatggttgattttagtcaaaatcactgcagcccctttgggatctactgtttttacaaagtgtggtcctgggataattgtgtcagtttcaggtggggattcatgctgaaaatgcatattcctgtgtcaattctaaagccaaatatataaaaatgtctgctaattttaacaaccttccagaatctgtatacaccagcttttgagaactgctcaactgcaacttccgtctcctgggttcaagcaatcctcctgtctcagcttcccaggtagctgcgactacaggcgcacgccaccatgcctggctaatttttgtatttttagtaaatggagtttcacatattggtcaggctggtctcaaactcttgacctcaggtgatccacccgactcggcctcctaaagtgctgggattacgggcatgagccaccacgcctggcccatattgttattttttactaatcaaagtaatacattttattgtgcaaaatttggaaatacagtaagcaattgagttaaaaataattcactatcccacaatgcaaaatctttacaatcattatatatttttttaaattggaagcacataaagaaaagccattaatattatgctgtatatacactctcctttttctcacttaacaaatctaatgcttaacttagacagtgcatttgtagaaatgcagtgtttggaaaggaggaggataaaaaatggtacgggagagtgcagagaaaagaagagaggaagaaaaggaaggaagagaaaggagatgagggtgatgatggcaatgtgaaagttaatctaaatgtatgtgtcagaataatgtcttccttttttttttttggtggttggaaataaataactttaaaaactctataatgaattatctgaggcaccagaatctcactgttaaaaaacagatattggctgggaacgctggctcatgcctgtaatcccagcactttcagagaatgaggcaggtggattgcttgagcccaggagttccagaccagtctgggtaacacggcagaaacccatttctacaaaaaatacaaaaattagccaggcccagtggcccatgcctgtagtccaagctatttggaaggctgaagtgggaggatcacttgagcccaggaggcagaggttgcagtgagctgagatcatgccactgtactccagcctgggcgacagagtctcactctgtctcaaaaactaaaacaaataaatttaaaaataaaagccagatgtatctgatgtttgacaacttctttccattagagttgggaacagatcactggaaaaatggggacagtcagtttgatcacaggatttggtttaccgcttggattcattttacatttttttaagcaaaattaacttgggaacttctttatataacttattttttgcgtgcctaatatggaacagatgcagtttttgtccaatggaagtgatacttgagctcgtctaatgaaaattgttaaagtgccaagtattcttattctgttattagggttatattaggcaactggcattattcattatttctaactaaagtgaaacgtggacccccatgcatgaagatatttattacttattgatatttaaaggttgttaaattaatcttatttaaattgctcctactaccaaccactgttacaataatttattatataatattacttgagggttttcttttactttagtataaaacttgcaaaagcaatgtattgcctgtggatttttcctacagttcattgtaactgtgactaattcatcacagctgtttagacatgcaaaatctataatacttcacaatgttgattttctgtttctaagactagagcttgatttgaaaccatataatgaaaaattacatgcatctcattggaagaaatattactttaaccactgggaggtggaagaccaggaagagctgtgtggctctgcagctggggatagtgtatgtgaaattctgatagcttcactgaactttgttatgtccctcgacagtattgagattagatctgtctttagttttgttccagaagtaatgttactgctttatttttcctgttactcgcaagaggtagtatagaatgtcttccaaaatataattccccacgaaatatctagggacctgtttttctttttgtgagtcattcatcactcctttctcttctcttctttctcctgcttctccttcattgcttccttctctttttttctaaaggacagtatactatttttgagttttcgtcattcaaaaagctggggagaagcacaaaaggaagtggtggtttccctctttctgcctcttatcagatcttataatgggttaaagaggaaaacaaatcaggggtaaagtgaggctttgcgtttattggcggggatggattgtatctattccattaacatggatgattgaacgctgcctcagtaccattgtatttgatattcaaactgatgctatcattttcttagtaatgattgaaagctgcctcggtatcattatgtttgatattcaaaccgatgttatcattttcttggtttgcatgtggaaaagactgatgaattattagttacatcaaatctttaacatgtgcaaattagtcaaatgcaaaacatgtttataatattcatggttattattcctccatttatattattttttgaggcttcacacaagagcagaagaatgtgtgaaggtattagctgccacttagttgtttagagtttaaatatttaaagcacagagaccttagtaaaaagaagggatttatgtggatacaaggaaaaatattgttttgtccactgaactgtagttattatatgaaagctaatggaaataggagaattgaaaaatgtaggtaaacttgttgttttaaaatactcaatttgtatggagtttggatattttatgaagtaaacaggaggtgggagtggtacaaactgagtacctattcattcatttcttcagaaaaatacccatttactaagggaatatagcaacacataaaatagatacaggctttgcctccatggagttaggacaggcaggcataaatttaaaacccacataagttgtataattactagtgtgacattgtatgaaggaaaatgaaggggatgacaagaaaatattaaagggatcataattgtcatgaccttggatgaaggaagtctgtcttacggaattgctatttaagcttgactgagcatggtggttcacacctgtaatccaagcactttgagaggctaaggtaggaaaactgcttgagcccaggaatctgaggcaagcctgggtaacatagtgagaccccatgtttaattaaaaaaaaaatgttatttcaactcaggcataaaacattagtaggaattaaccaggaaggaaatgaagagaagagccttccaggcacagaaacaacagcatggcagtggtttgctgtgatggaagtaccaaaaaaatgctaactttttatatagtacttgctccatcatgtgttttccattagcatatagtattttacatggatgttctaacaaagtatttttagaacccatatgcaataactgaattattatacggtcagaacaatgagaaatgtgcaaataatttcatgcaattgtacctactctttctatatgcaaacactttaaagaatcttctaagaagatggctctatgaataacagggagataactgctttaactacaactaactttgtgaaacttggttttcagagcaaaccaggaaaaaaagaaatcagaaaccacatgtcaatactttttagaaaaggaaaataatttggtatcttatcttgctgttacaaataggctgatgtctgaggttatatttaaagatatttttaataaataagactcagcaatcaagtcagatttgatttgctggcatagaattcatttgatataatgacacttaagggttgcttgacttctattccatttcctgatgcccaatctcattattaaggtaagcaactgtgaaaaagggtgactctttaaaactctcagtttaacagtttcacttcattgaattcttgtttaatttcttgttgccgaatatgagtgattgtttttagtatcattcatgaatgacacatagaagatttgctgtatagtatctggaggtatttctggaagtgggtttctggatttgaaaattttccatcatcttgaacctactttttaaatgtgtctaaattaaataaatcaatttaatttgtttgtgaaagttccatcttcattcacataattacccaacagacttaaacaacttttctaatgtaaaatgtcagttaattatgaatacatattattaaaaccaaacaagtagccagaagcatttttttgaatttgtaattggatttctgtatgtttttcttaagaatgcaactatcaacttttataatggtaaaccaattgtaatcttgttaaacatgccttgatttcagataaatagaatcgtagctatctctcaaggaatcaaaagaaaaaattattttaaatgcaatcttatttttaaactgtattacccataagtaattttagttatttaactttttagaggaagcatctcattagccgtgggttagaaaatcaactctctgtggcacaattcattaaaaataggatttctcgttcttggatagtgttttgtcaatatcaaaggctgaagtatttaatgaagtatttaaaatgccacgcaatctagcaaagatacctaagatttatatggaagagtatatcttttatataaaatttccaacttctaaaaaaattaggacacagattgaagcagtactttcagaaatatctgtcaccaccacacaccttcaattcgagatgaatgtaggcttcacatcactggtctgggccaagtgacatcatgcaaatggtggcactagtgtcatgagtaataatggcttcccccttcaaccctgtcaaactgtatcaggttgctaagctctaacttttgttgcagagctcaatgaaaactaaaataaaaaaataaaacaattaccaggttgctgtgtatgggttagtatagtgatttgccaataaataacaattaccataggaattaccatggaatgtgaatttctttttcctcttgttttgttttctttcttttttctttttttaatgaaatccatagaggttctttctctgtagattttatttttctttctactataaaattagaacttgtcactccactatgggactctgacagttaaataatagttcacaaatgattagcggaatgagaaattactgcccacagaaagagctctgtgactcagcagataaagatatacaactcaagtttaccaaggaaaccccactgaacatgtggaaacgaaaggcagatgtaatgctatctattgaagcacccagccagtttgttacacgtcccttaattatcagaataattttcacttgaaacttaaaaacaattggctcacacatatttcactttaagcattttcagctttgaaagggggttggtgaatgacattaaaaaagctccacacaccccctttttatcctccatctccgtttaatggaaaaaggattctggtaatatccagctatcttgctagtacagcaccaagcacaaagaaaggacagtaggggtggtgattttaattatctatgtaaatttaactatgcgccacagtcctgtgattgaaactcattactttaactttatagtttagttatgagtgtaaacctcagctcaattaaattataaaccagatcctgatggctccacatattcacagtctttgaaggaaaaacaaaaagaatatagacaggacacaagagcatctcagctatcttttctatgtatgttatcatcccccaaatgccactgtgaggcatgcatgcaaggtggtgtatactgcattgtaacctgtcactgtgcaacagaaataagctaatgttaagagttatttatcacaaatttaaagacaggacaaagtaatagtagaagggtttttaaaattttgtctgttttacagaatagtggtctcataaccctctccctcaaaattgtgtattaattagaacctcaagctcaatttttccctaatatctgacatatcttttaatatacattttttgagacagagtctcattctgtcgctcagctggagtgcaatggcgtgatcacagctcactgcaacctctgctcccgggttcaagtgattctcctgcctcagcctcccaagtagctgggattacagacatgtgccaccacgcccggctaattttgtatttttagtagacacagggtttcaccatgttggccaggctggtctcaaactcccgacctcaggtgatccacccacctcagcctccaaaagtactgggattgtaggtgtgagccaccccacccagcgatcttttaatattttagcgtgtgctatttctcattgtgacaaataaaagtcattcttcttgtctatatttttgttacctcaggggattatccataactgtcagattgtgtaagctccattgactgtagactaattgtccttacattaaatatattaaaatttctaattgtggtgagaagcaatgctgcatttccccttgagtcactgttgaatcagtttcctcacatgggagatttatttagagatagttttgcttcacttgaaataattgaggacattcaaaatgccaaagttattggattaacttgaaaagttgcgtttgctctacagatttatttcaagtacaaattttaaggtaggtgcctttaatcgacacttaattaatgcgtttacttttgttcgattatttcttggaattatatttcttacctcagttgtgatatttttatttgtaccaatgacacactcaggaatctaataatttgaggtttaatgggtaattaaagccactagacttctctagaagaggtcattattattagcgataatagtaataagagcgaacattgactgagcacttaccatgtgccaggacccacgctaagcatttcagaggcattgcctcacataattttaacaataatgctgttaagtggagttattcccattatttattatccctttctgggcttagggatgctgaataaccaaaggaagtttaaaagcaattaagtggcatagccaggttttggacctaagttcttttgactcccaagcccatatggtggggataaattcaatgatagaacaatatatcatagttaaacctaaactacaagtgaggataactaaagaatgatatgtagctatcatcttatgtggctgtctttcactatcaatgttttatctactaaattcttaaaagcaaatctccatccgtcatatagatttgcatcgggagcctagcacagcacttggcacagataggctctcaataaatattcgttcaattgaatttgactgatgtttgttttaaatatactgaaatataaaatgtactggcttggtttggaatgtggctgtattcatgcagttaatttactctctgaagttttcaagttagtgactttctcttatgtcttctaagtgcaacactgtgcttgtcacatctctaaagcaatttgccatgctcccactaagatgaattttcctgaaataatgtctgtgaccattttggtggcattttgtgatgctactagtgaatttccaagttatactgaagcaagcgagcacccatttgtagagctcaccttattcgctttgaaaatgccattgctcttggaagaacacttcgagtgaaaagggaaataagtgtggaggatcagcagtttgttttataccataagtgtttctcagtaattattttcccgaactgttactatagaaaaaaatcaatgcttatcaagaaaggagaaagaaagaagaaaaggaaagaaggaaggaaggaaaagaaagaaaggaaggaaggaaggaaagaaagagaaaggaaaggaagaaagaaaatgaaagagagaggaaagaaagaaagttgacattttagttgagtttagttttttgttgttgtttgtttgtttggactggggaactccacctatgattatatctacgtcacttaaattgcaattgcaatacttctgatgttttgttgtgtatgatgtgcaaaatcttcagtctcactatgtttccaaacacagatattaaatcatagctttttgtcattttgtgatgagatggattcaaattaagtacactgtgagataataaaaaaaaaataaaagaaagagagagaaatggatttggggaaggagacaagtgtggtcctgtttgaacatggcatcaattccttcttaacaccatccctttcttcttctacattttatcctatgccatttatcccacatgtattacataccttctatacataaagcactgcaataaggaattagcataaattcaaagataaataagaatagctccatgtccttaactcatcacaatctagtagagaagagataaaacatgcacaaagacgacattgattgtcctccaaggaggacagataaaagactgggaaatcagagtaaaagaaattgtctttaattttggagaggctcatagggtaagaaaaaatttcactgagaaggtaaaacgtgaggcctttaggaaggagtagagatcagctgcttctgaaatggagatgccaggaacacagaacattcctcctcctccctaggacagagccaacctcattctaaccactaccaagcactgatcacccttaatgcttgtttgctaccaattcctacaggatagaagaaatttgcattcttttgtcatacaaatagttgacttaaatacaatcttaagggccctgcaattaactaggtttgtggcagagagaaatttacttcttattgaatctcagtttccttctccatgaatgagataaatggacaagaattgtgattacaagctccagtcaatggtcatgactgcctgatatgcctggtagcctgtgccataagcattgcaagaacaagcctaagctaagttgaaagagaggtgatcaattaagtatgtcaagggcataaaaataaggagtgatggtatgcttgccatatatttacaaccacacatttagtcagttcaactaaggtgagattcctcattttgtgtcactaaattacaaggaatacctttatttccccaagagaaatgaaatttgaggtagaatttcttagtttaagctatttgtggaagcagtcttagaaagtcattgtcagccttttataggcagaacacatggattttaaagcaaagcagaaatactgagcatgtgagttgtgtgatgttccgttttaaggatagtttgaacacatagggaatgtcagaattggattgtgaagctctagatttgaaagcagttgaatatcaataagatttgactattaaaaaactcaaaaaacaccttgaattcattactggattgcctaggtaatgtaaggaatatgacacacagatccatgaaaagtatttgagaacagcatataaattgcatgttttggtgcttggatgtaaccaataagagatcttaggtataaattgagtaacatgccttagtcactaaaagaatttggcatggcccacacagctgttaatgggtaactctgattcttgctttttaaatttgagtttcatcagcactatttcaaatagttcatttaaaattaacaccctaacactgatgctaaggtgcatgacagtgcataataaaacgtaattttcattttacattatacagattacaatccctacactccgagggatgtagtggaatcttttgctgtaatgaatttatagcatggtgctatcagttcctctgaataaggaaaaaaggaatagcatcttttgtatgtttatttttctttactgatgtttctttggcactatgtttagcctcctaactacacctcttaggtttggaagagaactcagatttattacaaaattatttttaaaatatggcttatccattgcccacaagtgacacaaatgtcagaattacctatggaactccatggaaagcaatttaatttttcctatgtctgagcctttttggtgtctatttttatgaagtagttttcttgtgtttttttcctccttttataatttttaaatggataagttgcagtagcgtttctttctttgaagcagggatgataagagcaatcgcagagtacttctagttgtcaatgcccttaaattataattgattagtacacgaataaaggagtgataggggattggattttgaaagaaaatgggactaagtgtaactggtttgaagatatgattttattgtggaagagttgaaacacaaaggtttccccaaagtctcatttttcatagacatgagataaaatctgtaactctcattccattggggtttaggctatttgttggctttaatttaattggatagaaagcaaggaataatggtttactttgagctctcttttatcttccttagtaacatgtcacttatatgacccagggaccttctgagggtttttgaaaaggcctctttaaaatctgcttgcacttatttgggcactaaaatatgttttatttggagatgttcagaggcaataaaatatagaatatcattttaataatagagtaaaattcggtaaaaggaaacagtaaatacacgctgaaactggagtaacgaagtaaagcctgcctcctagaagttaaagtgcccggttttataatgggcatataaatgccttatgagcctgtttggtaggaaacacttaaatatgtagatcctctgtgaagcctcattacttatgtttctaaatgtttgttttggcatgtggtgccgtctttggtatacatgccatttgcaggatccgctggaatagccactttagagcaggtgcgcttgacaggatgaactgaacacacatattatctgctctaatgaagtgcacttattcttagcctggggcatagtcagtgatgttctgtgatttctctatatccatccagcagaagctttcctgtttctcaaaatacctcaccctagacatcgaggagccacttctatggaaggaaaagcagtttatcctccactgacatcctattgttagctgtgctatcgagttggcgagcagtcatcatcctgctgactaagaccccattctcctgggtctcaccgtggtcagatcaatgctctaatctctgggaaggaagaatgataaggcatctatgtagggtctcctctttagtcttcttttctcttagctgtttctttcaatgcccagattgccagtgagttaggctgcagtgctgaatagatcagagtgtttcactagaaagcacgcagtacaaagttgttcctgctctcttcaactcagtggccccatgactttgcataggacattttaacttacagaatcgcaatattcccttttgttcattgcaaaagctatcattgagtatcaatccatgtttactacctacttttcaaaatactggaaatacaaacatgccatccctattttgcccttaaggagccaaccatactacagagaaaacacggaagtgaacagccagttatgaacacggccccatcaccttcctagaattgtcaggtaaatgagaccataaatgggtcagcacttcctaagctctctgctgtcatattaatttcaggacatggctatgacagtcatgttactaatagggctctgcctagtaaccgtgttcatcccagaagaatacacaaaaatgtctttcatggttcgaaacttggttagaaataccaggatcctcataaaaataaatgatgcccattgccattaagtaagaatttgcaagcaattgttagaaaataagttctagagattccagagaaatgagagatcccactggaagcttcccaagtgcttcttggaagaggtgtagggcctgaatgactgacaggtcaaacctacccaggcagcaagccagagggagggcattgcctaccaaaggaacaatatttgcaaaggttgagtggctcacacctgtaatcctagcactttgggaggctgaggggggtggatcacctgaggtcaggagttcgagaccagcctgaccaacatggtgaaaccctgtctctactaaaaatacaaaaattagcttggcatggtggcgggtgcctgtaattccagctacttgggaggctgaggcaggagaatcgcttgaacccgagaggcggaggttgcggtgagccgagatcaagccattgcactccagcctgggtgacagagcgagactccatctcaaaagcaaacaaacaaacaaaaaaagaaatgtaaactgcatgtatggaaaggaaacctgagccatcaagttcatgaaggtaaacaccgaaagtgagagttgtgaaggtatttttgctcctgtccatatgatacacagttcctttttaatctgatagataatgtcattggcaaattcgctttgccaatgacatttaagcatgaaacttaacaaccatataggcttcagactacatagacataaaaagaattggaaaagttacaatgtttctactgtctacagcatgtagactgcaagtagagtatatatgtaagtgtctttgcaaggcaaataataagaaaatagtgttttatatttatatgacaaagaatctcataggttaaatacaatgttgtttcatccagagtttgtataatttttaaatgaaaagacacatagtttagaaatgtagatcaccttttcattgccaatgggttccaatagccagggcctatgctaagtcctagggataccaaagcagaagacttcagagccttgtcctcgaagagcttaatgtcaattgaagaagataggtagagaagatagtgaatcatagggcaatatatatatacatatatatacatatatatgtatatatatacacatatatacgtatatatgtgtatatatattttgagagggagtcttgctctgttgcccagactggagtgcagtggtgccatcttggctcactgcaagctccaccctccgggttcatgccattctcctgcctcagcctcctgagtagctgggactacaggcacctgccaccacgctcatagggcaatatttagtttaatctataaatatttggggcaaatgaaagtaagttcatttccagttttcttgttaattacactcatttagccaaaggaaatgttatgcatgtaaaagttctgtctatttgatgaactctctaccagtctttgctgtgaagtaactaaaatattagcctgaggacacagatttttttttagaaatttcttttgacagtgattgcctaagtgccagaaaacatagcaaaatgctagtttttgtatcaaaactgttgcgtatataatattcaggaaaaatgtaaaaggaaatatttaggacaatcgaatataatctatttctgtaagacactagctaccaaattcttacttgttagtgacagatatcatctaatttaaaacatggtctttacttccagacattgtaaatgcttctggattgcagcatagatttcatcacatgcctaaaatctcaagtgtattttcactttcgtaacctctctagacattttaatgaaaaacaaagagtggaaaagttaggtttcacagaaggtttctaaatagaaacctaattaaagaaattaataatcatcctttgatgccatgctcgtgtgcctttttccatctctaatggaatctctgcacctagaagaattgtagcttttgcttgtgctcttgactagtaacttaatgtggcgattaagacacattctttatatatttgcatatatacaaagacgtggatgtccttttaaattatacccaccttctgcctaggctaatgctatattaaattgcattgaaatgcaaaagcacctcaatataatgattttccacatcccatttacttgttgattattaatgaatgcttcctgagttgtgttcctgctattttgtctttaagactactttcagggttttcgcatcatattcaagaggccagtcagagttctgtgcttgcggcttcattaaaattctgtcctacacatcatctgactcacactttataatctatcagaacacctgtttgctttacaatggccacgaggcagctcaaaacactgtggtatttagcatttaataatgagcacaagatatgtatttttgacactttaaattttctttagaaaagtgcatggaaaagagccaagtttgaatgaattatctaaacttttgcaatttcataatgtgaattttaaccaacttttaaaaaatgtgtacgagaaagtgccttctctctttgtcagtgaaccttaccttggctaactaggaaaggctatagagggaaataactttaaaatgtcactgcataaactaatagtgatatcaaaagtattttaagaagagtctgtgcattattactttccctatttacatacccgtctcacagacacttcattgtaattctcactctgagaggaagctgagaagcttaatgtcactgttaatatctagatatgtttataatttagtgacttaagtcagtgatgggcactgcatacatatacataaacgctcttttctttaaagtttgggcatttacaaatgtgattgttaaatggccctcaatataattgtatctatttgaaatacttcaagggagggatagggagataatggatggtctcagaagggtgaaattccttcactatattatgtaaatgaagaaacgtctcctagtgcttatgaactgctatagttttcagcgctaatagaggacatactgcaagttgattattgtaatccaacagcgttatctcatcagtgagcggattaagggagctctctcagctgaggggtctgaataagcattttcatttactccctgctgggtcattgacaaatggaagtttttatctgggaacatttaaaagcataaacagtaaacaaacctatagtttcttcccttgcctggatcctttaccagatttgtgctatcttgcaaaggctgataccattcaacctagcagtcaactgacttctgttgtgtcccccaaatagagaattatatgcacctggtgatgaggggggttgatggagtcgagagagagtcagatcttccccgttcaaaagcattcagcaggggccgggcaccgtggctcatgtctgtaatcccagcacttgggaggcggaggcaggcagatcacttgaggtcaggagttcaagaccagcctggccaacatggtgaaaccccgtctctactaaaaatacaaaaattagtcggatgttacggcgcacacctgtaatcccagctatcacgaggctgaggcaggagattgtagtgagccgatatggtatcattgcactccagcctgggtgatagagcaagaccctgtctcaaaaaaaaaaaaaattaatagtttaagttcatttgtcatcctcttctatcccttgttcaaatccctgtactcagcaatgacattcactttctgtctaatgacgccatgacaggtgacaataaagctaacttcccaaacctggatttccctctatttcatccccaaatcaaaacttacctctcatttccttcctttgcattacaagagatccttcattctttgatttgaccataagattagagaaattatgttaatgactgaaagtagactaatgtcctatcattagattgaatcatatataattgtcatttttgtaagtcaaaacaattgaatgtttgtaattgtatatggcacaatctgaaatgtccagataatgtgcacaggttaaccgatgttttaacgacagtgactggagtagctaacatctgatgatcatgtgactgttcatacactcttctcaatactgcatgcatgttcctggcagtatcatttaatcatcagtcctattaacaacatgaaaactgagactgagttatcagtccggagtcacatcatgacagtgaaagtgccagatcagtactaggctagaatttttatgactttaaagatcattttcttctttgtctccaaaaaggcccaagtgttgaatggtgtgcttgattcagctggggccagtggcaggatcttttgggaggatgggggtacagaggcttcttgggccttgagaatcttatgtgtaggcagtatccataatgactgtgtttagattcagtcttggagaagagaagtcatatgacctactatggtgacttacttcttgtaagttttatgcagcgatgttcctgtagagagagcatgaagagaacaaagccttacctagtccatatcctttcctcttttagtgcaaggcttgaatccataatgtttacccctttactacagaccatagtaatttctctgttctgacatctaacactctgtaacaaacaaacaaattttcattacattttatcctgtatggttgtctcatggagtcatatgcttaaatattatcttcttatccaggttagaactttttccaagacagaaatcatcaatatcttgtctttatttcacattttctacaggatttatcccaacactgagcacataacaggtcactaaatgtgtgtcgaccggttgatcaattaaggtctttgattctaaattttacttccacatctaccattgatccctttatatagtaggaatattaagggtactaaacacaaaacaagttctttctcagacattgaattattaaactaatggcattggtgcttatgccaaaaccatgcactttaaaaaataaggattctagatctgtagtacacatttattatgtattggagccaataagtcaacagctgaaatggttatacctgtattactttcaaaagaaaggaaaaaattaaggggctcagagatcagtgtttcattttgtatacctctaactaaagcatgaaattatagttcgctaagagaaggctatggagattctgaaaaatgtaaccactttggctagatgtcaaaattgaattcattatttcttagaaatgattttagacctacaattcacaatcaaattgtgattgttttttaaacacacacaaacatctctacacacacagtcagttcggatttatattggcactccaagaaccgatgtcaaactaaattttaagtgaatgttagttgtaactctgatacatgtttacaagacaaatcatttcagatgtagcaaatgaatactttaagatgtatttgaaaataccgaaaacattctaaaactgaagaatcatgtcacaaaatgttggaaattagaaccttgattcaatactttgtaagcataggctaaatgggacctaaacatttcattgaagttaaaattagagttaatcataccagatatttaatcacccaatgccttaatgccttaaacagcccagcaaggagcagttgaggaactgtgcagttgagttttaaagtattttgatattccctgtaaccattatatgtctgcattagactaggtctcattgagcagtacacatcaagatgcctaaaatgtagatggctgtataacagcaaacaaagtggttatgaaacagcaggatctcggcaggaagtaaagagatatctcaaagagtacctaatcaaacctgacaaatggtgtaacatcttcagatgaatgactaggcctgtaacatatttttagttaatcttcctcttgcttgccagaaacaggctcattcatgttctttcagtatgagatgggagggtaaggcttttgtatgaggatcataatgcacagaaaccagtgaagatttggtccatcatgtttagaaaagatgaaagagagggctgatttggatatgggcagacttgtttaaaaatagattgttcctgataccaaaaggttgaagagacttctgcagaatagagtttatgattcgtcattccagtgctttgtctgtgaagtgtgtggcttgccttctaggtgtgtgttcttctctctactcttcatcttttctccacgtcatggcgctgcttcctccctattcctgcttcctcataattcaacttccacatggcctctactgcttgtttgacttctctcaattgggcctttcactttcagctccaatttttaacgacttaattctctcccggtaccagttcatattcccaacatattggctcagctcaactttttccatttattctttttcctttttttttttttttttggtgccaggtcatgtttaccacaaactgcctataaatcagggctcgttcctaattaattagccaaaacttgatgagatggaggtaatagatgggtcatagagccaataacatggtcatatggaactgaccattctggagagactgaggttggggttgttattgcagaggttgtcataggcaaccatatgccatgatacataggtctcagaaataaataaacaacattcaggatatttatagccagagacaaaggttgccgaaaattaactttcagtgtcttagattaagtggattatctgagatccattgcttgaaccaataaaatgcaagtatatcactactcaaatattcacatttttttccttaaggcaagattggtcaatttttagcccttctgcataccagcagagaaagatataaaatgagattcaaattttgaattagggcatatccattgactttgaacaaataggctctggcgtagctagaattagacatggtgaaaaccactaaatttacccaggaacactgcagaaacattcatcatatacaggtttattttgggcattggtgaatcaagcttgtcactgtgtctggtgggatcttggcatagccaaacacattgccatggcattttaatatgccttctgactggttacagaaatccttattatttcatgaatgagttccagaaattcagactccatgtgttttttagggagttctgggatcagcattgagaaaaatattgctgttgtgttggagcgtgaaatttatgcagaatggaatccaaatgtgacttgaccacctaaggcttagaaaggtgtaaaacttagctaatacagcactgtgttagccagttcttcccttattggagtatctctgattactgtacaaaaattacctttagaaataaaatttaattaaaagattctctctctatctttctcttaccaagaagaacactggtgcacaatattaatttatggtatcctttgagtgctgaactctatattaatcctcaatttataaagcacaattatatttttcaggttttcttaagacctttcaaatgtttctaataaatgggttaagacatattctctttcatttctcccttctctttaaaaagtgaccagttgagttgtccctgtccaatttttaaaaatatccctactctttaatgtattcaacactacttatatcatgacaagacctttttatagttaaacatgaagtgacttaaatgttctggataaattagtttgcttagaaaaagtcctatttggagatggagttacagcatttcctttgatagattcagggcatgacaatactacccttgaacaaaaatggcactttattaaatggaactcacagtcagccttatttcaatcatcaaagaagtaaaagtaacactctgatgattatgaaaaagaggttggatgagatgtgaaatgagtaatgaacccagagtgaggaggtctgttcctcattctgccttaattatctgtgtgattttggacccctcattttctttctctgggtctttttttcccatttgtgaaatgagggctatagagtattcaatcctttaggatcttttgcctgtattatttattttatatctgatgggaaatacattctttatggaattttataaagttatcatataaaaataaaaatctacttaaaaggcacatttttatagtaagatagcatagaggaaaaatgagtgaatctcaactagattcatctaagggataatgcctggatttagagagtagctggccctgggagatggtagctattaatattactactacatcctactttgtacactttacccagcaaataggcctctgccctataaaaaaaaaagcaagtgatttcacctaggcagctatgtgtgttagtattatgtgactatcctagggctgccgtaatgaattatcgtaaaccagctggcttaaaacaacaaaaattcatttttttgcagttctggaggccaaaagcaaaaaccaggggagaagaggcaatggcctcttccagcttctgaaggctgttgtcattccttggcttgtgggcccatctccctctgctccattttcctctgtgtgtctgtctcagtctccctctgcctttctcatgtaaggatacatgtgatagcatctaggtcccagccaggtaatccagggtaagttcttcctctcaagattatacctgatcagatcttttgccatttaatgtaatagccactctgttgccacaggaggtaagatttgcaggttccagggattaggaaatagacatctgtttctggaggccaccccagttagcccactacaggtgggacagcaggtaactattgagcacgtgcatcatttctgtgggcagcaccatgcagtgctggctgatggttgcacacaggaatgtgggctccgtgttgtaggatcttcccattttaaagcaaaagctagattcgattcaattcaattcaacaagctagatttcagtgagccaacgtcaaatatcaggggattttacacataaatgtgtagacacaatctggattttgtgtctacgtgtttatgtgtaaaatcccttgatatttggtgttcgctcattgaaaaaaagagtctactcatgacaaataaaactattctatgcgccacatttgctgtgagggctgcaatgtctgaaaaacagaataaaattacctttgagagagcactttgtaaccatattcattaactccacaaatatttctttagcacctaatagaataatatttattttagattgaccaggggagagcttgccgctttcagaaaatatctccccaaatgcaactctcatagtttttcttacgaagaaaagagagcattaattagtccaatatttcctttctggaaatattgcctatgtttctgtgcccttcattgagatcagctgagtttcatgatcctggaataaagttaaaatccaaattcaaagtcgtaaatgtggtctgatccttgagtatcttggagataatggtaccccaggttacctaatatctcatacttactggttattcatctcagttagcctatgattcttttataggtaaagaaagcaaggccattcacattccatatagaccataatccctattgagtcagcatctctgaattaggccagtgtgttagaatgccaagtccttcaatttcattcattattggctgataaactgtgtatttctttaatacaaagggagaaaattgttgcaggtgcccaatctgccatcaatagccatgagactttgtacaagttcataaacaccaattttctcatctgaaaaatagggataataacaatacctacttccctatattgttttgagaattaagggggttaatgcatgtgaagtgttcagaagagtgtctggcacacagtgaacacctaataagcattagctatgccaattattttcatcagtattatctttattattaccaaacatgggtaaatatctttattattctatctcctttctctatggcagcgtttctcaaaatgtaatgtgtgtaccattcacctaagtaagaatcatgctaaaatgcagattctgattccttagatctggatgaagcctaattctgctttttaacgagctcccaagtaaggctggtgctacctatgagaagattaactggctgcatgtcataatcatctagaaagctttcaaaaaaataccagaggcataaatgtaccctcctcctccagaccaattaaatcaaagtcactgatggtgggaaccccaggtcattgctattttcgaaacagttccccaagaaaatcgaacatgaggattaaacccctctcttactacataagaatttttacacgctcacaaatgatggggtaaaaagaaatgccagttctctctattacaaattaaactctcatcccacctggaagaagttagcagcataaactgtaacacatctgaagtggtgcccacggttactcttgcaagcttcttatgggaaacacaatattttggtatttcccaacctggtgctgttaacaagaatcatcccttgtttgtgtttgttaatcagcttgatgagcagtttctgtgttgatcttcccaaactgtgttggccagttgccaaatcaagtgcataaattacacactgccctctctccaagctgctcccaaccctgcagaacatcagaaagaatttcctttgaatgcgcaaatctgtgtaagccgattgcttagactgatactttgtggggttggtctgatgtgacatgatcatgtgtcacaatattatgacactgtgatgacgtattttaatgttaagaaataatattttgaccaatatccaaatgtcagtctttttgaaaggtcagattctctttatataatggtgtttcctagagaagttatttataggtcttgaggctccacgtaccaacctaagcactctattccaagaaccaaggagcaacatatggctcagctctactgagatttgttatcataaaagaatgcatgagtgtgctggtaattccttaacaaacattaaggaaaatgagatgccaataatatggaaatttcaacatggttgacttctctttatagaagacactctgggtatcgctaaagtcctattgacctgggacctataggaccaattctaatctttcttccatttctatgtgttcctgtggtgatttctcaccaggtatccatttttaaactgcgatcattttatattctcagatcaggagctctatggtaggaatcaccttagatttgaaatttctagcaggttataaccctctttgagaagtatgaggggaaaatagagaagcaagtagtgaaacctgcattcctaacgactatcttcatttgttatgtgacttggttgacactattagaaaaatgtagcttgtattatttttattactaatattattactatcattattatatactttaagacatctctatcatctcccaattaccaggacataaatctagatagcaaatgtcttttttctttatgttatgcatattcagaaatgggtctccttgtaaatggccaacccatttaacaaaagaagaaagacctgcctaacaaaggaagaaatatattcatttatatattcataaaaataagaataaaatataaagcgcccccaatatttgcatagcaatgtctagtgccttcatgaacagcaaaaagagacctctactgcaaaatccagatattaaaaatgactaaatagggaagcaaggatatttaaaactgggataatagaggtcatctctgaaaaataatcttaagatgtgaatgcatagagtcagctacctatgtcaaaaactacctatcattatctgtttaagaaatagcacacacacacacacacacacacacacacacacagaaaagaagaatgaatattctgcaacagattgctaacagtggggtaatgagaatacatggttgtctatttttttaatgtttcataagaagcctatatcactacttgtataatcgggaaacaataacaactgtggattgacttgaagtgcaatttgtttgtttttttcttttttcttgtttacgctttgtgattactttagaatcaatatatatttttataattcttattaaaaagttattttatacatgccagtatattaatacttaagaaaaatttctctggatctttactcctaggaagttagatttccttctttctaattcctattcaatggctaattggctgattgtgccttctaccatagataatgctttctccgttagtatatatttggaacctttgtatttcttgaatgaaatctcattcagtgtctgtggaaacctgctcctgagatgttcacagatcttttaagtagagacgtaagattaaggagtcttgctgaaatattcgtaggtatatttctgagggcgtatgctgtacccttatctgacccacaatacatcaaaacagcatggagttcatttggattcaaattcaatcaatccctgtctcctggcatgaagaatgaactctctggactaaagaatctttgatcaggaattccacactctctcccaacactcccttcttatccacccctactcacctatatcgccatggagggagataattcttacttataaagatggacaactgaaactttgcattaccacatagaaaaaaagacattcttggatttaactttttgatgcaaaaaggacatatctgaaatatgacgtaggccctcatgcacaggcaagctcaaggattgtgtttgctagaactaaaaattaagaaaagaacagtcccccacccaccacaaaagaaaaaaattcagcagatatttataaagtatgtgtacaggatatcaaatatttgaacaaccagaatttcatgctatgattttttttcatataattgcttgacatcctttctaatctatcattttactcctcatgtgttgcattctctggactctgtctgtatttacactgttccgtctgcctagattgccctagcccttgtcccccttagtcaacaaatgctaatactccaaagacgggagaagatgctccttgttttttcttagagcatttcttgacctcagtgtagaaatacttcttattcacctgtgatctcataatattctgtgcatacatctcttattttttcatcaaatacattatttgcacgttatgacttataaatccagaattctgtgagggtagagaccatgaatccttgtatttcaaccttagcaaacagtaggcactcaataaatgcttattggatgaaggtttaatcatccaatagagttagggggttcttgtcctgaggagaggaagacaggtagagttaaccttcaatgtactaacaaggccgagtccatcttttttctatcagagtaactgcaccaagatgtcatgtagcttttctgaagcctctagagaaattccatcctctggtgggaaaggaggggaataaaaaagtttgagctcaagtccattaaattctttttaataaggccttacaaggtattcagtattttgctttgatagctgtataaagtcagtcttctgacaaatttcatattgcctttttttaagataaattttaattattaaagtgtccagtgaaagcctgacgatttggaggctgcgaattagggagcaatgctgaatgatgcagtgtgacagtcgtgtgcaataatgggaaatgtattcatcttagataagaaaggtcattccttccagtgcccctagctcatttggaagtcaaaatggactgtgagatttcttgggctagggatgtgcaatatttggctaaatattctacctcttgctgccagatggaagagggtactggggagctagtgtggtaatgtgaacaaagcatgggtactgcattcagaatcccagctctttgccttactaagaggtgtagcttaatgtctcaatctgcgtctgggtaatttcatctttaaacttgacatataatagcacctactttagaagtttgttgggaggcttaaataaagtcatgtatataaaattcttaccatagtatctgccacatactaagtgagctgggattcaagtccctttttgtcggtctagctatataaatggagaaaattttttaactttttcaaattttatccttccaatccaccatacactgtacggtgcttagcaaagaagatatgattatgttgaagtgttcagcgttcgtagctgctcagcgactgatattattctactcatatcttaaaataatctctgttgaactcaatgaaatgaattcccataacctcttcacatccttgtctctccttgctgtgtgtttgttagaaagacagtagccccctgttggtggtcctttgtcactaagaactatctttaggctttttgaaattctatactatatattcccacgtgatttttctttcattttagtttattcgagtaagtattgtaggtgtggtagaagtagaaagattaagcaaaatagaaaatgatttctctaatagtctgctttaaatctatatctaataatggtaaagataataatcagtaagaaagccttggcttggcttctctccttttatctggagaactcttttctcttcttcatatagtattacatattgtagatcttgataattgagtgaataagtgaagtgtatttttttttcaattttataaattggaatcttaaggttgagaaaaagcaaatcagtcagcaaatggtttctgttcaattgcagcccctctttccatctgagccagactcttggtcctgcttcagaacagtgactcttaagtccctgttgtagttttcacatttataaataaaaagattgaggtgtgatctcctggagttacattaagcccttgaacattctgtaatattatgactcttcagcaatgttgctataactagaatccattgccatgcttcttggtttagtctttcctgtattgcaacttaatgtgttcactttctgcacttaggagaactttcctgtcttttgtagagtaaccagcatatatcttaagcccagaatgtctgaacacatgagtaaatacagagtgagctgagatgaagggtaaccttgaaaacagtgaagtcacgtgtatgctcacttagacagttaatggggttctgttgattggtacagaaataagtgactgggttagcttatgagggcacaaataacaaatgtaaaggtaaattttacagattctttaatatattcccttaactctcttaagttcctaaattcctcttgtgatgatagaaaacacaggcagcaaaggttttggcattcactgtaccagcatttgtgggtcctctgggaacctcataccaacgtgtttgaagctgttgagtggaatagagaagaaaggaatggctactcttccaaaattcaattcattggggtgcagtattgtaacaagttggttatatacattatctatcacaaagaaaaatagatgttccttgaccatttttgtgagaaaagtcctttgtactaagcaatatagaatgtatcccaaagcagtgctgctcaaagttaatctgcagaacaaactgctaccaatccacaataagatacatggagaaagtgagagtgtttagaaactttttagagcaatttgatataaccaggatattcatttttctattcatttttattatattttacatctgtgacagatcggattttaaaaacaaaaatcagttgttctacagataacttgagaaagactgttctagaaggaatacagttttaaaaaatgaagaataaggaataaagctagggtgggccacctaaaaattttcatgtgactatccatctgtaagtacgagtatgtttgtgcaaactgcaggcaccctttctttagttctgtgtgttaggccctgggcttaatactttccttctcttatgtcttttaatccttgagaaactatgtgctggatgttttttagacccttatatttttggccccaaagtggattttctcacaaaatggcagttatcagcagaaagccctggtttaagttttcactctcattacatcgatcccctgctgtcaaaatgggctcctgatccaggaaacaaggttcccccagatcctgtgagcacggagccatcggcccctgctcaagagtcccagtcaggtggagccctgtgcttcgctgtagagctgttcaggaaattgacaaatttacagccctgtcgctgccgtcctttcagtggggaagcgcggcttctcttccagcaagcggacttagatgtctgtttactgtttccctcaaatgtgagccctgctggtgatgcacgtcgcaaatggaagtaatatcatttgaagcagtcccgctagaagcccaggagcaatctaactgcattaactcttccgtctgagtggaggaggctgaagagggtacaggactggactgagctgaagtgaagaaaatagagcaatacacaatccttgactgcaagtagcaggggtgcctaaagaggtttcacttactgccttcaaatgaatgacaccggggtgtcacaggacatctaatattctgttgacaaatcttgctaagcattggaagtggctgaagcagtggcttcctgtatttttgaggggtttctaatgttgtattccccccttatacctctcagattctgcggattgttgtttctgtatgtacaggaatgccctgtgctggtggttctgaaatactaggccaagaactgcaggcttgctttattgttttcagaaactgcagtctactatttctttttctaatgagcatactatcattttattttatttcactgttttctattttcccagctttactaagttataattaactaattaaaattgtatctatttgcaatgtatagctgtgttttgatatgcatacattgtggaatgattaaatcagacagtctgacacgtccatcacttcacacttatctttttttttttgcaacatttaagatactctctcagtaattttcaaatatactatgctttttgttaactacagttaccgtgctgtacaatatatttccagaacttattcatcctctctaactgaaactttgtaccctttgactagtatctccccattcccaccctgcacctctcacccacccctttctcctctctaagttcaatgttttcagattccacgtgtaagtgagatcatgtggcatttgtctttctgtgcctggcttatttcacttattaataaataaactaagattcaaagctgttggggttttgtagctttcttgtaataaataatagccaattagttatcctgcaatgggcgttaggactcagacatttctctgtccatacttgaactcctataaaccttattacccagcacgttgtcttttcacagcctgatttatgctgtggatttgattgtttcctaggtatagtggaaaaagagcatctcttaataccattcatttattcagtgcatctttacttagaattttcttcaaacacggatattaagctgccctaagtggtctgtgtggcctcatctttaatctcatggccacaccatgaggctcctgttaataccctccccattttcaggtgaggaaactgaatattagaaaaggcaaataaattgcctgacgtcttaggatcatgaaagttgttctttgtctcattaagacatttaaggtggtgttagacaagatatacaaaaagtttagttacaagtcattagaatttatatatacaactctctgtcatgcatgctctctctctctctctctctttttatatatatatgtatataaaattagcccgttttcaagttgctaataaagacatacccgagactgggtattttatacaggaaagaggtttaatggacttacagttccatgtggctggggaggcctcacagtcatggtggaaggcaaggaggagcaagtcacgtcttacgtggatggcagcaggcaaagagagagtttgtgcaggggaactcccgtttttaaaaccatcagatctcatgagacttattcactatcacaagaacatcaggggaaagacctgcccccataattcaattacctcctaccaagttcttcccacagcctgtgggaattcaagatgagatttgggtggtgacacagccaaaccgtatctcctatatgtgtatatatacatatctatatatgtatatatacacacacatatatacacacacccatatatacacacatatgtgtatatatacacatatatatacacatatacacatatatatttgtgtgtatgtgtgtgtgtgtgtatatatatatatatatatgctatcctgtaaactgtataatctaatctagatgatgtgatgaaagcaagacatgggactatagtccccaactttcacaaaatatttatccagtagaaacatagaatatgtatccaaaatatgaatgtgaaaactagaatgtgatatgagatgaactttcagatcttcctcctaaatcaaaattacaatgacctgatttggatgattcaggagtgctttgaaggagatagtatattagtagaaacttgaaagaccctcaccgttagagataggaaggtaaaagattccaggagaaatcacaggaaagcagaaaaattgaaatagtgaaagatagtatggcttgggtaaaaatgtttatgaaagggtttagtaagagttaaagcaaaacagtggattcgggtgaggaaatggataacccgaaaaacaagccaatgaacttggtaagaatgaagtttctgaacttggaggtaccatgttcatagtggttttggaaagttttatttgtacaggcttgagtacaatgggttatggcagaagcttgggagaggcaaagcatgcagagaaattggccaggtggttgtttttctttgtttgtttgtttgtttgttgtttttttgagacagagtctcagcctgtctccgagcctggagcacatggagcgccatggtgcaatcatggctcaccgtagccttgacctactgagctcaaataagtgatcttcacaccttagcctcccaagtagttgggactacaggcatgcatcaccacgcttggctaactttttttttattgtttatagaaatggggtctagttatgttgcccaggctgatctcaaattcctgagctgaagaaatcctaccacttcagcctcccaaagtgctgggattacaggagtgagccatcatgcctggttggctgttcttatatagttgttaagtaacatagcatggcaggggatgcaacagaaatggaaaggaagatctagatgtgtgatatatgaaggagtggaatcaataaaaattgacagcatggtattggagtccaacatactggttcttaactagtgttcaaactcctgtcacttgttagacttgtggtttgtagacaagctattgaacctctcagaggcttgaagaagcaacaagcttgaggtttaggccttgctgagtcactgagtgtgtgtccataaggaaggacacatctgaagcatgaaagagtgatcaggtgaggataagagctgaataactaaagatgcgaccctgccagtggtgtccaaatgtgttgataaaacccaaaacagttacttaccaagtgtcaaatgaggattacattgatgtctcatagatgtaagatctcagaggctaagaatactcataagggactgtgggtagtcctcagctgggtagaggaaaaaataaaataggcgttctaagggaggatgccaatgtgagtcaggcttggagacaagaatgctccctttgcatttcaaagagcgtgaaaaccactttaatggactgcaaaaacataagactccaaaagaaggctggggccctgtgcaaattgcctttggatttgcagatttagcaaataaaaatacaggagagccagttaaatttgaatttcagataaacaacaagtaatcttttttagcataagtatgcactgagcaaaattatcaattgtttatccaaaatccaaatttaactgggtgtcctatattttatctggcaactcgatgtggagtgccacaggaaagcatttggactttattcagcgagaaccatttgagtggtatctgagcaatggagtgacaagataaaataattcttaggataattaatttggtgtgcgggatagaggagacgagacctcgaatggagaggacagctgtgatggcgtagggataacacggtgagagctgatgagaactcccctttcttctattatcgtctgtcaacgtggatttccattctgtcctgtcactccagttgtccctcattcctgatgtcacctacatctcctgcagaatacatgatgacctgcacttcttgaggttaaaatttctccttaacatgattccttctttcttttgtttttctatctttgtcagttggcagcatgttgttaacacagtagttctaggttaagtaaaatcatcatttctcagagataaaaatagttgtctattttcttttcaaacccagttgtaaaacttgtgtgagtccaagttgggataacttttcagtctccttttctgcttgtacctctcaatgcatctcttcagaagattccagtaagatgtccacagggtacacaacataagttattgaccatttggggttggggggtatctgcttatacgacactctagccacactgtaacagaggtaggaggttagagatactcaagctcccctttgtcccttttctgcgcctcaaaggggtgacataaatacaagggttgagggaaatgggaccttagagacaaggagaagtctagcagagatgactgtggtgatgctgcttacaggaaacccaggccctgcttgaagaaaagccaaagtcataggtgagaaaacagtggcaaggagaagacacaaaacatgcagacattcactgaagactaagattaagccatgattttaatacgtcctctccaaaattcatggtgaaactttattctcattgtgcacgcatttagggagtgattcagacacgatgactacaccatcataaatggcttagtgctttataaaagggctgggggaaactagctttggccctttggcccttccacattctgccatgtaaagacacaatgttcatctcctctggaggatgcagcatcaagatgtcattccctcaccaaaaactgaacttgccagtatcttgaacttggacttcccagccaccagaactatgagaaataagtttctattctttataaattacttagtctcaggtattttgttagagtagcataaatggactaagacaagccataagaattagagctcacaaatcaaaggcaagaaatcagagtggttcataaactcaacctgcttatggttgtgcagggcacttgggtcaagggagcaagaggcactgaaatctagcttaggatccctttgccaagcagtctacatggttgcatccagtaaaaagggacagctttatcttattagtgtgaagatactctataggctagtggtgggattacaccatgcagagtgtgaatcctggcaagtagttgaaccgtatgatctgatacttgatcatcctgaacctgagtctcttcacctgtaaatagtctaataataatacccacctaggctcattctgagggttaacaagattgataagctataatatacaaaatttttatcataatgactggcatgtggctacaaataaataataaccgctaccaggaaaactctaaaaaaaaagacccaaagggtgtactaagctatttagaagtcaagtaaaatgccttgaaggcagatttaactttataaagataatgatcagcaaacttattctataaagggccagatagtaaatatgtaaggctttgtgagccataatctctcttctctatcccatatacttaaaaaaaaaaataaccctttaaaagtagaaaaatcatgcttagctggtgggcaataaaaaaaacaggctgcagactagatttggatcatgtactatagttttctcactcctagaactcaaagagaatagtagtctatgagttcagaaatttgggatacctatgattttagcatggagccaggcaacaaacaggtagaactcattacttgcttgccctaaggcctcagacttacggttgatgagagactatttgtctagttcaagattagatgtccaggtcaggtacagtggctcatgcctatattcccagcactttgggagaccgaggcaggcaggatcacctgaggtcaggagtttgagaccagcctggccaacatggtgaagccctgtctctactaaaaatataaaaacaaaattagccaggtaatggtggcgggtgcctgtaatcccagctacttgggaggctgaggcaggagaatcgcttgaacccgggaggtggaggttgcagtgagccaagatcacgccactgcacttcagcctgggtgacaagggcaagactccatctcaaaaaaaaagattagacgtcccatcccagtacaaagtttagcatgctgtacaagcacaataaatgatttcgagggaatggattgaaatgtttcaaagtttgttgaggatgggtatggtggatcatgcctgtaatcatagcactttgggaggccgaggtgggaggatcacttgagtacaggagtttgagaccagcctgggcaatatagtgagacccccatctctaccaaaaaaaaaaaaaaaaaagccagttggttttttcagctagattttttcatctgcaaagctaagagaacaatggtgtcaggaataaataaattactatataaagtgtatttattataatgctggtcacgtagtgacaataatctcatcctcatcatgtttcagtgtcttctttgtgaatatgtgcttaggaatcatttcaaattattgtgtaaactcttatcacttggtataaaaggagaaactaaaagttttaaggataggctgactaaaagcagagaaacaagaacctagtctatcaggaagagtacagttatctcagaatgatgatcatttgttcttttgttctcaaaacaagaccttcaacaaaagtcatggctttctacctctgatgctgactgtgaacgaatctgagcctttactaactctcatgacctttgtcttcttccatcttcccaggtatgaggcaaagattaaagccatagacgctccttggggaaaggtgctgttataacccacgtgggtatcattagcttgaaatgtagaaggatgaagattttgaatgaaatagagactttattaaggagtaggatgcctgtagataccagccaattcatgctgtaaggtatttcttcaatacacttcttgtagaaaagtaagtggtggttacaaagccatgatattcaacttagctgtcaaacaagcagtcagcttacaccttaagggaggaaggaaactgtttgaaatgttgcagaatgtgggacactgtaggataatgaggagtttctaatcaggagacagtacttatatccaaaacttgttagcctatgccttgcctcatcggcaaaatgggacaattggacctaacagagtgtgtgccagagggtttttatgaattgcttccaggtgaatatccatgaatctgatgatacttgaagacactgactctcataaataaatgaaagccaaatttgaaaacacatgtgtagttggaaaggcgatttcaaataatcgagacatacttatcctctatttttgaaatgaggttcagaattcagctggaattacaaggctcatcaaacactttgaacttgatacagtttaaataggctcatctgagcaaagtacagaacagccttcatttcccaggttctgtcagtcagcctgctggattgactggtgatgtcttgattgggtatgattccccttgactcatttctctgttgctggtaattaaaagctgtctagttttgttctcatttaacaataagtgaaagggtaatgtctgccagacttttccattcacttggtgtttgtaacagttgagagccttggagcaccatgaattctaagctgaaggtaactatcagtacagatagtgtattggtgttttgcacctgggagctgactataaacctcaaagccaatcggaaaacagtccccagggtaaatggataaattgtcatagatgaccttctcctctcattccagctttgaaaaacagaactttctgtgagtaggtagaataagctgtctgtcatttgcagtttccagcagtctctgagactagtgcatgtgcctaattttacactggaaggagaaaccatgtcgaaacgcagaaggcaaaataagagttaggctctctctaggctcagtatgtttagttctggttcttaaacctttcccatcattatggttttaatcattccgatcagcattattataatcacaaaatgtcagcctaagaaaacgataatctcatcgtcattatgtttcaatgtcacctttgtcaacttgtgcttagctatcatttcaaattactgtatcaatgctgcaattagatataatttgtgatatgaccagcattcacaggtgagtagtttaaaaaaaaagtctcacaccaactgaaatactttattattataggtctattctttcagaaccaagtatgtttaatgtgtgctttcatttgagaaatatttcaaatcaaaatgttacattttaagaatacatgacttaatatttatgacttgaatattataactgtgtgaatttgaagcactgaaatctcccattctctataaattttattattaagatggcatatggaggttttttcaggattgtcctcatgcatgcaattaatgaaattcaaatgtcttttttttaaccagtaaaagtgcttattgaaattgaccattctgtaatgacttctactctttcattgcacagaagcataggtttaaaatattttccattctgttaagttttcttttaaaccaagataagattaaggtataagaaaggaagagaagtgatgatttggagaaaggtttcctaccttctcttacgggaagatgagacctaggtttaaaaagtaggactggttgatcaagcataaaagtgatttatgaaatatgacatctctgtaacattgagaaaaaaatgttttccttcattgagtgctttcttccatatgcaaaatattgacacatccctattatatcaaacaaaagccttcattcagagagataattttatagagcggctggtatcatgtgatcttattaatatttatgaaatatgataataatatggaaaagggggaactggaatacagccctatctttctagaccctattcatttcagcttcaaaatgttttttcatttcacacatcagacgctaattagcaaatatctaattagtgttagaagattaatcgctcatgggagttgttgaggctttgagctttcatgcatgcaaaaacagtgccactttaggtgcatttgttaaggtacagtaactttaagtgatacaacttttatttttcttcgaaaaatatttaaattacatcgttggagtaaatttaggctcaagcaacaaggaagcaaggaacacacaattgaaaaataaaaatgacactgtggagagccacatattcagtcaaatctccaagtgtcaggcaagggtctactctgttttaggcactgtgggaaactatcacaaatttagagaatcatcaagtacagctcctgatttgcagacacttagggaattaccataggggatcaaaatccaaggactccaggccaaattcagccagacatgtgtgtgtttttgtacagctgtaaactaagaataggttttacatttttaaatcattggacaagaaaatgaacaaagaatgatatttcatgacacgtgaaaattaaattcaaatttcagtgtccataaaaaaaattgtgttggcatatagccatgctcattcgtttatgtactgtctgtggctggtttcacaccaaaacagggcgagttgagcagttgcgacagagaccatatggaccacaaagtctaaaatatttattctctggccctttaaaggaaaaatttgccaccccaaaattaaagataaatatctagatgatagagcagagcagctttgggagtcaggtagagccatatcagttccgtagtttgttacctgtgtgactttggcaggtgatttaaaatttctaagcttctatttatagtgtagcaattatgaatctcttcatagatctatagaaactgaggatttaaagagttgaatgggattacttacacaaagtacctcatctgttttctgacttatagtagataaagagtaaaagtcactgccttggcccccatagtttccaagatacaacataaagttaggtttctttatgaattctccctctcaccttccttagaaaggttcctaaatggaagggcaagtggcccagaagtgggaacggtactatttttcacctgtttcatgaataagatggaaaggggataggtactaaactaaaatgatctcactagagatttgtgcttctaatattataggactttgtccccatcttgtccccaaatgcccttaagcatcaatcccttcttctaataaaacctgaagaaagtagctagcaaaaatgtattgttaatgcaagtttcaatgatgttgttcttattttttcactcgtaaaaatctctgttcattccaaattcctatttacaattcatagctgtcagatctttcatttaagtacacacatattaaatttattgactatatcctgcagagttaatgatgggtaactcattaaatgccacggggagtctgtagtttataagtaaaaaagaaaattttagagggtgaggtgttttttgagagagaggtttggagtaaattaaaaactttaaaaattattctacaagctgaaaaatctctgtttcaaagcagcaggaattttaatcaacacacacacacataaagagagatagccgtctcacttcagtgttgtaaatagtaggactggcttctagaatcaatatatctgcactgaaatttggtcataattcaaattgctttaagtgttctttggagacaagaccaaaaactactgaaggggtttaaagtgaggtttaaaccaaagatattacagcctccaatgtatctctgatacctccaaggagcattaattcatttcctctgaaacaatgtgcattaggaaaatattttgaaattatactgattttacatgacagatacataaggcaataatttgagaaataaaatcacaatcatagaaagcatataatcatattcctgaaatataaatagcaattgctttaggggattgttagagttggggcagaacaagaaaagctagtgtcctgaaagtttaatcaatggtcattgactaaatggtcatgccgccattttagtcaacggtcactctgtgtactcaacatgcctactcagtctggaagtatcctgggcagtgggcaagttgtattcagagaagggccagacatggggaatgaccttgaatcagatggaaggatttgccaccaattgcataaggtaagccagaagcccttgaggtctctcaccaggaggttttccctccaccttccaaaagccagaagagaaggaagaaagaaagtgattataacaaaaaatgccataagtcagtcactaagaaggcgctttgtattgaagagaaggatggtttaacacatacctttcaagagcttctcttgaaaacaagtgaacttcatgaagatttataaacatggtctgcccctaggagctcaccatcaggtctttccttggcatgtatgtatctgtacatcatgtgaataagaatcaccatgaatgggggtgttatcaaaagatacagataactagattgtctccctgtcttcctccttctgaatccatgaagggtcaagcccaggaatccaaatgttagtgaacctctcaagtgattcgtatctacctttaaatgtgagaaaaatatccctgggtcattgccaaatatgaaaaacagtcagttgcatagcttttgtattgtcattactggttccttcatacataaaggcatctctcatgaagtttttgttgtttttcccccaaacaagaactttacctttgccaaccattgtattttctggttttttttctgtcaactacaaaggatttctacactagaaattcggaagattttataaaaccaataatgagttaggagtcagccacacaagatggcctgaataactggacgtcacagttatttcttgctttggaccaaaccaccccaaaacttaggagcttgtgagtcaactgagcaattcttctgctggactcccctgggatacgtcacatgactatatttgtctccaagcttcagtggagcctggttggttctcaacgtgtaatcacttgaccagcacaatcagtatcacctaggaaattgttagaaatgcaagttctcaggtgccatcccaggactactgattttaaaactttagaggtggagcccaggaatctgctctaagctggcttccaggtgattccaatgctcactcaagcttaagcacttccgtttagagagcatcggagggggtggtactcttatcatcctgcaagctaggctgagcttcctcaaacggtggtaccacattccattgggctgaaaacagatgttgagatgcctcttgagacctaggcccagaagttgtcctgtgtcatctgtgacaccttctattggtcaaagcaaatcacaaggacagttttaattcaaggggaagtaaaatagactctttcctcttgagaggagtggtgaagtcacacagccaaggtgcctggatatagggatgggaataattgttctggccaccttggtaaacaaccttccatactgagtaataatataatagacttaatgctttattctcaccaagattccccaatattttcctaaaggatttttctcttctttgcaaaaacaatgcctattttatccgttttatagagcaactgcaacaaagtaacacaaactgggtgtcttaaaacagtagaaatttattttcacatagttctggaaggctggaagtccaaaatcaaggggtcagtttgaccatgtgccctttgaaatctgtaagagagaattcttccttgcccctttctagcttacggtgatttgctagcaattcttggtgtttttctggcttgcagtcgcagcattccaagctgtagctcttgtgtcacacagagttccccttgtgtatctctgtgtgacattctcttcctgtgtcttaacatcatcttcctataaggacataagtcatgttggataaacatggctatgtttactaatccactatgaccttgtcttattgaactaactgcatctgcaatgaacctatttccaaataagatcactttctgtggtactggggtccaggacttcaagatcttttgggagacacaatttgatccatagcatctacctggatttgagtcatatggctgactgtattttatcatatctgaaatcaagaagtaactgtactgggaggaggggcggattctaagacctctactcacctctgaagtcaccgcttggttgtgtatggttgaccctcttgtgtgaatagatatataaatgtttgatggtttagtaatcttctggacatggggccctggagagaattatcagcacagaatgtgatacttacgtgggctatgatggaaaagccacagaggatggtatcttcctgagctctgcattttaaagtatcctattacatagcatgaaaatcacgcggtgccatttagcataataataccaggggcacacttaaaatatcatgttatagcttggaaacattgagagctacaatgggatttcaattgtgtaaagggatgtttttacatcatcttccctggaatttatcaggggcacttttattctattatatctctagtgtaatgagactcatgctttttgaatgtttagaccctgcctatatatgtagagtttttgtctagctatatttatatattgattcattaattcatctacttattattcatttattcatccattcatcattcacgctttcattcaacaaatgtgtactgggtgcccctcctgggagacagacactagggagtcagaaataataaaactaattccttccctcatggagctgatattctaaggagagatacacaattttaaaataacgaaaagcaaaaatacactttcaggcaataaaatgtactatgaagtaatatgtgtgtaattggggaatagaattaacatttgtttgaataactctaggcatcatgtgaaggtatattctgtaagggcttgttttttttaatatagcagcgtccaaatacatagttcactgtccctgagaatggcatggttactgctcagtgacccttttcaagtcattgaaaatattttctatttgctgctgatctatttcaataattgagcttgttgggacagctgttatgctatgtaaagagcggagattttggctcctgagaaccctgggtttgaactgaggattggtggtttggttatttattctctctgagcttggcaaatgtccctactaaatgaacataatactgccttgttcttaggttgtcctaaagcttacacgaggtgacatatgtaacactaccaaccacaacctccatagataactgcttaacacatatttgtacacagttttctctgtaatttcattcaagcaatttgggctttttggtggtcttctaaaatggccacttttaaaaatagtctatgaaaacagatcagtcaaagatcctcttctctataatgatattactcaggcacctgcacacaatgaaagtccaacattaaagggcagaatcttgctagataaacatgttttttaaaagatttaattgtcacggctcccaaataaaataatcgtggttaatttttacatcttcaaacacgtatgtatggctttctgatagtgcattatacatcaaatacaataaaaaaggcattaacaaaaaccacttacactaaaatctgatttatgctttcacataagatacatggttttatgcttttatgggtacatccaaagtttgtgaacttttacaaagccctatttaaatactctgctctaagactgcattttatcttcctaatttgggcataataatcttaattatatctactgcacaggctgttggacaaggttccttttcgtgccctccatgagtaaatttgaccatacgtacagacttgacaggccatacatacaaatgatagcaataatattggtaaggaacaaacttggcagcatcgtatagaatgcatttcaaagtttagtaataatgatttgcaaataataacatagttctttagaaaaaagttattgacacttatcacatatgaagcagctcattcaatgttcagaacactcattcgagtcagaaaatattattgtcattttatagatggagtacatgagacccagagaaattaaataacttctccaaattcataggctagaaagtggtgaagcagaggtttgaactcattattcttcctccagagtttatacacttagctgccatgctgcgtggaccacctaatggagaacacatccgggccaagttattcatctcaattgttgtggggctacacatagcatgtcttctttttttgtttgtttttaatgatcataagcaaatgcctgactttcaaattattcctatattgaatgagtcattgtctactggaattgtctcccataaatggcatgatctccctaggaaccttagactgtgaactttatgctgctgagctttcaatcctagacctgaaaggaaatctttaatcaagaaatggagtctggtgcctcagtgagctcagacctcccctcgatgactaacgctaagtctttgctcactgctgaactgaacattaaagtgacagaaggttgcacagaaggtaaatattctttgcgatgtaaacctaaattaggaaagagagggtaggattgatcgtgaatgggtgcctgcatttgatagtctcatgatttaggtgtcctacggagagagggttggcagcgactccagttaaaaaggggaggggatgctccgcaaggcagaaataatgacaaccaagcatcagatattccatgggctcttggctttcttccatgctcaaaagactaaactaacctctcggtcaacttcaatgtgctaatttacaacttaacactcttaggccatatttctgtccctttccccataattgacacctcaatcattatgctggcctcctctcctgggcactctcagtatacagactctgcttatctcaccttcaaagtggcagtcccattgcctgcaatgatacattcctaacatgtcagcccaaagcacagagttattccagtgcgacttaaacttgaagtccactttttttgatagaccagcatctgtctggaagtggaatcttattattattattattttgagacagaatttcagtcttgttgtccaggctggagtgtaatggcttgatctcggctcactgcaacctccacctaccaggttcaagcgattctgttgcctcagcctcgcgagtagctcggattacaggcacgtgccaccacgcctggctaatttttgtatgtttagtacatgttggccaggctggtctcgaacacctgacctcagatgatccacccgcctcagcaccccaaagtgctgggattacaggtgtgagccaccgtgcccggccttggcggtggaatgtgaatacaggtatttgctctgcaggatccattaagagcagcggcacatgaagggcaaagagtggttttggcattacaaatgcttctcaaccacacttttgtttttcgaaatattttgaaatgtttatcttaaatttatttctttttaatcataatggagattcatgccaaaatacagaaactattttgtctataaatgtggaatcctataatagacagtggagctacccggggactttagagtttgcacagtttaactttctctttacagatgtagaaacggaggctcaaagaggtcttatgcctggtccaaggtcacatggctagctgagtatagcctcataatagtccctaagaactgaagatgtcaaaatatgcaatgagctcgttttctctttgcacatttaattacttctatttttctgttttatcacatgtccaacatattcttcaacccttcaatttaagggacaaagggaaaggtggagacaaggataggaataagaacacattggcatctattaagatcatttacaccaaatcagaaacataaatataatccatcagggcactttctcgtagcaaatcaaggagttttcccttaagtaattataaaacaggttaaaggaataagaactctggtcattcatcgattcttgatttttattcccagacttatcattccccaggatgagaggtttgagagaatagatacatttgtaaaatgactagaataattttacccacctcagggattcagtgagtgtttaataccataaaggactttgagatagtcagatgaaaggtgctttagaaggcagacatgattactggattagaatttcagagagtgagaaaggactcttttgtgttgacagacttttttcttattctttttgcagttctatagtggtttaaaattttttctcctaccaatttcttcaatttcagatcatgtccttgacttggtactgctctcgtgagaaggaatgtgtggttggtgtaaactgtctagctccctgtacattttttttctaataagcattttagcatctttgaattcacaaagctaattttcctcattttccacagtggcaatgtttgtaaagcacaatgaaatcacctggggacagtgttctttaaggcagtatttattacaggtcacagacacacacacacacgcacacatacacttccctgtattgaattgtttggagaccacaccaattttgtttcattctacaagggtttccataatatcattaatctctctcagctcttcaagatggcctcttaccatattctgtcaaaaaacaagatatagaccatttactttaaatacctaaaaataaaaatgctgaatcaaatggttacacatacacacacacatgcacagacacacagagctctctaatgtatttttcagttgttggaaatctgtgtgcattgggtggggggagcaatggaacttgcagtttattgagagtgaaatgttctattgcattagttgtaaaatgttctttgctattaaaataagtagtgctaattaataatcctgcagaattgtagagcagcctttgaactacaagaatagattcttaatccttagtatcaatagcagaattctccttctcctttctctctccgtccttcctctcctgcctctcttccttctttctagaagtatctatcgcaaaaatactgtgctaggaactgtgtttgtggtggtatatcagctcagccaatcgtagcagagcaatcttatggacctcacccaggaatgaatttcaacatatctttggtgtgaaaagactgaggataacaccaaccccgaatctataagctttgttttattttatgtgaaaggcctttttttccctcttggtcactcctgtactgtatctagtacacttgaactttataaggctaatgaaaatatctgtgtcctaaaaataaaatgtactggctccaaaatgaaaataaaattacaaaatccaagttaattaagtttgattaaatatctactgaataacaaaactaacatgatatcagctagtcaactgctatccaagtcagctgttatgcagttatatataaatcagatatttatacatcttgtaactattagatttctgttttggcctaatatggaggagtggggttttttcaaaaagaagcagcctaaaaacaatgaggacctaaagtgtccctcttcagatgcttttgttttcaaacaacatctcaataatggcaatggagatttgatgtatctgtaccatagatttaaaaaaagaactctacctgttaccaccatggggatggaggttattttatcatacacagtaactttgtgatgtgttagctgttttttgttttttttttatagtgtgaatacatttccttctgctttttctatcaactaaaacgttgctgtgagctgactttcgttccattatacttctatgcattcatggattcctcctttaaaactattgccaggtgttagcatcttccctgagtaatttcaggcatttcctttgaatgaaaatggctcacttggaaggttgtgaaaggcataaccatgtggaattgagaggattttgtgctgcgatgtggtgagaaggcttgccagaaattgcctgtttcaggctgatgatgcaaaactagacatctgttaaattaacatctacctaacgttttgccttcagtcaaatgcattttttaaaaaattaaatctctcccactctcttcactttcttttttttccactgtcaaaacaatctgtcacaagatatttaatttctgtgtaatgggttacttaaagaaaccagcatatggtgcagtgaatatacctagctacaagctagaggcaaatgtacgttctgctggttcgctgtactactgaagcatattgtgcccagcatagatgttattatggtgctggattccctgagcgctgatttacattagtgccagtttctcacaactcttgccttttaggatcaaaatattagtataaatattcttgttccaccaaggagtcagaaatcactttcgactttggttaagtggtgggcgtttatggctctaacatttcagggagggagaaagaggaatctcattatgcagacatcttcgcacacccctcctgcatccaagaatttgctaatagcagtcagctgatctgtggcctggcagtatgttctagaggagtggaatctttcacacacttacactgacaacaccccggacaccgcgtgcatccctgcaggctagagtactttctacacaattacctttttttttgttgttgttagtgtgtgtgtgtgtgtgtgtgtgtgtgtgtgtgtgtgtgtgtgtgtgtgtgatggagtgttgctctgttacccaggctggaatgcagtggtgtgatcttggctcagtgcaacctccacctcctgggttcaagcagttcttctgcctcagcctccaagtagctgggactacaggcatgagcttccacgcttggctaattttcgcattttcagtagagacggggtatcaccatattggccatgctggtcttgaactcttgaccttaggcaatccacctgccttggcctcccaaagtgctgggattacaggcgtgagccaccatgcccagccataaccttctcatatagtggagttgtcttattgataggggaggagattctaaagtccctgtcattatggtgatgagagattaaatataatcaaaattacttatgaaaatcccttgagccatccatgaagtatgtgtacctccttgtttagtaatgcatgtgtatttatatatggtaaagtgtaaagtgcttattacgtcagaaaatagtgttgactatgtgtcaggcccttttctaggccctgagaatgaagcggtgaacaagaaatacaagattgctgttgtcagtgcactcactttcccatggaaagagacccagtaaatgcatgagcagtaagcaacctgaaagcaaaacataaggctatagattctttatccatctgcccgctcatctatctatctatccattcatccatctatacatctgtcaacagtaaaccataaagaagtacatagtaactgtatgtctttgacactaaactcatgagcaaatccataacaaaatagaagtgtataggttattttatttctccataacacttaaccaatctctctatatggatatatacacacacatacatacatacacacacacatacacgcacacacacaaaaataaacccataaaatataagttttgaattatttaatctatctatgtattcatttgtttatttttgccaaaagcctggcatcaattttgtgtaagttggacaaacttactccattgtgtgcctttgaggggcacagtgttcatatgttaattcatttctatgtaatttgaaaggttcccagattgctccttattgggacagctaaaggcaatctctgcagtacttgaatcatgaagtctcccaagttggtgttgacttctaggctactggtgagggaacaggggaatgtgggtgaactccttcaagccaggcagtcacagaagttaacagctccttggcaattgttctcaaatagttcattccctgaacagctaggttgtgggttttctggggagaaaaagcataatacctgcaataaatcacttaagtctattacttattaatcgaaattctcaagtgtcctgaaaagtatctctaggccattgtcattgcaaagctatcacaaatgaatgagctaggcaaggcggcaaaattcttggtccacttgtaccaaatagcctgaaatagctgtgttattaatcagaactccataaaatcctaaagttcaagctgcataaatatactcaggtgcacgttaggcagagtcaagtgggtgctgtagtcctttttcagtacatcagaaaacttcacttgtcatcatttgttttttatttagtattaattttgagaacgataattctttcccatgatttttaccttgattctctggagccactaatattcatctaatatttttgaaacgcttcttaggaagccaccatatttagtcaaggctgaatgccactgagattactaagaacaaaagatgagctcccatccttccccccaacccgccgcccacaaaaaagggattatgttagcattgtgcagacacctattgacattgtagcctggtaatgctaattaccactggaggcaatgcccatcagcactggaggagtttgctgctttgggcatggaagatgattggcttgtctgcaaagcctggatcataggaggtattccataaaggtgtgttgcgtatatgactgagatttcttctctttctgtctctagggacataaaaagtaatagataactagaggagttacattcttaaacatcctaatggcattgcccctcatggttgcatgaactttcttcatttgacaaatacttagtaaacacctactagctgccagacactatgataggtgctgatgtgcaatggtaagttaataatgaatgaatgaatgaatgaatgaatgaataagtgagacatagttcttgtccccagaacagaattattgtctagtagagaagcaagacattaatcaaataggcaaccaataaagacataattacaagctggggaaaatgctttgatagacagacatggttctagaggacacacagcaaaggaaactgatgaagcttgatgggatcagagaagatttctctaaggaaacgagtcatgtgctgaaactaaaggatgaagaatagtgaactatgtgaggagcagggaagaccattccggacacataaagacatgagcactggctcaatggtgacagggagcctacagttcccaagagttgacagcaggtcagtgtgtcaggaacagagggctgggaggagggtagtataaatggggctggaggggcagcaggacctaaacttttgatagtactgtgtcagtaaatagcgctgatttatcaaaggccaactatgaatgtataaacaggtgtcaaagagcaggacagcataggaagtcatctactctcacatagcgtccagatctgtgcctagctctgggctgggtaatgagacaaggagatgggaactcagagctttgtattcattacaaactagagtggtggataatgaaagctttaagaaatgttaagggaatcatggacgtcatatgtgatgaagaaaagattgggggcgggggttggaaagggctttcaggatcagcatgccttctgcacagctgaatggtgcctggctaatttccctttctaatgagaccagcacaaaatccatccatttagactattcagcttttaggtaaatggaccaagctgttggggtagaggggaaagaggggttgacattgatggatggagttaaataccagagtcccctccttcacacagacttttctaaagcagtattgtgatagaaagacctagaagatcccaggtgggccaggcaggctggacagagcccagtgtctccctgagaaggggaggaggagggcgagatgggggtcttctgtcagcatggaagggtcctcttcaggtctcacaacataatggcacatggcgaggagtttctcaaacagggcttgattctcatgggaagtgtctggggatcattctataggctttcccctggcacaatttaattttttgtccagaattcccaccacagcaatatccattttctcacttattttgcagtaccgccctccaattttatggacaacaaattgtgatttatctagactctaaaataggagtgaccttgttctggaccagagcaatggttaaattgaagtaaggaaggttaccatgccttggtgcaatagctagctgcattatactctaaatagaaaagatgataacccagccagactccttggaaagacttgagcatatgtgtttttaaaaggagtgatgattattttcattcattttctgacacttgttctgatcagatgcttagattctgtgacctcacgatacagtgttcatcatttaaaggagtccaatggcaaaggagattgtgggttatagtcctgctttgagggtagatggagcagtgacaggtacattcagagctgtggatacttagctgtggagaaaagacacttccaatggccaccattctaagcgacttttatggttaattctcataacaacctcagggcatgtgtactgctattttttgcactttgcaggtgaggatactgaggcacagaaaggtgaagtaagttggccatggtcactaagctggtacacagaggggctggaattcagacccaaccagtttgaccccagggcctgtattcctaaccactatcagtgtgaccaagaagtggattgggccaagagggtggcaaagataagaaactcaagagcagctgtttactttcaaaggagcttctctctctctctgctcctcctcctcctcctcctcctccaacctgttccaattgctcagagtagacagatgcttggggggagtgtgagtaggaaagcaaagaaaatccttataaattaattttttttcaatagtcaggattaaaaacacacatttcccatcactcatctctctggaaagcaatggtaccaattgaagtaaacactttcctttctgccgcagcacacagtcatgcgcgtgcacgcacacacacacatgcatacacacatgcacacacaaacacacacacttgtttccattggctcttggaaaagcatttgcagctctgtctactttctcagatctacctaatttggggctggctacgacaaccaaacacatgagctgctttctgggagatctcagcagtttggccttaaaaatagttttgacgaatgaattttaaaaagccctctgagaaatactgaccaactgcacctttgtgtttaacatttgaagcttactatggtaatttttcccttttctttttgctcatttatatgtttcaaaaattcatattcaatattatatttaactcaaacttggttggataccctactgtccgttaaaccctggaaaaacatctcacttgtaagttattgtcttctcctcactgtacggctttttgtacaacataagaagtcattttccacctcatatttggagatttggccttccattcatggagggattgctggtatggaagtcgctagcttgtgtcacctgtaggaacgaggggaaaagaatgtgtaagtcagttggcatgttctttccctaaatcccctagagacaactcctccatttgctactaagaagaataaatccctccctgacatgttgggtctgtaactctcggaatcagtaaacacagccaatttcaatctgactgtcggtcgtagcaactaaattctgggcctgctggagagctccaaagctgcacggcaccctctgaaatgagcttggtcgagccttttcaaattccataaggcgacaaagaaacttcaacgacatgattgcaaaaagaagatagaagagaaaggaaccttgctgttttcattaaagtgagccgcattagttctcaaatcctatgtttggggaacccctaatggttaaacttacacaagcagaaggaaaataaaatgcccttattaaatttcctatgaacatgttaaatattttccctttctcctgtctccatgtcttagactttgagtcattttgcctctgtcatctgtttccagctcagttgagttacaaccaatcagatatgaggaaaattagattttaatggaatatttgattttcattgcttaattgatttaattgcaagtttctatttcagactggaagaaatgcaaagattttcagtcaaatgtagaaaagctctcatttttctgtgttcaacaatgacaaacttaattcaatggtagcctggattctaaaactttagaggaaggcaataatggcatctttctgaattgttattctaagtctacagttcagtttctctttcatatatatgtatgtatacttacatatatatatatatatatgtatctgtcacatcaaaattcagcgtgtacgtttgcttattctagttgtgttgattttgattttgggttatgaatttttgtttgtcagaggaaacaatacatatgtacttatgtaaacccacactttgtttccacgggcacttaatgtcaccaaatatttccttttgttgctaggtagaaagacagcttagagagatagttctctagccaccatagtaggtcagtggacttttctgagctcgcttagaccacccttgataagtagaattcagtctgtgtcaatgcttttgatgtatactggctgcctaggacattggggtgagaagaatccctgggagaacatgcaaggctcattcaccaatgcggagtgcagcaagtaccccccatcccttggtctcacttgtattttaggtgcccgtgttgatcacagcatctcattttccaaagggtcttctcacagcagtgggacagccctgcatgttagcacagtttctgaattctctgaactccttataatgtcaattagggattctaccagaatgcacatttctttatttaaaatgttaagttttttattgtttgtttttaatctttattggctttgggaaatttaagagttttctaatcattttgagagagttttctaatcattttgagaaaagcgtgtgtgcgtgtacacagaccattggcatgtgaaaatttaattatggatgatccatatttgaatttcttatcaagtaccttatatgcttctttgtgagtttttaaaatgtggaatataattttaatataaaaatcttagcctattgtgtggttatgtaattttcatcaatattcttaccatcacgattgtcaccatgatgcctattttgtggagacttcctcttctacaagggtaggaaagcaaaaaagctaagagcatgagctctggagatggattgcctgtgttcaaatcccagctctgccagtgactcattatgaaatttcaagcaagttacttttactctcctgcatttattttcctcattcataaaatgggaataataacaaggcctagctcacaaggttatgtaacagtttaaagaagcaatagatttaaagtgcttggaagcatgccaagcatgtaggaaatgcttgataagtgcactgaatactactgaggttataatatgagcccgatcctagcctgagactgtacgtggcttatttcacttacctcagtcatacccagtaggggggtgattctgccctccaggggacattagacaatctctagagacattcttgattgccatggcttgcaagatgctactggcatctcgtggatccagggaggctgctaaacatcacacagtgctcaggactgtcacccacaagagagaattatctggcccaacatgtcaatagtgctgaggttgaaaaaaatcttgatttaatccatgaagtaggaaatgtttacattatactcattttacagaagagagtatttgaaccttggagaaaatataacttctcatattgcagatttagtaattggaactgctgtgcaacaggcttttggagcaggagggtttattttgtttttaagataattgcatagaagatcttctaaaagccgtgaaacagaaaccttcagtgctttttggaagcagaaccactaaggaatgggttcaagcccgtcagaacagacactgtctggagtgtggcatcaggatgctagaagctccagcctgtgcctggtctgactttgaattttctggatcctggggaagcccatgaggcttggccacagtcccagggtggtggtagacactcccaaggctgaggtaggctttgtcttccaatagtcacagaagtttattttaatattttagcaactggtttgatcattcctgagaagtacttcaaacacataatttcacagatattgttacttaagatgaggccaaattgaaagtataaaaactgaaattgtctaaagcaagggtccccaaccccccggccacagaccagtagtgttaggaacccggctgcatggcaggagtggcaggtgagtgagcgaagctgagctccacctcctgtcagatcagcagcagcagcattagattcgcataggagcatgaaccccattatgaaatgcgcatgcatgggatctaggttgtgcatttcttatgagaatctaatgcctgatgatctgtcactgtcttccatcaccccctgatgggaccatctagttacgggaaaacaagctcagggctcccactgattctacattatggtgagtatgtaataataatagaaataaagtgtacaataaatgtaatgtgctttagtcatcccgaaatcatccccaccaccaccatccactgggtccatgcaaaaatggtcttccatgaatccagaccctggtgccaaaaaggttggggactgctggtccaagggaaaaaaaaaaaaaactgagtacatatcaattaggtacagtcagcagtaaaaatcatcaaggtataacacaaatgattcatgaatggggaacactttatctcagctagcccctgaggacaggagcaacagtgttgatctatacatcccagggcctggcacatagtgggagcttaatgaatgaacataaactcacaatcttactccatcattgtgcaatgcagtttgaatggttgtgacacccataacctcaaatatatacaattcagacctcccacttcatatctgagtagaatatggcagtagttggttggttgcacttctcagcgtctcagcctttgtattaactatggtccatctctacatcccagcaaatcatccctccgttgtgtccccctgcaatgtggatggagaattagctgaatatgcccagaaagccaagtgactcaaaattcatccccttcattctgacccccagtcaaatccagatgtcacaaaacagtttgtgatctgtcatggtcactgtggactgggtgaagaggccacaaccattagtggagatcagttctcaaaccattgctttaggaatgtttattacaggacttggtttctgactttctgagcacagctaaacaaatggtaatgcagtttacagtcctcagaaccatcattttaatagtgatcttcactggattaaaaaaatctctttttgttcttggcctcccacctgtagtttttttccttgttaaatacatgcgtggcccattgcagctccacagccattcatatctcagtgcctgtaggggtgggagtaagggggcatggagatatttcttatgtatcccatatcatagtattttggagagaaagaagtcttctcttccaaaagtatgaaactgttcatgagaatataatgtgtttgcagaaatcagttatgttcaatgggtaggtgttttcgtgcttcaaattaatatctgtcctttaaaaatagcagatgtttagctgtatatgtgggtggtcgacaaatgcaggcactccacatttgctccaagtgcagggctgacagacaagggtggctctcacgaccaaggcaatccccacccctcctctcacccctcccactctgtggcgatgcttccttggcatctcagatccgtactgttgtgcctcacttctcaaatgcatggaagctacacttcccagcacagtaacagtgacctgcttgaagtgaggtcttcagaccagtgccatcatcacccaggagctggttagcaatacagaatcccaggctccagtccacatctactgaatcaaaacctgcattttaacaccaccccaggtgactcttgtgtacattgaaggctgtggtcccagagcactccgtctctaacctctttagtctctcttactgcattttaccttttattacctatttctgtattatactcttcattttgcatgcgacagttgagggcaagcatcgccttatttttttttcttagatctgtttagcatgtaggtgattttcctagcacagtggtacttgatcaactcctgaatttaatgcagatattcggattataaccacagggagagtggtagtatgtacaccagaaagggaagagtgccacctgtaagggagctctgggtttaggcatatttgactcttccacttcacagctgggcagtcttgagcacattatttgtctcctctaagcctcagttgccataactgtaaaatgcagatcataattgctatctcataggtttgtttttaggatcaaatgggagcaaacatataaagcaattggcatggtgctaattggttcacagagagctctcaagaaacattagctactactatatgaattatcatttcagccagtaggttctatactatatcataattccaaaaagaacatccccacctcaactttaaaaaattaccctcatagctctcaactggggttgattttcctccccaggggacagttggcattgcctggaggcattagattgtcatgaactggggagaaggtgggctgtgtgtatctagtgggtagagttcaggaatgctgcctaacagcccgtgatgcacaggacagccccacaacaagccatgatccagcccaaaatgtcaatcatgccagttgagaaatcgctattatccacagaggaactgaggtaagcaaaatcaccattttttcttgaggatttaggtaccttggtatattcatcctctcaaatattaatgttgagcccttttgtcagaatccatctactatgaggcaaatcatttcctttggtacagaatcacaccctggaaaacctgatgcaacctgattaacctattaaaggtcataaaacaataacaattacattgcacatttcattctttaatatcaaagagagctaggttctttgaaatgtaaaacatcataagtgaaaggatagggcctgcaattcccccaggagcccaaggtcattgtataaataacattctggttcccctattaatttcactccattctgggatgtgcaggaggccataattgttagaggaagaggagaaggctgaacttttgctgcccatgacggaggtcagacagtgtaactgtggtccgtggttcaaaacagttgcccaaaatggagcaaaataaatgtccttacagctggtagaaagatcaagatgaaacgtctatgttgtttttcccttaaaaaatcagagatgctgcaagagctcccaagaaggtattaatttcccaggtactactgcaaaaataagggtgaggaggcgagtgttaggctttattcctgctgtgaatagattaagcagacaccaatttacacctcattgttaagagtaacttttttctgcaagtgagaccacatttacatcttttgtaattaagctaaaggaattttttttaatgacatttcccctaccacaaatcatgaagtaaatattttaagtgagatcaaatgctaacatgtatacattagaaccgtaaaaataaaaagagagacagagagacagagtcctagcgccacctttcagcttcgtcatttgctgggctgggatagtctctgtgcctgttggtgctttggttttggaaaaggccgggtatgactaagtgaggcagttaaagagatggtgagcgtggagggattcgctcttggaagggatggctgtgccagcttccctgaaagcaggaggtatggcagtgagttagtgagtgctcccagtcattcagggcacaccatccatcagcaggagcgtgaggctgcgatggcatccatccatccgtctcctgcatgctttgctttttggcaattttcgtttttaggaaaattgaacatagagagctgtatattaagagctctaacatcctttattccccacacaagagaatctagttgggcaaagaggcattttttccccctaacaatagagtttgcatggctgctagaaacaatacaattacggacccagataataaataattgcagaacaatggggagaatgaggtgtgggcaaggaggaaaatggatggtttcagataagatttgcacaaagattgagttggtgaggtgaagtcatcccaggtcacgtctgttctgcactaactaaggtaaattattgtccacacacctgaactgagagctggaggccacgctgccagcctagactgtgcctttgtaagatggaccttttctcctgagaagagctcagaatgtgaagtattcaaatggaagcctgtgactgctgcttggccaaccttgtgatcagtcaaatagaaaatggtggcaagtcatgcctgtaatcccagcattttgggaggctgaggcgggtggatcacctgaggtcaggagttcaagaccagcctggccaacacggtgaaaccctgtctctaccaaaaatacaaaatttagccaggcgtgttggcaggcgcctgtagtcccagctgctcgggaggctgaggcaggagaatcgcttgaacctgggaggcggaggttgcagtgagccgagatcgcaccactgcactccagcctgggcaacaagagcgaaattctgtctcaaaaaaaaaaaaaaaaaagaaaaagaaaaagcaagcctaccacttgtgatctacatgtttatggagcctaaatgccagtgtgtcacatccctgggcacatgcctaggtactgtagcaatgttggctcagtgtgcattctcaactctgatatcagcatgaaaagaccaagcctcagatatatttggctttatttttaggcttttcctgaaaaaggtgcaagcacatcataaactttgtcttccacaaaaagatcagatttaccctttggaggcatctttctccctgtgccacttgccttttaaattcaagcaggcttggagagtctccttttcttcccttgggttcctccttagcctttccatggtggctattctggtgagtactcgcctctctttgcttttgattgtggttctcaccacctgtgaaaagaccttctgatgaaatacttcccaaagaaccttcttgaccttctcttctccttgaccacaaggctacttctgttttctgccaagtgatgtctcgtaaatctttgtaagttgcaccaactgtgtgtccttacagagtctatccaatctcagcattgccattaaatatagaacccaatctgtagccctgggcaccctaaccagaagtattaattttatagtttagcaaatacggtaatgcaccaaataacaacatttcagtcagggacagacctcatatacaacagtggtcccataagattataatggaactgccctatatagtgtaaccgtttttatcttctatacagtgtttttactgtactttttctatggttagacatgttgagatattaaaatacttatcattgtgttataattgcctacagtattcaggacagtaacatgctgtaccggtttgaagcctggtagcaacaggctatgccatacagcttaggtgtgaagtagggtttaccatctaggtttgtgtaagtgcactctatgatgtttgcacaatgacaaaatcgcctaaggattcatgtctcagaatgtatccccatggctaactggtgcacgactgtacttactaagtctatcctatgtaccagccattgttctaagtgtggggaccaaaaagacaacttctgaccctcttgaagcttacattctgagaaagcgagtcagacagtgaccaaaatcagtaaaccatatagtgatttagaagtcttaagtgcaatggaaaggaacagaaagggaggatggagaattgggggcaaggagatgatgcagtttgatcagggcaagccctgctgagaaaaaatgattttggaggaaacacccaaacagagtgtgaaagtaatccatgttcatgaagaagaacctttgaggtagaggcctatgcagctgaaaagagaaaagtgagggagagattagtggagttgacatcggataaattgagggaagggcagagcatgtcaagtctttagaaagtcaagtctttaggaagacttgggctcctctgagataaggagctcatagatggctttgaggaggagtaagattatctggcttacattgtaaaagaatcaccctgattagcagagttggaaataatcagcaggggatgtatcagtaatttattactagataaaaaatgcagcagaacttggcagattgaaacaagaggaaatgattgttgctcacattctggtgtgtccaacaggcagttcttttgggggacttgcctgtactcacttgtacagtttcatctagctggtgggtttcatgggggctggactccatgaaatatttgagcgtttccctcctcttggtttttcatcttctaggaggccagaaaaggctttctttcatggggatggcattcttccagcagggcaagcccctatgctcaagaacttcttgtgccttttcttgcatcatgtttgttaatggcctattggccaaagcaagtcatggccaatcccagagtctggccaatcccagagtcagtatgagagagaactatacaagactgtgaatacacgaaggtaagatacattaggaatccccagcataaggaactgccacaggggcctaaagtagaaatcatggaaaacaattgagaggcgctacaaaatccagaaaagaaatggtgatagactgcaacagagtgctaacaatgaaagttttaagaagtacccaaattctaaatatgttttacaggatgaccttatttttattgtgtcaagtcagtaggacaaggctattaagcttccagggattggtgatggtcttattatgcgtgagatgatgtcataatatagtaaatgaggtcagggataggtttcttttattgccaataattattcaacgagttttctgtacaattgtaaacttagcaattcacttagtgccgtgactacacagcaccctgtcaatatcatcatcagctaatatttatcgagcaccctctgagtacatggtattgcactcacagcaacagaggtgagctgcattaattctttcagccagtgcaggattattgagtggtttattacatcactctattaattggtgccccagcagcttccggaacaacatttagcttccataatgcaattctttttcctcttagagtagatttagctttggtagaatttaactgcacaaagaaatgatagggctatctgcctttataaatatgctaatgttttttgtttatcttattatcagaaacttggagatactggtcccatttcatagacggagaagttgaggtagacagcggtgaagtaatttagctaatgctatgtgctgagatcagggattgaaattcaatcactttatctattgcactatactgcctctcagtggtgtatgttattcccattttgctctcacactaatatatggtcatgaaaacacccaaaaagatttaactggcgtctatattctttaagggagtgtatggcacttttctttgacatctgcacagactaatcactggaaaagtggtttgtttgtttgttgttgttgtttaagccccttattataggggatttgtcagctgttaaaatcaccacttttttgtgtgagttaaattctcatcagaaagatgtttttgcttttatggtacatctaaagttttaggaactagctcatgaaataaatgatctcattgagatccctactttcattttgttctggaaacagttattcactggcgattgttttggttgatcattctttttgagagagttctctttttttttttaatgaaagagttaaataggggagctaagaaaactgtgagtggaagggagccgtttaaatgcagaatttctttgcaaatcttgaaagtagcgccattagatgtcacgtactctgagatgcactagagtgtacaccctccagaatgtctgtctgttgtaattccatcacattacatattttagtgcatatctcttcctagcagcttccagagcttttcagatattcagcatcagaaattgcactgttttttcctggattttacaaatagcaaccagattattgtaaaacagaactatctgataagtaaggttgtgaattgcttttgtgattgtcatgggtaagagcattgaagaaactcgcaaacagtgcagcacactggttcctgtaaaaataaaacctgtagcagtgaatgcgtttttctgatgaatacgttcaaggctgtgatcattgtgcaacttctggttggatgctttcaaacgttccatattgagaaacatcagtaacaagaaccaaatagtccaccaaagcctgtattcaactcaatggagaggaacgtaaattcttacttagagtttcattgaggccaactctattcggtccaccatgggaagcagagatttaaggttctctcttgatttgctttccatttttactttatgataaggtggctccgctactttggttttcacttaaggggttgttccaattactatgcaaaacagaaatggaaaacagacaagacagacttctgttcagcagacaaaaaccaaaatgccagaacatgttaattaatgtgagcagttttataagcaaaataatttgttttaattggctaaataagatctgatataattataataagccaataaactaatttcagaaaactatttatatcacaaacctttaatcacattatatactcattgcaagtttggaaacggatataaaaatcgacccaaattatctcatctttacaaataagaaagatacattaagggcttttttgaaacttcaaaggttatgctcttttcttattttggagaatttctttttctttttggaaaaaatatataggcaatttcaggagcatgaatctttagtgaatcaagaaggaagcattatgagggtgaaaaatctttcttaagaaagcttattttgtccaaggtaaaaggcttattaagatgaggtttcttccacaatgttctttcatatcatattcaccctaaggaaaaacaaacctcgtagaagagagagattgtataattgggcctgaaatgacctcctagaagagaccctatagaattgagaactctctctctgaggattagctgcccatgggtcaacacaaactgacttccaactaatgtataaacgattgggggaaaacgatatgcttccagagggcagttgttaattcttcctaccacaagaatctcaatttgttgggatgagctaattttgacaccaacttgaacactggttgatgcgcagcatgtgcacacacacacaaatacataacaaagtaaataaataaatggcctttcatacaaccccaggggtaaaaacgctacaaataaattatgcacttttacattatactagctgtattttaacaacagtttttaaaaggccagggactgtattataagctctttcacataatttccgaatgacagaattgcatgcccatcagaattgcatgcccaccaaatcaacatgtcttttttaataagtgcattctaggtacaaggtagtactcaaaggaatagcaatatatattgtacaaaaaaaaaaaatacttcgctcatgtaaccttcagtatacttaaaatctatgtgatgaagtaagatataaatcaaataaaaaagacctagtaatattagaagaataacagttcaccaatggtatgagatatccaaaggcaggacaagattaatgggaaaattatatgtattaaaatgttctcggcaatgggtgcttagacatgggaggaaagagcatttactgtgagctaatataatgtagaaaaaatatttttggttggagaagtatcttattttgaacaaaggatagcatacatttaacaaatccttccatgcaaaaggaaaacatagggagatagcagggtacaaaatgtgtttggaggtgtatagaccagattttaaaacactgctagaaatagatgaatgtaggcaaaattgaatggctcattcatgtatcagacccacatatactgaacactcaccatgtgttaggcactggtctagctactaggaatatagcagtgaacaacaacaacaacaataaaaacacgctgacttcatgaagtttatgcaaatatttcaagacagtaagtgtgtgacaccattgattatcctaatatggggagcacaggcagttctttatcttagttctattgtttttcatttgtgcacagacaggcagagaccatggtgtgtgtgtgtgtgtgtgtgtgtgtgtgtgtgtgtataaaaatatatatttcaaataaaagcatttattcaacttgttgaaaattcaacaatattgttcatcaccatgtacacagaaaaacatcacataggttgatggaattttttatgttgttccagattgttttagtattatatagacttagccagagagaaaataaaagagaacataattaatgcatttacttaaaaagaaagaattaaaggtgattaaacgctgtgggtatttgtgtggttagttctgtctttctgtgtaaccttaaaaggatgactatcagctaataacttttccttttccatgcatggaatgggtggcctgaggggcccatcttcaagcagaatgtaaatgccaagtatgaggaccgaaatcaatgagtatcaccttcctacagcttttttttttttttttttttttttttttttgcagagaactgcatttgtttctatctgtgcagccatagctacatcattcatatgtaatgtttgtcttttatattattttgtataattttgatgattttcgtggaaaacgtgatgaaaacatttccccaaaaaaagtgttgctgaatttaaatgtgtttaaaaacttaatccccatgagcatagatgatcaaacactcaacaaatatttaccgaataagcaagctactttgtttacagattgtgggaggtactaaagatgcaaagtgtttaaaatgtgaatattgttctcatttaatttaaacatatatggaagaacggggcacaaaccagaaaagccaagtaataataaaccaatgtggcataagctaagtctgaatgcctgacatggataaaaataactagaaggtaggaagacaagggttaatatcctggctttgccatttgctccttgtgtgatgtcgggtaagttaattttgctaaatctcagttttgttgtctgtaaaatggttccagcaacagccatttggtgagttgttgcaaggttagaaattagaggcaatgataagtccctgtcatttaagaagcattcccattactatgaactatttcattattgggtaggtgttagctatatactagctattatataatagctttacatggattagctattaagttctcacaatattttacagatggggagagcagggtttagagagtaaaagaatttgacccatgttccacaattaggaaacaaatttcagggtgggaatttggacttaggactaaccccaaagcccagctcctaattatgatacatccgagagcactgtgatagctatgggaattaacagtttcatcaatgtaaaccaagaaagtcaaggatatacttgtggaggacatgtaacctgtcctggtctctgataaaagattggagttaaatatgttgatatgaaagagaaaaggccgttctaaacagaacgaataatgtacttgaggctctgaaagggatgcatatgcatcaggctgggcggacagtaagctcttgtgcagtagggatagaaccagtgtttacatggataggttggtgtcaaaccacagaggcgactgaagttgaggcaaacaaatctgcacttgattctctaaggaattgtgaaccttagatgatgtgcaagccgatacataagataatgaaataaaacagactttcaattgaccaatcaataactattgggaatggatgtcattcagagtggcattttaagaaggatgaattggagaagaaaaaaaaaaacctcttaaaacggctgttttcaatggctgtgtcacgacagttgggagaagtgtcacaatgaacaaggcactaatagaaaagtatttgtttgccaaacattagctagtttatagattagggcagagtcaaggtcgtatgtagaataatgtcattctcctttcattcagattccaagtgcattcttgagaaggggaaaggcggtgttacgatctctggtgcagtccttgccagaaccctaggaatgccccctggaatgggtgttgcatttcaccgcccttcatgtgtttcagcacaactaaaacagcctaaagaagagctgcattgaagaattattgcaactgtccaggcaaaagtacacaaatcaagaaatgtcagaggtctgaaaacagtaactttaagagatatggggttggtatttaagttattggtaattgaatgattgtggtgggggaagaactgagccctgaatggcttgaaggattttacattttacactggtgaggagatttggagaaagggcttgcttcgagggtgagttcatgagttgagtggtagaacttattgagttttaagcatattatccaagtggaaaaacccagaggggaatttgaagaactgtagcttgtaaagagggtcagagtggaaagaagtctttatgagtcatccattttgaggtgatgaaatattgtccatgttatccatttttaaaattttaaaaagctgttgagtgggtttcctaacaatggaagttcacatttactgatgcacttgctatgtgctgggagcaggacctaccacggcacagacattgtttattcttaatgacaacccatgaagcaggtagccttacacccatcttaagatgaggacacaatgagacaaaataactcagtcaaggtcacacagcagtaggtagtggagctgggattcaatcttaggcagggtaacctggttccaaaaactgagcacttaactactgtatcatacgctgtcatataagcatatgaatgtaaagctctcccacagagaaataagtcacataaaagttacattcctgtaagaaatattaatatgacttggtcaccccagtataatcacctagccccccaccctactcaaggtatcttaaatcacacatatccactccactacaaatgatatccactcagggaacccacctcctcactaaggaagcggtaaaaataaacaacagcactgatagccatttgtagctttaaaaaaatctctccttttgtctgctttggagatttctttttatctctcattgacaatgttttgcagatgctgttcaataaacctcgggccccttcccctgtttttattgtgctgaaatagttgcgtgctgaaatagttgcatccttgtaactgggtctttatttttattggcagaaaattctcagtccacttattcccttgtataaagtaaattttaactgtagaacctgtatcaataatgtcatttaaaggaggctgcttccaatacactctgcaaaatgtccgcagagatttccggatttcccagtcaccacttccctccctgctagccaggccttgcagctcccttttcccttctacatctgagcactctctgttctctggccagctgccttctgttcagcccctgtgtgttctccattctctgctctgccttaatgataagtagagtttcatcctaagcacattagggtggaggtggggattacttctttatttgggtccaagggaaaaacataccctcctattggcaaaccatgaagagtatgacacttcgagtttaacaagattaagcaatccctctttgggcacagcaatgtggccagtgtgggggaagagagtgttattcttcttggaccatttctcattctatatctggtggcttacataggaattccaaattgcaagatgcctagggtccggggatatgttgttgggacataagatagttgaaatggttgtgtacttgggtttttctattttttatgtttctaaaatgataattgttataagtagggcacatagaatttactttcggatattggaattgcttaatttcgaagagatggccagtcaaaagcttgggcatctcctcttcctgttcacttactactgttttagctctgcttaccatgaaaggtaagcagtcattttcaccaataacttataccaaatagttgaccttggaaccagcaatttacattcttataaaagaggtcacttagggaatttaactgtgtaatcctagcccccatgtggtaggagatgagtagaaatggaacaaagctggtgacacaccatttgaaacaatttgaattgggaaatcatttcttttcgacttcgtgtcaaaaatggaaccttctttaaaatggtacaggaagggagaaggatgcagtaaaagtctgtagcaatagtgactcaaaaactctgttctaggactcacgaaagcaatcctgttgtcacatttggagggaaaccagaaataatttaggtttttcactttcctaatagcttcttttccaatacctttccttcagacaccatgccctcccttttattttgcctttattaatgaaaactaatgaagagaaacaccgtttaaacttgaactaggaaacacaggttttgtagtgctaatattttggtgtgggctctttttttttttctttaagacaattatcaagacgaagcatttgtttcttcttttgtttacccatggcagtttgtcagcagttatgataagtagagttccatctgccagtaaaactacattgcaaattgccgtagaaattagcagctttcatttttgcctacataaataaatatgcgaaataaattgcacataaatgcatcctaaaaaatcacaggtataccacacagttaaatgccaatcagacaaacccagagacacactgcgattatctcagttttcaaacctgggagatacacgaatgtgtttctaaatgagagaggcagtgtatcatgctcgctgagataaaaacagaagctgccagacactgcactgtggctttattctgagaatcctttgcctgaaacccgctctcttttcttgatgttctctgtctctctctctctctctctccccctctccccctctctctctctgcttctctccctctctcctcgctgtctttccctcgctcattgttctctctctcctcctgcctttgatgcacatacgttgtcacaattcattgactctcctctcttctctgttcttacactcaagcctagcggtgctttcgccaggcagcagcagcctctcctgcgagttttaggcatgtatgcagctcagtttgatcgagcgttccttttctgccttttcactcttacaaaagattaaaaggtggcgtcacattgctcccctgttccttcccgcaggagggacttaaaagggacaacaaaaactaatcactttcaataagcattttcttgctggaaaaaaaaaaaagaaaagaaaaaaaaagaaagaaaaaaaaaggcggggggtggacttagcagtgtaatttgagaccggtggtaaggattggagcgagctagagatgctgcacgctgctaacaagggaaggaagccttcagctgaggcaggtaagcgccgatcggagggtttgaccgagtggcttagttaaatctctgttttcaccgttttgtaattgagaaaggcatccgcagcagaagccgatttttcagtcggcttccttttgtttaacatagaaagtacctgtattaattttgatgaattagagcatgcagcaaattcaattgaaaatagatttgtatagtaaatgcatttatactgaatgatttctcctccgttttatttaaggagagagatgagaaagatgattttgatcagaatagcactttgcattacgttaaattctaaacagctaacggaaagaaaaataatccaattgatactgcttttgaactccgggacttaaaccctaggagacagctgccatttgaaatttttcttctaactgaacttctgatgtgttataataatttttcactggaggttttagcaagggtagagtttatttaagtcgagctactggggtttgtttggcttggatcttgtgggtgaagcgcttcttatatctccttaacgtgtgtcaggttgatggttcataaatagagattaagtgttgtcccaaatgaaatatgaagttaaaacatcaggttagggcatgttgtagaaagggatctggtaaataattaggagaactgaattatgacagtttgaaatgggagttaactctggaggtgctgtttgataaacctttctggattctaagcggctcaataatggaggggctgattaccagtctcgagtcggaactttgcatcaggatcctaaatgtggaatacatatggattttcattgtacgtagcttttagaaatatgtcccttttgtgtgctatgagagttgtggattatatttgatggcatgtctcctttaaagagctttggggtgaagcttaaaaggctcatatctattttaacattgaacaaacacaaaatgcatgatctcccagcacttgatttttgttgctacttctgttgttttaaagttttgattatgtgtttttaacctcagtctttgttgattctgtgttcattgcttctgctgctaaaatgtattgctgacatgaaaaaactgagatttgagaaagaaaaaaaaaaaaaacaacccaaacccacctctgattagccaagtttctaattaaggataacagaaatccagattatatctaagattttacctaaaagatagcatagaatgtttaaaattcatttttaaatgtttttatgagaaaatctgaatattaaaagtacaaaattcagttaaaagaatcctcctctggaatgatatatacaagggtgacttcagtacctgtactaggtttggtcctagaaagaactgcactactatggcattgttgatttcagcggccacggaagggaggatattttatgtatttgtctggagataagatttttttcttcccaagtttccaaaccggacttgctcctcaatatcataccctggcatgtctcgcgtttgccagaccatctgatggcatcttgtgggtgcagcctatgaatccaattttatgaggacatcagaaactgctgagtagtggggagtagagaccaaatggactgtgggtctgatcatacttcatcatccagagataatctctggtggaagttccctgggaagcccctgatacaggttggggagacttaatttttcctcatggttgaaagaatagggaaagatgcagacaagagaaaaagacactgctgtcgaatgtttgatgcaatcgtgctggtggtagcatagtgagtttttaaaatcgcatcacatgtaattttttttcagcttaagaaactttgcagaatcttgaagtagcttttctcaaattcaatctcgttttttttctacatcgttttttcctgcgtgaaatttttctctgactccagctacacctaactattgaaagctgttattctgctgctgataatgatgattatttctcaaataagtggcaagtgttgaagggatgggccaagagaaatatgttgtctgtatcatatatgctttgcttttatttatgaaaatgacttcttccaggtgaggcaatgataaatttgaagttgcgacttggctatttgcctcaccaaacaactgtccttttcttagagaacaaaatagaactaaagtaagcagaaataatttcattgtaaactggattgtagttcagcatgtactttttaggcagatggtaatcaaagctatccttactcaaactatttgattcatataaatagcatttttctgaattttccagtagatgttgctggagagcaaagaaaagagcattttttttttttttacaggaaaaaaagaaatgcagtagacttataaaagccaagaaaaaagattcttctccccaaactctgctgatagcattttgcataatttgctaattaatgaattatattgaatcattaccgtttatgatgttctatagaaagctattaaaacttgagttcgattttaaaattatgagattgttctctttagtccctatatataatgtctgtttgctgtgttccgttttcaaaaaatcaacttaactgcacattactattcagaacatttcatccctgaatgctaaaaccctttaacatgcaaatatgatgtcagaggaagaactgaaatagaataccctgagaagagtaatgatcaaacgcattataaaaatatgcaccagttgccaacatgtaatgaaatattaagaaattaaaagcatgcaacctctaaagtaatagaatttcattgctctgagactgttttcccactgaatattaagtgcttaatagatctacccgtaaaaaacaatcgaaaacctacatgatttgtcactgaagttctttcattatatgattttgaaaaattagcccaataggattttcctcagaataggaaatgtaattaacattggatattaagtgtcagatttccaaagcaaaagctataaggcttgatggagaaaataggaatgcagagagcaaacataagcactagaaactgaggggacccacgctggaactgctctgcttgtaatcactgtgataaaatgacaaagacgtcccagaggagcccaggaatctcgtacccagacaggaactgatgcaatttcaggaccaatgacctctatctatgggagtatttatttttggaaatgatcaattaactgatttcaatagtgaaagggaagtgtatatgttttttccaatgagagggggacgtagggtattacaaaagcacttgcagacaggacaagggtgtaacctatgttggagagctttcggttttcttactttaagccgacctagttctttgctggtggattcttctttggcattgaatcacctctttgtcagttttccttcctgaggtgtgaaatgctccataggatgttttgatttaacacctatttatttctcttttctgggaggaaaaagcttatatttagaaggcataagtgtcagctacttctattttgtaattaatgctctaagtccactgggctagggatgttcccgattttatttttatttgattcaaatacatttttttttgtacttgacccatagtggtttttttcttcttctgtctttaaataaggaaagctacacaacttggtgggagattctactttctagtaaagtttgtttgttgtttgcctcttgttctctttttttaatagtagctatcgagcgctgactatattcaaagtacgatgagctaagtgtgccgaattgcacccctaacaacaacaaaagatgcctctccactcactgagaatctgacgaagatgcaaaatatgcgccaaacagcctactggactaaaagtgccaggtcttaactccctcccttaggagagcaggggagaaaaggtcgctgcaggttgagaggaccctgaggagcctgtctttgaattaggggtgaaatgtgaaaacacaaaataatccccatcagcaaaatcagcgtgggcacagggggcacatgccaaaagggaacaaccgatgctagtatgatggagggtcttgaacggcaagccaaggtatttgatagccactggagaggggtgatctggtagctttaggggagttgcggctttggatgtggacagggaagtactggaatatggggtcccaccatacaacacacccttcccaggaaattctgaaacgtctgtctacagggcatctattcttccgttaaattgcagccttacggaggtattgctaccagtagcctatatcttccccttgtagcaatgctgttgagaactcctggtccagaggctggaagcctgtgaataatctgttgcattagcctagacttcagcagtaaggttgagaaacgctggggaacggagactggctacgagaaacaccttcgtattataattattgcaatttcttgtttgtactgcagatgtcatgccctcattagacagggattttgtgtatatgcatttgttttcatgttttcataagaaaaaccttcaccattcgttggagatcagacccgtggtttagaaggtgtgatgttctctccatgctatttcagtataatcaattagtgttatgttcatctctggtttcttgacattgattaggatggatttttatgatctttaagggttttcatctctctaaaaacatatatactttatttattagaattaattgcctctctgaattgcctgtgttgtcagttactttctataaaccttgactaacttaccttgaactctttgacgtctagtgtatttgactgacaagctcagctgtggagactactctaactatataatggaagtttatatgtgaacatataagctgttttcttttcaacagagttcacgatgagaaggagcaaaaataattattagtacaattaagtaagtagagtgtcatgcttttcttctgtaacacggattttaccagcctattcaggtggacacggtcaccaacatcacctcaaaaccaaactgtagatgagtgactttccttgtcctccaaccactttaatttaatttgttccatttacttttccaagctttccatcttcccaccattttaatactatcagagatggggtgctgcccatgacattcacacttgacattatcaaacacaaaaggcatcactcatgcacttgactgcattacaatggaaggaaaaaaatagatcccaaaggcttagaaattattgtctcgtaccttgaatgtagctggattttcttttctgtttcctccagcctgcctcatttgactgttttgccactgtgtgtttgcagagggttctaaaagccctgcaaaaatcagcactcacaaatccataacatacacatttttatattcactggagatatgtgtcttagtataataggaatttacaatcatatcattattgtctgttatttgttaggcaccaaccacattttgatgcagttccaaagttgcagcttgcaccagagctaccttctcatcattgacttcagttcttctgacggttcgacagtcgtagccaagcgttgtcctgactcacagatctgtggtcactgcagttcctttactattgctgggcaagccagagatttactgaaatccacagtagctctaatttttgtgtgtgtgagtgtggagaattcttaaagttagtataaatttctctgtacctcccttttcttcctattccgagcctgatggtcaaagacagtttacctctctgcccccatatataagacaacacttgtgacctgaataaatagcattagattgtggtgagtttcttcagtcatattacatcatgcatcacgatcgcgtgtgctgtaaagctttgtaaaacagccagctacatgatatcctgcaggtttaatatacttctgcagccttgtacttgggaaggatttctgtaattggagacaatctagtaaggagaactttttaagccatcggaggccaaaatacaagtttttgagaaatgtgcctttataggcttgaaactgaatggattacaaatttctcttaactggacagaatcataattgcctatagagtacggtcctgattatccagggtttgaatttccagcatggggattatccagatttcttccttgactcccctgtctttttcctaactacctgacgtgaaacatttctctaatcattggcacctctgctaatgctatgcaagggcaaatttgagcaggaaaatccgaactagcgaattatcattcagaagagggaattatgtagaaaaatctggtttttgtaactattcactaaagtcgactggataaatttaaatttggggggacatctttctatttacaaatgatgtttactgtagctgcatatatgctgttgagaacagcatatatgggtttcctacccaaaccccagttagttattctccaccattctcattttagtcattaactgggtgccaatcagtccttgataagttatttatttttaggatttgacccacacactgaaagcctcttagataccacaaggaggctgaaatggtgaaagaataggaagtggagctggccttgccagaaacgctgttactgcagaataggacaggagtcaccagaccaccttccaagtctgcagaacagggagcagatttctgtctactgaatattactacagaatcaaaacttgaggctgggctcagtggctcatgcctataatcccagcacttcgggaggccgaggtgggcggattgcttgaggccaggaattgagaccagcctggccaacatggtgaaatctcatctctacaacaaatacaaaaattagccgggcgtggtggcgcaagcttgtaataccaggtactcaggaggctgaggcaccagaattgcttgaacccaggaggcggacgttgtagtgagcggagatcgtgccgctgcactccagcctgggaaacagagcgaaaccttgtctcaaaaaatcaaaaaaacgggaaccaaaaaagaaaaccttgatttcctctcatattcacgtacatcagttgtggcttggacactttcataatcctgtggttatatctggcactttgtaccaatgtctctcatcaaatagtgtactcttctgtcatctctatttgacaaacatacttattaataatcggtagcagtttgaggtgcttaatacaaattcacaagctgtttctgtttctaaatgtataacataatataagcaataaaacatatgctatataatataattgacaaaatatgctaaaaggcaaaaagtggtgttgcctcagtggtactttaaaaaatatccttttatcactagattaaaactgagtctgttagaaagaaacatacttgaagttgttaaatgttcaggtgcagtcgatgatgtagtataatgaacaatagttttcaacccatattttaaatgagaatttaagcagtaatatagtacataaactgaaaatgtaaaacaactgttagaaaaatcattgacaaatctagtcacatgttctgtatgtagaggattcctcttagtattcgtatttgtgttacatttatatacatacatgtatgtacacacatgtattatagagaatatatgtatgtgcatatatctttatctatatctatttccagagtgagagagacagagagaataaaggggtgaattcctaataagatacagtatgagtacattcccgataaaatattgtggtttttccagctgacattattaatttcccacaatctgacgcacagtgtgctatgtaccaaggatgccaaaatgaaaaagacacaattcttaaggagtttatgatctaatctgaaattagatattattttcatgttgaattttcagttgtagatatatttagtaatcaaaaacattgagagagaaaaaaaaaaaatcaagcgttacaaagccattggagcccacactaggtatctctacattttacatgtcttgcctcatcaggaggagagttggaaaataaatataggcaggtatgatttggggaagaagattctcatataatataatcttgtcccaactaaacataaatctggctttatggaaaaaccaggctagggtttctgaattctctgttaccacttactgttgatgcaggccacagaccaaagataggattagtttgtctgattttcactcttctctgagttctatacagcattcaatcaagcaaagaatgtgagggaaagtgttgtcaacctgcttagtattaaacatgcacaaataatgttttgtttgaaaagatatgtaattgagcatatgtttttaaatgaaataggcttatgtgacaaaaatcattttattcttgatctatatggcatttatgatgtatatgttttatgtgtttataatcacctatcctatgtgatttatatacacacacatatagtctctagaggtcagtagaatataagaaatgggcaaaaattcatgtctagatgagacccagagatcctggagaccatttttcaaatggtgaaatgatgatagtcgactaatgacattaggaactgaaatcattaatcagtgttaacaaaaaagtcatgtcattcttgttcctgaaatgaatctaatctatttgttttaagcaaatttcagataaatgaacatttacatggcacgaacctttacagaaaccaagctgtaattactttattatagtttattataacaggctgtgattctccagaagcttttttgaggatttttttttaaatgttaccagaacaaaaaggtaatttgtttttaaacacttgactattacatccaaaacactatttctcttttagctgccaattcagtccccttgactcttagaaatgaatcatttcatgatttatacgttgtaattttatttgttcttatgaactaagtgtccctgatgttggaaaatgtattagaaaattgtgatttattttatatattaagctaaaattgttgacagtccagcacttgctgcacagttgagcatgtttgccaagtttttctctggaacattcatgcacaaaaagtgtaggaaatgacataatgtagccatgaactatttgatagtggagttgtccgtgactcttacacaccattttatgcaagaaaaaacagcacagcagggattcagatttcattcgaattcggggataaatgattatcttttaagtggagatcgcatgccttggcttagaacttaatatgccttgcacacattaatatcgctcacacttggaactaatctatcaataagctattcccatatttgtttacttacactagcgtggattgcattcttagttcagtttcctccaggataaatcctaaaccatgtattgcagcagaagtgcctaaaggtgaatagtcagaaataaaacaataggaggtgataggggcctgtggagctgtgaaaaggcattatgagtatatgtacacacacacacacacacacacacacacacacacacaccccaaacctatcttaaaacaaaacaaaacaaaaaacctactgaacatttttagagaataaccatatggagaatttagaagaactttaggtttatagtaccacaagattcccagtagatattccataaaaattaatggagcacttacaacgcataatctagcaattattaaatcaagaagatatgctgtgtttcctgtcctcaaggggttcacagtgttaactggatgctccccatacagcatctcccctgcctctgagcctctacctctgctctcccaatcttctacattttccattccatctctccaggattccttccagtctttcctgctttcctaactgtggctttgcagatgctcatcttttttgtctgctttaacactccagtttgtccctggctaaatactattcatctttaggccgaacattaaatgtcacctcctccaagaagtttttctcgactactcctccttaagtttaaattaggagctcccactctgtgatactgtaacaatgcactcaccttattgtaacagtgtcctcactatatataactgctggtttaattgttcatagtccacctgttactggcggagggtcctgactacaagtcattcatgttcttggcgttttaaacaaataattggataaaatgcacaaacaaagcagtgaaagaatgaagcaatgaaagcatagatttattgagacaaaagtgcactccatagagtgggagcaggctcaagcaagtggctcaagagcactggttccagaattttctgggatctaaatactctctagaggtttcccattggttacttggttacatcctatgtaaatgaagacttggccaacaaccagtctgattggttggaggaggtgaccagtcagatgctgaagtgaagttacaaagttacactctctgcaaatgaagacttggcccatgaccagtctgattggttgggggaggtaaccagtcagaagcattttccatttttcatctgtgaggcatggaaaggggagttgcaaagggagaagccggctgaggctgatccttttgttatctgggcatgaagaggtggggttttccttttcattcagttctaggaagtcagcatcaatcggccttagattccctacccctccagaccgtattctcccgcctcacacctaagctttctttacttttcttttttttttttttcagacggagtctcgctctgtcgcccaggctggagtgcagtggcacaatctcggctcactgcaagctctgcctcctgggttcacgccattctcctgtctcagcctcccaagtagctgggactacaggcgcccgccaccacgcccggctaatttttatatttttagtagatttggggctacacctaagcttttaaactcagtgaggacaggagccatgtgtgtctagcttatctgctgctgtatcactgatgcttagaaaaatatctggcagcataatgttaatttcatcaataactcttgaatgaatgtgcaaatatataaatactcacaatgtatggattaaaagaagatatccacctccaaaagaccacaaatcattaacctctgtgtttgttcccaagtcttagtctagggcagattcaaagtgtcctagggcatcatccttcttctctctctattttccaccctgaagtagatccggatccttaatccccagaatagaatcgttattttagttggaggaagatgtacactctttagatgttttcttcttagtctctgatcatgtaatttatgatgaaaagtacacttgtttggagggtagtctaaaagtggtgactacctctctccactctagtgatgtttacaagattttgaaccttggatatcagaactgtttaaatagaccatggactctgagcattgtgatcatgaatacagattgtctgttgaatatcaggcattttgctaggaactggagagtcagaaatgatgatgcagaataaatatatattgatttatttttaattaggcctatgggaccatgtcactttatgtgaggatattgtactcccaaatttctctgcttcttttccacacctctggtgaaattctaagaacttatcaatcaagatattttcctaaaaacattgtatttctatgttacacaaagacataaacaaccttagagtcatgctagaagttatttatataataatagaataaaaatgttaatcaaataataaaatttttattttaattatagtcagccctttgtatctttgagttctacctttatggattcaaccaaccatagattgacaatactgaaaataagaataataaaaaagcaggccaggcacggtggctcaccctgtaattccagcattttgggaggccaaggcgggtggatcacttgagtttaggggtttgagaccagcctgggcaacatggcgaaaccgcatctctacaaaaaataaagaaataagctgggcatggtgacatacacctgtagtcccagtactcgggaggctgaggtcacaagattgcttgagcccagaaggtcaaggttgcagtgagcaccactacactccagcctgggtgacagagcgagactgtctcaaacaaaacaaaacaaaaaaatacaaagtaagagtacgataataaaaataatacaaataaaaaaacaggtgatataacaactatttacatagcatttacattatattaggtattacaagtaatctagagatgatttaaagtatatgggaggaagtatgtaggttatacgcaaatactgcaccagtttatttgagggacttgagcatctgtggattttggcatctatgggggtcctggaaccaagccccacagatacggagggactactgtagtaataaacatgaaaggctggtcagttaactgttcctctgacaatatgcatgttaaatgatttcaatgtataactgtaatttctcttttaatttgggacatatcctccttcctttaatctttggttccctgaggatggtagcagactgttcatttctgtctcactctccctttccttctccagggtgtcctgttgaatccactcctatgtcttatgtgcaaactcataatacccaggatagtttattatatttattcttgaataagaaaatattttagggaaagaggtaatttaaaaaatggaacgtacttgccaatgagcaaatgtattctattagtagagaattataaccaccttataacaatcacagtatccctcatttccaaagcgttctggaatgagtaataatcaataccagagtaaagaaagaatttttcttcaatttagttagatgatttttattcacaaaaatatctaagttgttgaaaaaatagacctttgacttttaacttgggtttatttttcaatttggaaagtgcatgtaagtttgttaatgttaattagtaattgttgggctctgagggggtgcagcatcttcagtctgagcttattacagtgtaaaatatggattgcctttaccctaatggcctctgaatcctattaccatcccattagagagtgtgggattttagtaattctgttgttgtttccagtgggcagtgaatataatggggaagggcaggggttaatgcaattcatctcttttaatacttgtaactccaactcccttatcactcactgaggtttcattgggtttttcccctttctttctatatctttaaggcccaatatatttctctatgcttctcccagccagaatagtttggggagtatttcgatgattcttgggtttaaatagaattttcaatattagcctttcataaactgaagataaacaaataaggtagtatgtccgcttgttgtgaaacagcctgtcactcagaaaggttttcagtgactgtcattgtgccaagaatagtattgaaatggctcttcattcaagatcatttataaggccttttggaaggagaagcatgataccagtgggtcggatcaatgcacactagtgttctgggtataatgtttccatgtgttcctggagacagctgtgtcctgggtgctggtggtgctagagagaagaattggaaaagatttcaaagtgatagaaattagattcctttaaagagaagtttatgagcaatagttaattccctacatctccaacatgctcagtagatgttcatgtctgattatgtatccgtggttttattcatgaaatttgtttttagctaatacagcttttttcggaataaatacgaacatcagattacttctcagtatgtcaaaacaaattagtttcccacagtgatgcagtgaaaggtgtaactattttccctttttatatgtcagaaagcattactgggactgggaaattcctctttttccccccttagcccgtgagccatgtggtttgcaaaggtctgctttaattcacaagcatgttcacctagagctccagcacctccctctgctgccattagtgggaatcacatgctgagatccaaagaggcaaccacactcagaaaagactgggaatggcaggaggtgatcagaccatttcaatctgttgaaagtgagtgatattcccagggctcactgttcaccttctcagagaattaagtttccatatgtttcatcataaatgacatgaacgtgcaacataactgcaatatgcaaatgtccactggataacgtaatagaaaactggattggagaggaattctccttgtctccgtattcaaaatatcttgattgtccacctggttatggctaataggctaagcctggtgacagtgcttaggtctatatataatagtagtttgtgtatctgcattgaatattcgtgcatcacatttctccttaatttgaggtatcacttatatttctacacagactgtgagagcatttctttctctccatcaatgggtgtattgtgtgaaattcattttagaatgtaattatgtagtgaccaatacaattagctttcatccaaatgaattgatatgaataagcattgttaagggatattgttttcttttgatacttagttacttagttacagactactttttaaatccatttctgttcccacaatcacttgggaagctaaaacaaaacaacaacaaaagaaataaaatctactgtaagtatatactgaagtaataatcttttaaaaacagcacatatacaaaagaccattagcagaaaattactgaactcatggaaatgacatgtagatagaacctatgtagaattactggtttgcaaaggacaatatgagggattctggttactcaacaagtggaatgtggctttctgtttttcatttatgattggaacccatttaattcatcttgtctgtttattcttggaacttcccttcagatctccaagaaatataaaaatcagatgacaggccaggcatggtggctcacgcctataatcccagcattttgagaggctgaggtgggcggatcccttaaggtcaggagttcgagaccagcctgggcaacatggcaaaaccctgtgtctactaaaaatacgaaaaattagctgggtctattggcacacacctataatcccagctacttgggatgctgaggcatgagaatcacttgtacatgggaggtggaggttgcagtgaactgagattgtgccattgcatgccagcctgggcgacagagggaggctgtctcaaaaaaaaaaaaaaaattaatgatacttaggtttccattagagaatgatatatttaccattgtcacaaagccacacaacctttcatgtgttgtctctgttcagtgttcccttaatgcatgatacacaaattatttaacaatagttgaatattatcaaactagtagtaaagaaattggactctgcataacactaatagttttattttttaaacatgtgtcagaattcaaatataagtgtgaactgtgtagagcacacaggaatgctgagtgccacattttgtaccatattgcatccaatgcttttgtggaaatattccccaataagtttatgatagcaatagaaattagcatattttaaaaatatatattttaaactataaaagtagaattgctctttcagaaaatttggaaaatttagaaaaaaaattgaagagaataaaaattattcataatcccatccaagtttgtttgtttgtttgtttttaacccacttaaacaggtgaatatttaaaaaataaagattgtttcttgcattcattcttatacagtggaaattctcttatgcattaaatagcactcaaaaactttacattaatgttctatcaatgtgtatgccttacaaattccatgatacttaaaaataactttctttaacattttatttataaaactataataatatatttatttaaaagaatttggaaacaatatacaaacaaaagtaaaattattttgaaatgctaccgtgaaaaggtaaaagcttgaataatttgatgtatcattttaccatctttgtctatgtaataagtaataatagtaattactttgtttgatttatattttagttattctacagttttatgcttatctcttgatttacttaccactgaattctctgcttgattacatttttcttaaaaaagtcagattgcaatatttttaggatataagaaacttctgcttgttgtattcatagccaatattttttccaaatagtgttttttgtttttcatatgaaaatcagttttgttttcatatgaagatatttcaaatcttgatgtagtaaggtctaaggtcttcttctactatttcagatatcttgaattgtttctcagctttaaaaaaaatccccattataaggttcaataaatgcgtactatattttctcctagcaattaaaaaataatgttataatgacattaacttgctaagttactttagaaatgcatgtatgtatgtgtgtgtgtgacatgaggatctagtttcttaaatggttaatccattactagatatttgcactgttactatactgttttgttattgcaagtttatagtaagcttaatgtaatagaagaaccactcctttttattttttttctcccaggcatgtcttgcttaactttcatcttgattattcagttgtatctgtatgtgtatgtagaaaagcagaaaaatggtgccatgcctcagtagtatttttttcctctttaacttgagtctctttaatttggtaaggtatttttttagtctcatttttgtttctttgctctccaataaaacatgttttccattttgaatatgtgggttttgtgttttgacccacttctcttagatttgtcttaatcaggcatttcttcctggaattgtactttaaatacctatgtatttgcatacaatgatgtaagaaatttctcccacatctactttcttctcttcttgagaaaacaatgcatatctgttaacaaaatgttcatgatattcatctatcatgggccaagttcatcttttgaaatgtaactgcacaaagtacaatgctgatctaatatggttggtctttatacatttatgtcagtaataattgcactaagcaagcaagagagttctcattgctctagcttccccacgataaaattttgtaagatgtaacccatagaacaccagcctagtgcaaagctctgcaaagaaagggttccttggtggagtgaatttgagaattaattcatacaatagccatattttaccagtttagaataactgttatcatattaaaagctctgacaagttcaacaataaagacttgtttggtttgtttgaacccatcttctcccagatttaatgtatgacataaacatttgctattttttgaagacagagaatattatttggtttgatggtttgtattttattgaggggtaaatatataatctattactcaacctaggaacttacattgaatactcaaatcgggcaggctttcttccaattaatttcagtttccagtgagtcttgtttcttttcagtgtacaatggaagataactctaatcagatcttaagagacaattctcaaggcatgtcactcattggccatttatttgatgattagtagtggttgtagttgaagtaggcggcagtattatacaattatcatacatagtagctctataacatcttgcaaataaattaaactctttatatatcagtttttattttttgtaaaatgggaacagtatcctgcaggggcttgtgtaccacagaaaggatgcgtatataaagccctaaccctatttctgcatagaacagccactcacagaatgatagttggcattctcaataatcattgacaagaaaagttagcaggatatatcccctgctctgatccatctaaacaatggtgcaataagaagtaacaatttcataatgctttgcaatttacacatatttttatgtacgctgttgagagtgtaagcatcaaaataaaataggagaactggaaaatacagtgagggagctgagatcaagtgatacagcatttgccaggaggtgggtattccatgccacagtatacaccaatacagaatgaggacaagcgttcattccttctaatgaggactttacctaggttgggcaccaaaggctgtcacacagttggatggaactgaattaaaacgatatcaaagttcagttcctcagctccaagtgcttgctgagttcggcttcttctctggtaaccctcttatggaatgtgattttaaaagcatcccaaagttgtaagtacctttgtgtcgtgttgacatctgattcatcagtgggcaaacattctgctattgttactggagctctgttttatcctcctggaagagaagccccagctcagcaagagcggtgtggaaatgttggtaaacccctttattactttgagtctagactactgtaattctccatttgtgggccttctaaactgggttatttataggatgcaacttaagagaacaaggcagcccagagccttcctgacattttgtcccttcagcatatttaaaaccatcaactcaatccttatattggttacccataaaattttacattgattgtgaagttgttttacttacacaaatggtgcctccaagatgcgatttcattctgcctgtctcactgatttttcttttgcccaaccctggtcccttttaaagacttaaatttgaaagcttttggtattgtgctatgagcttgaggtgggcatattcaaagttatgtggactagttttaggtttcattgtatttttacagataagctcttatttacttaaataaaatacatattctttacccataagaaaaacatacatttgattttttgttttttttctgttatacacatcatatccaatgtgattccaatatagattccagtatttttctaggcatatcatataaaatgtttaatacaatgagatgtatatcatacttattatttagtagcctacttttaacattgatgttattgtggtctttttctttgttttaaaaactttattttaataattgcctaatattttctcttagaaactctgtgattcatttaattcatttggaaattattccttaagtaagatttatcaagtgctctcactttgcatggtcctgcccatagcttctgaaggtatagtaacagataaagatagatacagctcactttctgtggaattaattctgtaatgttggatattggctctcccttcactttagagtattattacaaaaaagatgactttgagttttaatcgaatcacgaagaatatttgatctgaccctctctgttcatttgtgctaagaaaacaattgtttttctaaaagggtaatcaccttggaaaagctttccatgttctgccctcttttgtagaccttcttcttctgatcatgtaccctggcttggtcattttcttatgaacataaattctgcctttccccttgttccatgtaaaataaaactttctttgaactgcatctggagaatttaggccctataaaccttggccctttgccaaattgcatttagccaccagcttagcccaagaccgcagaatctgtgtccattgctctaggcttctacctatccggtaagagaagttaggaattgagagctaaattaaagttgcaaatatttatccttatcttcactataagctctggatttgcctttcgatgataatgcaaatactccattctttgggtctgtccactgtgttaatagaaatactcctgaaattggaaagaatctctctggttacaagcacttcttcctggtgtcggagataaaccaccattgtggatctttgcatttcttttcacaagcattcctggcatgggtcctcataaagcaagagtgcttggtacttctccctcgcctcagtgaaatatccatgttgtgggcaaaacatgctagtaatatcatgcagctgtcattgggtgacaaccacatgtagatttagagatgactgaggtacctgtctttgctgaaatgtgatgttcctcatgcatacttagactcttttcatgaacattctttaagttgtatgttccctgcttgatggaaatgaacattgtataaaattgaagcaatttaaaaatatacagtatttaagaaaaactcaaattccttaaatatgtcagtggattggaaatctggcttgatgcacccactactaaaattaaactgtattaagatcatatgatacaatgccaggtgtcagctttctgttccttctgtctttagccatagaagttgtattccccattgatagataacatcagactttgcacctaaatgcaatatgtgagatgcaaatttgagaaagcacatggtattttattttaatctttaaaacatataatctacaaaaatataatgcttagtctaacccacatggcaatgtagtagctgaatatggctctagaaatgtgggttgtcatgaaacaaatctctcttctagatattggaaatcagattctatcaggacattcaatttagaaatagtgtttgcatccaactgtccttctgtacagatatgtaatttccatgttttgtttaatgtaaattacaatgtttttatttgttaaaaagagcaatctttaaagcctagaatcagaattgaatgtttgtaatgtaatcgcaattttgaggcattctttgtcatttatctttatagggtcagggattcagatagcaaaggagagaggattgtgcactttggtgtcttttcaaatagaaagaactaacctcaagcggggattgtctgtcttcgatcatatgttatcccagatgactaagaggaaaatctgatccgttcacttatgccacactatttttgatacaccaaagcccttgcaattttacttacaaacacagattaggaagtgaaaggttgattgtttctggcagtttgaaatgcattatgtttgtcctgaccccagctcaaatgaaaatagaatgtttccaaatcttctaatggtcctgcaactaaaattactcatttgaaactgccaggactgatcagtgcaaaatcaagcagccctttctgggttcttcatttggagaacatcagtttcaaggttttaagataatcatctcaccttattatcagataaatcttcttttacatgagcagctactgtctctcaagacagcctctcacttattaaaaagggaaaaggagggaaaagctaccagggaaagagacaatcagaagaaatgtcagtaaaatggaatcaaaagactataagatgtaaaattactttttacctttgttagtcatttagaaccacagaaactcttaaggtgccaagaaatatcgagcccaaagctggcttttgaaataagaggaaaccgaggcccagagaaagaaaatgacttactcagcaaattgggatgatggaggagatgaaactgactggattttgtcccatgatcaaggtttttgacatgaagtctaacctcagcaagattcacagcaaacagacctattctgaaacaaaagattaattttcaatccaattactttctcaaaaaatactagccctcaagtattcatgagatacgtcttgtattgctgttctcattgaggagaataaatagagagccatttggatttcgttagttgtttagtattcctttagcaatttcagacttatttgtgtctgaggaaggaagcctcttatatcaaaacatgacacacaaactaacagctggttttgacattgaacttcagatctagggttggtaagagtatttgcacttactgtttgtaatgtacaaatagatccttgtttaaatcctcagcaagaacagccttgtgtaaagctttatccaccgtgtttcccttccctctcctcccccataaaataaaggaagaaaaacttcattgcagtcactaagcatggggattactggaaagacagagtgactgtttggtttaaatgtaatttcagtgtgtaaatgttcacatctacctaaggatattgttaatggaagcaaaacctaaccccccttatttgattttgcccttcagacttgaatttttctcctaacgctattttgttcagcatgccccagtcctcttcatatgatggcaagttctatgttagatggttcaacaactattgggggtgcgacaggaatagcaacactgattagtgctaattaggtgtcagaccgtttactgtcattatctgaagtaaacatcaacaactctgaaaagtaaatattgtccctattttctagatgaaggaacagaggccccgaaagcctgaatactgtctacggtgccccacagtcggaagcaggaggcctggctttgactctgtctaaccctgttctctccatcctactggactgtcccccccaaggacctccctacaaaccctcagttccaagaatgtcttgagccaattcccattaatcacattgagctagtttctattgtttcatcagtgaattttctgtgttaatggtaaaaaataaaaaataaaaatgcaggccgggcgcggtggctcacgcctgtaatcccagcactttgggaggccgaggcaggcggatcacgaggttaggagatcaagaccatcctggctaacgtggtgaaacacccccgtctgtactaaaaacacaaaaaattagctgggcgtggtggcaggcgcctgtagtcccagctactcgggaggctgaggcaggagagtgctgtgaacccgggaggcggagcttgcagtgagccgagatcttgccactgcactccaacctgggcgacagagctagattctgcctcaaaaaaaaaaaaaaagaagaaaagaaaaaaatgcagaggcatcaagagataactcttcttccattaggacttctgcattcggtttggaagaaaggttttctccagcaatcagttcaccttcgggggacacaaaacgtggatagaactggaggtcccaagagcacctgtaggggacagttcagagcctggcttttctaaatccggctgcttatgcgaaaagttcatgagctcagtccttcagttttcagtcctcacacacatggagttatgatgatttctcctggcccaaatactgacactaggacaagagttgctggggcaaatttgccataaacacccatacatatttcttttcttttcttttcttttctttttttttttttttttgagacaaagtttttctcagttgcccaggctagagtgcagtggcacaatctgagctcactgcaatctccacctcctagtttcaagtgattctcctgcctcagcctcctgagtagctgggactacaaggcatgcacaaccacgcctggctcattttttgtatttttagtagagacagggtttcaccatgttggccaggctggtctcaaactctggacctcaggcaatccggcctcaagtgatctgcctgcctcagcctcccaaagggctgggattacaggcgtgagccaccatgccccatccccatatgtaactttcacgaagcttttgagaacatgtaaaattttccttggatactgggagtggttcactttaaacagaacagataaaataggcatttgacaccataaggagtcagggtggtggggagcaggtgagaggacagcagagagacaaatgataattccagtgctactaatatatatgtgtaattttatgttattacattataattaagatttgttttgtcacactttaatatctgaatgctatcttactttcaaacttatatatgcatgtcatatttccatattttcatagtattctgtacaaatctctcccaccacactaacctcattctctcataattacccatatacatacacacatgtgcatgcatgtgcacacatatatactgcttccactgggctgtgttattcacctatagttctttactgcctggcatattctgagtagacaggcaatgttgactgaaagaatgaatgaacaaacctgtgaataacagaatacaacaccatcacacccacattccatgagtttagctgcattaacccttcttggagtcagagagattggtccacgggagaccagtgaagcatgaaggagtgaggcaaatctggcacatggacatcatatgtgagccactgtctgttaactttccatttttactttacgtaccaggagagcagattgatattgcattttaattgtgtatattagaggaaggcatatggttacaacattctcttatttaccttctggaacatgaaatttgtcattttgttcccaaaataaaggattgaagggatagtgcctgctttttacacaagttcaattctccctcatgtgcaagtctcctgagatgtgtagcaagtcggtgccaacatgaggctggcaccattttcctattgccatggtgatctccagctctcctgaaatctcaagggggactatgatattttaaaagcaacttgaattttggtaattaaaaaggctgcaaagaataatctttctacattttgccagcttgggtaaatatggatagcaagtgatgtctagagaagaagggtattactgtgctttattacgtgggtgaccccgtgttggaaaatgaaaaccgtcatgaaagttatgtgtggagtatttatggcaattcagaaacctactgtgaaatttaaactacatctaatcacaaccttcctacaaacagctactctcttggagtcactagtattttaacttaaaggtatgatgatcagagtttgtttttgttttttttttaatgtcggaggcaatgagtaataatgtaaatgttggcagttatcaaagtaaaggggaaaaaagtgattctcttaaactggaaattaagttagacaagcataatttataccgcaggttaatcactccctccatcacgaaagttcttacattaagggttcttttgaacttcatttgagcaactgcgctctcctagcaaagcctcaaagattaaagggctttgtttcacttgagaagacagttgaaatttttttaggcattcttttgagctataaaatgaatgcttggagtagaggaacatggaagcagacattaaaaggcaaaacaatgtatgggagagaaacccaggctagtggaaagagagtgctttcttgtatctttgtgcatagctttgtatatagaatttatagcggaaaatgatcagcagtttaaggtagggcttgggaaattttttgggctgagtgtgtgttgtcttattaggtagggtatgaaatcttcaacgacagagaaagagaaagggtagaacaatcctcttaaattaggaacttcacaaacaaatgcagattcccaatttgcagatgggcattttaattgattttttttttacaaaaccacctacaacctaatgtttcagagttaaaaataaaccatataactctcaagtgctgtttcttccacataattcaaatctgattatatctgaacaaatcaccaactggaagtgaagaattttctatggatcagtttgattccattgggaaaatactgccagcaaaaatagtttggcggtccccgtggcaaaacttagaaacctgttttcttgttttgaatccctctgggtaagagcccttaccatgttgctcataatcttatttaatgccatttttagctggtatgacctgaagtggaatagccagatggttttgttgggtttttttatttgtttatttgattgattttgtgttgtgtttagcacagagatttggtgattttttagaaaattgttcactgctttttgattagtgaaatattctgtgatagctgacagatgacttgtggagtataaaagcacagtgaagtggctgagaatatcgttaaaggtttcatggctgggcgcggtggctcacacctgcagtctcccactttgggagattaaggtgggcagatcacttgatgtcaggagttcaagaccagtctggccaacatggtgaaaccccatctctactaaaaacacaaaaattagccagacgtggtggtgggtacctgtaatcccagctactcgagaggctgaggcgggagaattgcttgaacccaggaggcggagtttgcttcatttataggatacgtggaactcagaggagaaaaagtcttcccaaggctattttattgcaaaaatatgttaatgttcagactaggctgataactttttccttatatgttctccctaatggtatgttcctgtatttcctgttttattctatgcatttaactgaatattggatttttacattaaaaaaatatgtttatgaaattaaagaagattgatttgggcagcaaattagaacctttttttgttaatagagaaagcatttagtgtgatgtacttgctcttttctatataaaaaataatgtttttcttaattttaaggacagttctaaataaaatctatgctacttaaaagagagttttaacatcccccattgccttgtagtttttcttttcctgaaaatagatccacaaatgtcataaattagtctgcagattttaccttattatgcttcctccttcaaaaaatatgcaggaaagtgattatatgtggtgttcaactcaggactgatgagttggttataattatcaaggcagacataatgaaatgaaaacaactctttctctagggcctcagaggcattttcagtcactatcataaccctgtcacgctgggttaactgttttctgcccaagtagatgtcaacacaattaatttcacagtttcctcaactgatacagttagggttcatttgctcatctgggcaagaagatccacatatgttaagggtagaattgatttctgggtttttcctagacagatgagactgtggaaaatagacatttatctttatatataactaaacggcattttgtctctttttcattagtccttaaacatacttttgttcaaattatttggcatcgccatttgacattcatggcataatttattcactcatcaaatatttatcaagtgccagctttatgcaggaccttttgccaggctctgaggttacagcaagagcaaagcagaaaagccctgcccgtgtgaagttttcaatccatttgggcagtaattgcaccaatatacctaattaacagaaaaatgtaaaaccccactagataatttgcatgctactggtacttgttctttactcctggtataatagatgcttgcttgccattggagagtgttcaatagaacgtcctgtcgcacagtgacgaaaacattctaaactcacatttctaagacagtaggcactagccacatttagctattgagaactttaaatgtggtagtgtgactgaggacttgaatttataattttctttaatttcaactaatttaaactgccacaagtggcaagagggattaccatatgggacaatgctggtctacaatgtatcatcttattccttgcatatattttacacctgaaaacagcacttgggcagcataaaaacaggacagagtatacacaagtttaatttaacatttactccgtgagcttcaaggagcaagaagatccatgagagagtaactgtgtttttggatatctgctaagaaatgtgaaataatgtccttgattttagtgtgttcatagattacaaactaatctttaatttatgtctggaatactgtacctggttgggatattttaaaagtccaatttcttattcgttattgttaccctatgaatcactgagataatgtattaacttagttgattaatataatttattgctataaatcttccccttttgcttatgctagtgcttagtaaaaattgcaaacacattttccccggagttgtattcaatatcattccactgcaaccaatttctaattctcatttcctagagtacatctattgcttaataatgggaaaagaggaaaggaactggggatggtgaaggatggcaggaggaagagggaaggggaaaggaaggaaagggagagagaagaaaggggaagaagatagggtattattggatagaaaaaaaaaaaacacagagaaggtagcttttcttgccaggaaacgtgggaaggttttggccatgaatactgctatgatcattaaagttgctgtcgtatttctcttctctagcatttaaatctccggattcctttcccctgcaggtttgtagtactgagaataatagagcgttttcagaccctacattcctcagctgcttcttgtttgtttctcatctatttctcgccaaagaaggaaaaatgagccaaacaattttctgctccttcccctttccaattggtatcgaggaccttttaactcactgcctcatatgaaacccactgctggccatctgcaagacagaacgatgacgtgtgtgtgtcacctctccactcagggttcacgccttcatattgtctcatcatctgtatttttttattgatgaggacagagcaaagaaaaaatatttctctatcaatttctgctgaagattgagtgtttttggtcacggttaggtccagtaagcattgggggtttggtggttggagagtagatattgttgagactattttagaagacttgctcaagtccattgaaaaagaaactacttctttgtgaatgcatttaaactcacataaatccatctattctttcaattgatataaatgttatatagatgatgccttggtttttctagattctgatgatacagagaaagaaggagaaaaagacaaggaaacttcaataagtggaacttatattttgtcaggcagtggagcatggaaggagactgaaaataagtgcataaacaaggggcaaaagaaaatttcatagagataaaggctaaaaataaatacagagtagtatggtagtaagtggtcatgaggagggcttcctggaagagaatggtcatgaaagttctcttaaaaacaggagcatttgaacttactgtgggtaatggaagaagcctgccatgggaatagctttccaaggaacatcaagaataagaattgtaagatgggtatgattctgacactcagttagaaaaacacaaaagtaaccagttgaccagttggctgacatgacaagaagagaaaaagtggtgtgagagaaggttatagaaactgagccatcactagatcctcaagcacctggaatgtcatttgttcttgttaggggctagtaatcaattaacaggacactgggtttcctaaattccattagatatggtgagatttcattggtgaaactcaagccagaggtgtttccttgaattgtttaatgtcatctatttgggaggaaatccgtgttggcttccagatatcacagaccatttctgggagttaaaaatagtgtccaggttaagagatacttacaggatgtttaaaaatattcttggctgggcacagtggctcacacctgtaatcccagcatttcgaaaggccgaggtgggtgcatcatttgagctcaggagtttgagaccagcctgggcaacatagtgaaaccccgtctctacaaaacaataaaattagctgggtgtagtggcatacacctgtgggctcagctactcagaaggcaggggtgggaggattgcttgaacccaagagttccaggctgcagtgagttgtgattgtgccactgcattccagcctggctaacagagtcagaccttgtctcaaaaacaaaataaaataagagtagtctttaagatcatagaatcagtttgaggaatagcagtagagttgaactttctcatcagtgatgaagttgaggagacaggaagtacctgaatctcgaaaccctgctgagaacagagttcttgctggtaagacatagaaggaatgattacaacatagagtgaaaatgaaaaatgttgtaagtacctgatttttcattaagcacctcatttaattgatctggagtttcaggtagcatatgtctgtgttttggagtttattttagggataaggtacaaatttccccatttaataaacagctgcctgctgtagtggggcacatgtatctgggactcctgattggagtgaaataaaacaatatactagccttgtttctgattttcttaaaattaactaaatttaaaaagataaaaagaggtagatgagaggaaaagaaaaaaataaaaatacgaaacaacagtaagatctttcaatcttgtttactactaaaataatgtctggtacataggagataatcagaaatatttatcaagaagggtagaaggtgtaggtaggaaatgagtctgttctctgcaatgaaaactgcagcacgtaaaatagcataagccttcacttttagccttgaaactcaaattgaatagttaattagtgaattaccatttcattgatgaaacggggcagtggggcatttttttcaatctcttcatttgtattataaatctatgcagaagattgatgtgggtttggatcatcatcatgaggctttattttaagtagcttaatcaccgttaatcttttggggtaactttcttgtgatctaagtatctggtaggtctccttgtctataaataatttcttatgttggattagggtttctataagacttctcatttaaaaattccctactattttctctgtctgagaaagagtatgtttctgatacctggagcatcaggaggtcatcaggatagaaatgagacacatcaatgtgttccttcaaactgtcattggtgagcatgtgcagtgacccaggtcttttggcagatgccagggatataagcaaacctaggatcaggcatctggtggtttgcagactagtaggagggaaaaatgcagaactattaagtggtataaggtggtaaaggcaccatgaatggagtctgtcaacagtgcaaacagagatggaatgattgattctacttggacagattaagaaagatttcacacagccaaactttgaaagatattgtggaaacaaataggaagatgatatgctaggcaaacggacatggtttgatcaaagacttggaggcacgaggcaaggtgtgtttcttgaactgcaattaatgacaaggtcatcccttgtcagtgcagtgaaagatgaaatctaagatgctgtccaggccacatcacgcatatgctcctaaaacatactgagcattttccactttccccatgactgcaggccatggggagtcattaaagggctttaagcagaagaacgtacgattctatgttcatttttatttttaaggaccattttgataaaatagagcatggaaagagcagtagtcatttaaaaaattcttttttatatttatttattactgaatattaagaacctagtatgaatcagcctttgtctacatgcatggtataaggatatgaaccaggaataaacattcgatgttgagcacgctatgaccttcagacacatcagatgaaatatcaccttatccaaaaagggccagtgaataactgttcatcccaaagttctctgtttaaatatagtcttaggtccccagtgagaagtgttcccctggagtcactgctgctgagcatagttaggccacttgcatgcaaactggaggagtatgtgttatacaagtccttattttcatcaggtagagtagatatcacatggtggccagtttcgacatcaaatccagtgttactctgtaatgggaactcaattttgaactgcaggtatatatacatttagcccatgctgtaattacatctgatcgtgtaccaggtaaattgattggctgttttctcccctcactgtttctcatagattataggcactagagagtcctcatcatctcctgaagtggttctttcccgggaatgcacatcaggatcatgaaaggagcttttaaaaaatatgcatatttgggtgtcgcccagaagagtctggttcccaggttagggatagagccgagagaaatttgtagtgttaaaagcttccttagggggcttctcatgcatttaccctcttggaaaaccactaattctaatcagatatctcttacaacacaactaagacatagcttgttagagcccggactaaaactccagttccctgaggcccagcccagagcaatttctgttatattatctttacctgtgttcatccacgctgccctggaccttgagccaagacatctgtgtttgcactcctttcatctggatggtgatggcaggaggaaaactgcaatctaagtgcacttgtcagctccagctgctataacaaaagatcatagactgggtggttcaaacaacagacacttatatcacacagttctggagcctgaaagtctgagatcagggtgccagcatggtcaggtttttgatgcccttgattctcaaatggcaaggaagctgggggagaaggggacatggggagggaggagaggggcagaggggaaaaggagggatgggaagaggcaactctttctggtcccttcttacaaaggcactaatctcatcatcaggaccccactatcatgacctcatctaaacctgatcacctcagaaaaccacacctccaaatgccatcacattggagggctagggcttcaacatatgaatttggggaaagcaccagcatttagtccgtaatgctaagagggtagttcccaaccccgactacacattagagtcatttgggaacttttaataatatactgatgttctgggcctagcccacgagatttgcatttaatgcttgccaggcctaactcttcatcctgttagtgatgtaattttacttaaagcctaaattttttcgtcttcaaaatgggagtgatgttacaaactatgctgaagattacatgagattacagatatcaaaagggttgctcatctctaaagtattgtaaaaatatcattttcaccttaattaacccactttctttctttgatgagcagcttcaggtgaaatcagtatttcaagatttatatatcagcgctttaaagaccaggttttctggtagccttgaattggaactgctgctctcctgaatatatcaggaaggcaatccagcaagagggcatagcttaagggtcacaaatttaaatatctacagggcccaggcaggtcatataaatgaggaaagagagggctggctctagaaaaatcattcactgcttcattcggcactctgagtcacttctaattgcaatacagtagagagaaatgtctctctactattagagaagtaatagtgccaatatggtgacaaatggcagctggcatttgcctctcaggactgggaaaacagagactgaatgccccactgaaaggggcagctgtttacactcatcccagcgctgctcgatcattgagttttgttctcccagagaatccaaaatccaggcttttatgtaaaagctcctgatacttaagtgttagtagctaatataaacaaaacaaaaacaaaacagggagcatttcacaggctaacactgactggcataaataccacatatgtggagtttgaatgtttcctgtgtgccccatttggcctgcacactgtcagttgatgaccattacttcgggccttatactctacctcacccatcaactaaggcattgcttctcacatatattgtttatccacaaacaaaatacattgccgtgctggcacccagttggcaatttctggcgtggatccttatttccttttactgaattgtcttgcatttgtttctagggacgatagtcattcatgctatcaatatttactgagcagatactgtgctagataagaatgcaaaatgcaataagatagagtccctgccctgtgttgcttccagtctagtctaggcgatatgcccagtgtaataatgaggcctcaaagaatatcgtggaatacagaatgaagatagctaacccacccgcccctacatagcccattgcttttggttctttttattataacagaaaatgtacttctttttcttttacccagttttttttccctcttgttttagagcgcttggccaacgtattgagcctagtgtgtgaagaccacatcctagcatgtgacgccacatcctttggctcttttgatgtttaggaaatatttggtgcccagaaggtcatgctataaaactaaaagtcatatcacccaatgtcgcgctaatgcttaatattgtcaatattttacttataatgcataatatgaaaaagctactgtcagccagaaacaaagcccactgggtgcatttggttcaacatgaggccctagctttcatatttcttattctagtttttggtgctcagagatgccaagtggctcatcttggggactgtctcttgtagcaggcatctctccaggggagtgtctcccaaactttgagatggttatctgttaatcgaaggaaaaataagttgtgaaagtaggccatgtgcaccaccaataaacatgaaaatttcgttggcaagagccctcctttccttgccaaagtgaccttggttggcgcaaagatgacagagtgcttcccttcccaggtctgacagcattgctatcacagcacgtttgacaaatcgttcacattaaatcggggggcactttcggcagcgccgacatcccctctccatcactcctgattaccacacagacgtcaaccatggcaccaagcacatttgtcacagggagtaaaaagcagttgttagtaagagcgctacctgtcatactaatggactagagcttgttgcttcgtgtctcacaggagcctacagatttgcaaaaaaaacaaaacatgatttttttggagggttgtccagtgtttcctgaaaatgcttttgtgctttgatagagagaggtactgaaagcttgtcagatgggacacccaaacgccttctcttggaaggggaaacagattctaattttttaagtgattttgctttttagtgactgctgtcatttccttgtggccaaacaaggcaatagcaagtttttcagttgaggaaatccacaccctacacattttaattaaataatgtaaaaaaatgaatggagtgattgtttgctattcatgagtaagcatgctatcctcatgctgaaatcgtgtgaagtcatttgaagtaggtaaagaataggtttttttcttgctatcatcacttcctttagcatgtaggtgcctcatgtgtcattcatacactttgtttcatagtctggccataagaaccttcagagtgggccagtcacacactaccatacccattgtacagataacaaaactgagaatgagaaaggttgttgcccaggattacacaagtagagtcgcatttcttgcctatgcctgttgactcaagtccacaatatcaattgtacttggatatccaatcaaaagtatacaacttgtttaaatgtggcctgtgtgggccacgcatggctgcttcataactctgtttccaagccattcttctcttctccttaagttcctttaccagtcagtatgaatttgatttctgccttttttctttgcctgatgatgcaaaaaaaaaaaaaaaaaaaaaaaacaaaaccttacctagaaggttttttagaaattagagaaagaaaagaagagtactgggtttggaacttccaacagactgccctttataaggtcaagtgaagactaaatcatggtttgagggagtgaacttccggtagggcacacgaaggggattgttgcgttagaatttgaggatccttgctatactttattctatcttttgtaggcccatgagaagccactttggctctttgatgagataggaaaaaaacaaactgtttttcctactctcacatgttcaacacggaatacttaacttctggtcaccaaaatgtgtggagatttctccctaccagcaaccaatcaattctccagcagaccccagctgggagttctataattcaattccaatgctatctacatggagatagtgttagatcccacaggttaagggctcagtcccacaagactgtccccacttcagatgccaatcacaagccccaggttgtgacgtacacttttgatcggctataaatcaggatttctacaagcccctctcttaaattcaattaatttgctagagtgactcacagaactcatggaaacactttaattacatttacccatttattgtaaagggtattacaaaggatacagacaaacagccaggcagaagagaagcataggacaaggtattggcaaggtataggaggaaaggggtgtggagctttcatgccttccccagaagcaccaccctccaggaacccccgtgtgtacatctatctagaaactccttgaacctagtccttctgagttttgttggaggcttcattatgtaggcgtgattgattacatcattggccattgttgaccgactcaaccttcagcccttctcctctctccaggggttgggggtgaggctaaaagtctcaaccctctaatcatgatctttctggtgaacagtccccatcctgaaacaatctaggggccccctattcatctcattagcaaacaaaagaccctcatcactccagagattctaaaggttttaggagctgtgtgccaggaaccaagaacagaaagcaaatatatattacttcttatatcatatcacaggcttcttttgaattcactcttccaagtactataataagctagagtgataagcttgagatgggctaggttgaataaaaaacttgttaaatgtttgattcctttcttgttttattacagaagtcttagataaatgtttctggatgatcaggctggttcatttccatgggatattttagttaacatcaattttcttttcaggggaaaatatatgatctgtgattggctcttcattacattcttctcagattcataagccaggaagcctcaatgtattaagccctctgattcaaaaggagacagtcccttataagtgcattcattcgtcaaattttattacatactttctctgtgtccagcactagactaagccctgggaaaaccaaaggaaatctgtatctcctgctgttttaatgtagattatcttacaggtagaaatggtcatctactttgggcatgcccactatagtagctgtaggccttcccaaaatattcaccttcataataaccttctgactattccccaggggttcacttttcggattctactttttcccattcttattctcaataaactaccacttatagtgtacccttttcagatcagactagcatttgacattatcaatatctctacttttttttctttaataccaggtttcctttcatgctgcaatatataaaacagatcaaagaggagcaaccatgggtgaaacagaggtgtgaggtgcccagtgcccacaggctctggtcccctgggaacctccctagaatatacagtcctgctagaaggtggggaaaaccttggtctaggttgcatccaggaggtgccacagaaggaggctgcatccctccgtggaccccaaccctctctgcttggacacacctacttgagcaaggtggggttgagatgttcatgccagcaggaagggagagtttttcaagaaagttcagatagggaagtagttagaggatatttaacaggtggattaaatgatggcttagtctgttttggctgctataacacaatgccataaactaagtagtttataaacaacagatgtttgtttttcacatttctggaggttggaaagtccaaaatcaggttggagttggtatctggtgagggtctgctttctggttcatagatggcgcctcctcattgtgtcttacatggtgaaaggggcaaagcagttctctggggcctcttctataacggcactaattccattcatgagggcttctccctcatgacctaatcccacctcccgaaaccatcacatttgggactaggttttaacatatgaattttggcgagacacattcagaccatagcaaatgataacaagtcacattttatatcatgttccaaatactctgaagtgatttcatatatatttgactcctttgatccgtatttccaccctacaagtctgtctcgctgttcattttagtttacataaaaaatgaattcacaaagtcatgtgcaaggtaagaatttagcgagttactatttgagccaggattcgaatcggagttccagtgtctgactctgttctcgtcttttgcccaccacaacccccagctcacaacagcacaatgtgtcctaaatagagctgatccttgccatccattgctttctgctcccaccccttcattactaaccttatagaagcacatatctacctgtagcgaggacagtttccatcaagacacgcatttccatggaaacgaactcacccaacccccaaagataagttaatgtggcatttatttaattttcgtaagttacattgccttattttctttacatctaggcatactgcatgatttttttaaaaaaaaggctcaggaatgtgaccctgtgttaatttccatggctacatacccaatcatccaacagtggcttggtggcatatgatatattcaatatatttgaaacactgctgcatttaaaaataactttaaaaggttgtaaatgtcaaattgagatttgaaatatgtcagatagctgtcatttttacacccttcattaatttcaattggactcagtgaattggatttgacaaactgttatcatacattgactacaagcatgctacatttatgtagcaaggacctgacgtacgggatgttttgagggaaactttaatatatgacttctctttgacctcctagatgacatgagaccatcaaatgacaaatgtggcagcattcaactctaagattttccaaatggtggcatttggaaaatcttcaagaggcttattcagaaatggatgtgtccactggagagtttccagtaacaaaaatagacatatttgctttaggtacaaaactgcacaatttggattccagctaaggaaacagggttgtgaataaaaatttcctgttggcagatctcagcaggtaaagacacgcatggaagagtcagatctgactataaaaatgctatcattattcaaattaatagcaactaccaactatcaagtgctatatgaagagcatgatccatagaacataatgcttaaaaacccatgttctggtgtcagatcgtgtgggttcagacactggctccaccacttactctgtaacactgggcaagtcacttaacatctagatgtcttaattttctaatgtgtaaaatcacgataataaaattacttacctcatggggttactatgaggataatctgcattcaataaatctgttatcatcacaaaccagggctgtactaggtgctctgtacatactcatttaattctccaactatgctgtgagatgtatattaccagtatcttgctcgtttaccagtgaagaaatgaagactccaaaggttattgtgtccagaattaaccacctggtaagaggtagaggctgggatccaggtaactgaggacatcttgtaggtcagtttgttcatctgtaaaggttggtaattgaacgtaaaggtcccctgatatcaaccattactagatgcaatgacactaggaaccagcccagtgtcacccactgagaaagatgagctacataaatccaagccccaggtcacagaaagccaagtttatgctcgaccaggacaggacagttggtttttaaaacatatacatcctcctgtttgctcccttttcaagaaaataagtcaggctttatgtgtgtgtatgagtgttagtgtcatattttaacacagctataaagaaaataccaataggtaaataacctgctaagtatgtttttaaaatgcaacggtggaagaaattttatgtagaaatgactaattttaaaatcttatatttctctaagttaaaaaaattattcatgtttattgcttgttttctttttcttggctttagtatatagaaaggtatttgaaaatcaaccagatttttataataaatcagaattttaaattttaggaatctttagaaatcatagcatccagagtgttcttgcattcctagcttgtccaaatttacttgcttttgtctggatgaataaattacataactggacctagctggagggtacacgccgctactcaactgattatacctgagggtatgccaatcttctgatttaaaacatagtacctgacttttatgagaaatttcctatcttttgaatgtctttaattcaaaaaatgtatgaacacggtaacggaataaacaatatctgtctgcaagccatttttggcccctagtggattattttgtcaccctaagtctcatccctttccctacgttttgcataggatcctctccttcacccagcgagaaggccaaggtcaacttttggctcctttggggtcattcagtgaggtggtagtaatatacgaagacagccccaggccccaggcttctgtgccttggttagtttcactacattattctgctactttcacttcttataagacaagtgtaaagtagtgtggtctgttaactagagcaagagaggaaattttttttctttgcttttatatttgggaagtagaaaacgcttttagggtaccttcataggctaaggactgtgtgaaataaaaggaaggctttccagcctgtgtttttctggttgcatgaggaagagagaagcacatcaaaatgagcaagaatgtgtggcctaccccaagggatgggtaaataaacaaggagaaatggggattgctgggagaatcaaggcaagtcacttccagcttcatgcgatctctgtcccctggcagttagtttcttaaatcacatcaatcccgcatccccttttcctcccattcttccacaaggcaagcaggaaaccctcctagagtgtgagagagggtgatctcccctatctgtgcacttcatcgtcactgacggctctgactggaagcaaatgctgcctttactttatctcactgtgggggtttggcattcttcatataagttatgtttatgtaaacgaggactctaagggtgaaattataatttatgagaactgcatggagctcctgacaatattcataaacattccaaacaactttatctcgattcagaacaaaacatacatttttgtcacctaataaggatttttattataacaatatttctattctggactgtcctgttaccgtgaataatatggggtggggtgaattttttttctatatgtttagaaatatttgttcatgatgattcttccttaagaagtggtgggcagtaaatattacccttattaagtcttgctgatggggaaattgactgttgatgtcttttagaatgcaggtgttatttctgttgttggttggttgtttttatttcattttgtgtttaacaaagtaattagcaagtcgtagatccttgaacctgagattgacactccttgactcatttgccctttgttagttgttatttattgtattttttacctctgcaaaaatacacagtaagtgagatatctttagttgtgttgtaatttcagaatatgataaatgctctagctggcattgcacagatttcaggtggggcattcagagggggacttagacctctgacatggcagacagattttttttgaacctttagtaccatcattcaataaacagtcagaatatcttagttataattaagagagacaaccaacagcccattttgctccagagtcactcatcacttaagaaaaaaaagaaaggcaagcaatcaccaattagtttgaatgttaatattccttttgctggtggtggaaatagagaccaaaaccagctcctctttacctctgttaatccatttctacttttgatagaaaaaaaatccaccttttttcctcctaagaaatatttgaacaaaaggccattagatagaattttagcttccagatttaaatgctcattcaagaataaccatgtaatcagctgagcttgcgaagaatacacaatcataaaatcatttaattaaattccatcaatgctgtttgttttggtgcccatttgggtattaataacaccgttgctgtttttaatgccggaggtttaccacttaattattatctttgcttattggagatgttagcatcaatttgtagggttccataatcacaccctagttgttgcttcaccagatatgatgcactttccagaactagaagtcctatagcctgtgcttgatctaaagatgaagtggtggaaatcaaatgaaaacatttgttaaactgtaaaaatgtaacaggaaataagagcagttattcagactgtgagtaaatttgatggggtgtgaactgatcactttattgcactttgtttatagcattcttgccatttgtagagatggcagtccaatcctcttcattgtcttaattagattaggaatggattaaaggagccaaatctattattaaaaaggcaattctgctgtgttcctgaaaaccctcttttggtttttaatttcttaaattccactgatgcaaaatagcaaatgccttacttgtaattatgagcatgtatgcattcatttaaaaggctgtaagggtattagggaaatcaaatcttcaatattcttcagaattatttctgaagaaataagggaagggaggaagagagagaaggagagagggaggggatggtgggctgcattgcttttggctgtgatgaatgtgaggaaacaaacagtgtaattgtgtaattgttttcttcttcttttgatttactcaaacataaaaagggcaatgcatgtttatatgaggcaataatttttccagttacatttgttttttttaattcacttccacagctaaagtatttgaaaatgtaggtgtctcttacatctgacttagattgagcatttgttctgtagggaggccttccatgatgattatctggttttgcattttgcatgtctacctctctcccttgtgcctatacacatgcaactttcagtttaaagctttgtgatataatctgctgtaaacattacacaagtattgctcagaactccagttggagcagagcttctgtgttggaaactatggtgctttattttttccagtgggtgccctagttttaagagttgctttttcccttctttaaattgtgtcatcttgagatgtaactttttaatgtattttctctgcattttaaaatgactgtatagtcattcatagtgctacacatctgaacacacacatgcatacacaaatgtgtgcatgtaaaaactggtgaaattccagtaaagtctgtggtttagttaatagtgttacaccagtgacaatgttctgggtttgataacgtactatagttacgtaaaatgatcttggagaaaactgaaggaaggctacatgagaactctctgtttttgcaacctcttgtgtatcttaaattacttcaaaacaaaaagtcaaaaaattcaatgtattgttttagtccattaactactaaactgctaccagaaaatattgatctctatttgatctacattaaattaattctgttttagtaactgacattcagatgtcaccagccttttgcagactcatattctgtcgttctacctctgtgtattttgcaagcatttcctacccactcaactctaatatcccctagtagaggcttcgtgtttgaacagtctttgtagccagcgagcctaatgctatgctttaaacattgtcttcacgggcatttaactggtgaatattcaaatggaaagaaaagtcatggacgaatggttaagtaaaaaaagaatcactgtgctagcacaatgcttgctacacagtaaactctctgcctatattcagaatgaaggaataagttaattaattaattttgctcacatatgaattttgtaccttagcaagatgggacccagtgatggctgagccatctgttcttttaagtactttgtgatggacttggattctgaaattgctcattaattgtcattgcttcagtatggtgccgtgcttgggattggaggtcttgaagtgatacctaatttcggaggactgtgacaaaatttatcactaattacctgcccctcaaatgggaatcaaagccatcagcaacatacgatggtgataataatggttatcatttatcgagtgattagtattctaagcactttgcaggtattccctcgctttaattttactccattgctagcttagagttgagcagaaccacttgtccagggtcactcatagttggcttgtgggtgggtggcagagctgaagctgaacccaggaagcctgactccagaggatatgctcttaccaccccctgtaagctctcccctcccattcaggcttgtgcccttattctgttaaatggtgagtagttatcaacaccggagatgcattagaatcaaatcctctgggggcttcttcctggacctgcttccatatacacttattcattttgtcttcaccggacatgttaaacttccagagtgactctaatgtgcagacatggtgaacatcattcgcttagctgcatgtcagcgctcactcaatgtctgtgaacagtgaaagctacttattctacttataagttcattaagtctgtgtataactattgcaaagcagaatagttgtcccagccacctgtgtttggggagatgaagctgggaggccatcaaccttctttgcaataaatttcctcacgttttgtcaagcaacctgttttttgtattctcagctagaggctttccatctctatcccccaccatctgtcaccgatgttcatttgagtaccattttacctgtataaatgtgtcttattttctccactccctctccccgcaaaaagagtttctatactaggagtcctaaaaatttacctagttagggagtttaggcagttcaggtaaatgagtgaagaagacaggtctttgagtagtgagtacccccttttagaaagacaattggggtggttgtcactgaggcaaactggggagtgtatatttcatttctaggagcactcactactcaaagcccatgacatagccacgtggaaacactgcccagtgttctagatcttccagtttttctggagactacagaaatataattttccatttcttttgcttggtttttgttttggttttctattgtgaactggcttgcaagatagttccatttgttttctcatcactgtataggtcaatattgtgtcatcagtaacaatgtgaaaagacatgtataactgaaaggaagtagcagctttattctgctaccttttcacatttttaaataaagagttgatctttctttactaactaccaagtgcaccaggttccagtctttgtcagagattggcattctgactctaaacaaggcataaaatttggtggatgctgtttcctcatctgtgaaattgaacctagaggagggcattatggaattacagggcacattaaagtcatggtctctggagtaagactggtgtggatgggatcctcttgctactacttaccagctctgttcttttaagaaagttatttagcatcccctacattccctcatctgtaaaatggggacctgagacattgactctcacagttgtcttgaggattaaaataaattgtgcattaaagtgcttagacctagtaaaagcactggccctcctgctaataaaagatatacttaatgcatgcaatgtttttaatagactgcagtcaggcaaaccattgcctatgactttgtcctgtggctcttgttagccttaagcattgggtaaacttgctcactctgactttgctacttctttcattggcatttcaagacctctctctgttcctcccccttttaaaaaaattaataggactgacagcttcatggtaggtggacaaaaattcaagttgcataactcgtttctaccaccactaatgtggtccatactgatctggaggttatgctgtagaaccagagaaaatctctttgggatgattagaagcaaagtgtgattaataatgaatatatgtatgtattttaagagtagggttgtgttaaatgtgaagagtcaataaatgcctgttaaccttctgagaggtcaatagtcggccgtgtggttagttatgcagggcagcctgagcatctgcagtctaattcagacctgcccttagatctgacaatggtacatgcaattaggaaaatgtctccctaataatggtaatcggtgtaaaccaagaggacagggcacagctgcggggagcacttggagggggaaatcagaacaattgatacattcccaagaagcaagcctcaagctatcccttttcagtagaagtctgcagtacctttcaatttgctcttgatcataatttactgaaaagcattttaaaaataagtgcatgactcttaaagactgttcttggctcctttttatttttaacttgtgaataggttgggattatatgtcttcctttttaataaggctattgtggatttaaatatctaacttaaaccctgttggctaaaactttgctttttggcttttttttttttttttttttttcaagaactgagctcaaaatgtgctatacaaaagctgtcttttgagaacatatatcaattcagctttgcctcacttgaaatgttgatatttgtaaatgacagagctcccactctagacttacaatcctctcctctttcaatgctccagagaagcaatcttgggaggagaaatgttttgactcatctttgattttgaaagaggtttagagctctggtctcctttcatgtctcaggttattttttggtcttccccatccccgattttcccaaacccctaaataacaaacccagttccttggtttctctcctttaaaaagataatgtttcaatttacaaccagctctgaataattaatgatggtaatgatgtgagaatattttgcatttatggctgctttagattttcaagtcccttttacatccattttcttgcagatcccaatatcaacactaagaagtaaggagagagacaggatggaaaatactttgaacatttatttatcctttgatttacttatccattcagcaagtatttaataagtgatgatgtgggccagatattatactcggagcaaagtctacaacatgaaaaagaaagacaaggtctccatgcattttgttggaaggaccaggcattaattacctaaatgaatgaataagaacatttcagataatgataacttgctgtgaagaacataaaacaagataatgtctttgcagagaatctactgttgttacttcagatagagttgtcagagaaagctgtacaggggtagggacatttgagctgaaatctaaatgaccttacagaggccatagtgtggtctggggagagcctgtcaaattcaaagacgctaagatgagaagaccgtggagagggaagagtagcaggatccagggaaaggtagggaggggccaggtcatttaggaccttctatgctgtggtaaagataattcagaaccattacttcactgcctgcactatttctaaggggataagaacttccccctgattgggtgtaggaatggagaaaggccatatagacacaagtagactcatgcaactaccactgcactgtgagctcaggaagacactacctcattcattatcacatccctgaacccctaggatacctaacataggtaagcaattaacaagtatattggataaactgagctgggttgtgtcaaagtgtggccatggcccacctgcatcacagtcatttagggacaattatttaaaatggagattccaaggcttcacttgcaggcttatgaatttggaatttctgagagtagagttgttaacatgcattttcaacaaattctaagacacaggaaatttgagacttggcctcatttttacttctcacaagaagttcgtactacattataaaaatcttaaaggcaaacatgtttaggctaatatgtgtgtatattcatgagagactcctgctgacagctgcatgtgtttacactattttatatactggatcttaataagattacataagtgtttcaattttttacatacttgcaatttatctttattaatgcaagcaaagtgagtgaaattaggaaattaattatattttgacttttgttctatttggtttatttgattttattatcaaaaagtaaacagcagcttggctgagggagacatgatgagaagcacccctctgggctattcataccatcaaacctctgaaatccaagagctgaggactgaaaattttgcataaaagcgtagcaatataaagcatgccatgctttaaaagctcatgttgcccgcataaaccaacttttttaaaagaagaagcctcagatgaaacaatgaattgagattcagggtaaactacttctggccaagttatttccaaatactggcaaaggtatagattcctcactcactgattcaaattttagaaagaagaaagaatacatagaatattaaatgagccttgggacccatccttagacccaccattatttcttccataatatagagcagaggaaaagaatcaacattaagccattccacaaggttcaggggtgagtattattccagctccaggtacattgtgtttttgaaaatccatcatacactgtagacatgacaattgctttaagtagcatttccagggatgaaaatgacaaacacgcagccagaaagagggataagtcttgagagctattttgctgtgtgcatattggaattcaaacatccaaagaggagaccaggagggtggggattccttcatctcacctttagagtttttgttttgtttgcttctttctgataattccttcttccacggtcttgtcaaagctgcattgtgttattatcagtttgttcttgctgctgcttgacctgtttcctaacaatgtatagttgtctgtacttgtggcagggaaaagagaaaaggcacttttgttgttttaagcatttctttaaaacatctcttaaaatcttgttccctcacccccaaataaaatgttgcagtaagacattgtataagatagcaaaagagtgatatttgctttttaggctcttagctcaagaaatagggctgctattttttgtttcaaggccaactgctttgaatgtagatcattgaataagtccccctcctctgaaataaaaaggagactgcatttgttttattttctaatactaggttctatctattattatttccgttgtcctgttctgttcagcaacatgattttgacagagaattaccagggaagaccgaattctcttttcccaatttgttgtgtttctctttattatttcaaaaaacacataataattttttttaccttctttcagattccccactcccagtcgatttatccagtgcaatttcactttcttttttaagcttaccaccaaaccagtcattcttacaatcttgctgtctgaatgctacatcgcagccaacaggattttgtttagcctgcacagtgattttttattactgaatttgaatggttttagatgagcaagctccccactatgtacaactacctcacacctggctgcttcacattgttctcggaaggaatcctggcagtaagaaggaatctagcaagaacaactcttgtattgatcttttttgttgttgttctgtttgcacaactgcaaaagagagtgtgtggaatactagtggagatgctgattgttttggttttgtttcctttttaaatttttttcccattatagtaaaatgaaatctatcccttttgggagatttgaacaatgtatttaaaagttaggtgtttttccatggtaagataccatctcacaccagtcagaatggctattattaaaaagtcaaaaaataccagatgatgatggggctgtggagaaaagagaactcttatacgctgttggtgagcatgtaaattagtttatccactgtggaaagcaatttggggatttctcaaagaactaaaaatagaactactatttgactcacctgtaaacattactaagtttatacccataggaaaataaatcattctaccaataagaatacctgcactcatatatttattgcagtaatacaatagcaaacacatggaatcagcctaggttcccatcaatggcggattgggtaaagaaactgtggaacatatataccatggaatagtacacagccatgaaaaagaacaaaattatgccttttgcagcaacgtggatgcagctgcagatcattattctaagtgaactaatgcagaaatagaaaaccaaatattgcatgttcttattgataattgagagctaaacattggctagtcatggacataaagatgagaacaatagacacttagggctacaagagtagggagggaggaagccttgaaaaactacctattggatattatgctcacaacatgggtgacccattccattataccccatatctcagcatcacacagtatacccttataacaaacctgcacacgtacctgaatcaaaaacaaaagttgaaaagaaagttaggtggttttcatgttttatttgccaatatttaccatctaacttatgtactacatcttatcctcccaaagacaaaaatcctgacatataacaagtttctcatccacttaaaagctgtgttctgagctcttgatattttggctctgccagttataacttcaggattcaagaacttttccttaacaagaactaattttgttcttttaacttaaggcttcataacaagaagagttgttgggaatgacaaaatataatctataatatgtttagtaaacacttaggtgaagtgtttatctgtagatatgtaatatagagagctataaacaaggtactagttgcattgatacccattctgtttcattaagaaactattcaccctcttaactaagtccacttcctcttctttaatcacctagttctgagttattggctgattttcagtattccattccttgaggcctcatttagcaaatcacttccttaaatcatggctgttttacccccaagcagagagctgtcacttcaccttttcacagggagacatgtttagactttgagggctcatcatcatcagatatattctcatcgtagcaactcctcttctgaatttgctctttgaacaatgtttgcaaagctagactaagatgactttttgcatactgcctacaacagctatctggtattaccaatacgtttaattttatgtgtgatcgtgtggcattgtaaaatataagaagaccattccctggctacagtctctcccctactattcagattttttttcagttcatgtttaccttaattattttattatcacataccacctcactgaagccatccaaaatgttattattaataaaccattacttatcaagatttttagggactttatttaaaacaatgcttataaattatgaaatatttgctgaagtgtatgtgtgatcattttttatgtgtctgtatatcccagataaggaataaacaaaggtagaggtaaaaaccactataagttagataaggaaagtctgctcagatgtatcagttatctattgttctgtaacaaattaccccaaaacttcatggtttaaaacaataaacatttaataattctgacagtcctgtgggtcagaaatttgggagtgcattaatggggcagatctggctcagggcctttcatgaggtggcagtcaagacatctgccccagctgaggtcatctgaaggcttgactgtggcagggagaatcatttttctgggtagcttaattaaaatgactggcaagttgatgttggctgttggcaggcagcttaaggttttccctgctggagtccctccatgggttgtttgaatgtccttatgacatagcttgcatccaccaaagcagcggagtcaagagaaaagaagaagacatctcttctatgacccaaccttgggacccatccttagacccaccaatatttcttccacattctgctctttaaaagtgattcactaagcccagcccacattaaagcagagaaagattaggctctgcctttggaaggaggaagtgccaaagaatttgtgagcatatttaaaaactactacaccatatttctgtaatggctaagttttatgatatccatatcttccacaaattgaggtggattgtcaatgtttgtctttaccattctcaaaatgtgatcagaaggccaccgagagaggcaaggttcctcagttacataaaatggtctcaggttggacgatattatctggattttcatgctgtgtgtttctgtcctagcttcccaaattggctgttatacttaatagaactaaaaccattgattgattggtgtcatacataaaacaattccagtcttccttattcatttgggtaagtggtcgtttttaaaaagaaagcagaaacatgactaggtcagtagcttataaacatgaattttgcatatgactcacctggagcttttttaaaaacaaacatttctgggcactagcccagatgtactcaatcatgagttctagggaatggatccctgggaattgtgtgcttttttaagttcggggtgattctgatatagccagttagaaaagttggaacaactgctatacacaacgaaatctaaaaagcactcgaaaaggacaacaccaagcaaaagggaaatcattggcactctcatgataatcaacattattttgctttcagaaaaggctgggtctgggtttctaggcactttcccacaccagccccaactgacaaggacagtctggttctgtagctgcatccccaaaggcagtaacaccggggccgccacagtggtaagctcactggcccagaaatgcatttgttcacgctttcccgaagacaatgactctctttctgattagagttgtcctcccttttacccagaggctttccatgcaaccaagggagcataacaatgacatgagggcttggaaaggaaatgtcttcattgatttttatttcatgaattggagcctctataaaaatggcaaagacatgttttacagtgtcaatttgtggaatggaggggaggactgttaaaacccatccattttccaaaagtttaaaccactctaatgaattaatccatagataatggattgaattcagtgcaattaccctagtaagtaaggcttgttaaaaagagataaggcaacacactaaagaaaacagcaatttcagctattaactggatttcatctgggctctgataattcagtatatgagttccctttgaaaagagagaatgtgaggtcctattatcaatgtagctaccagatactagagttcacctgctgatattaaactgcagaaaaagaccataagatgataattctgacaaccattttcccaataacctcaagatatctaggatgtatatttgatacaccccagtaagtctttataaatacaaggctttgattccttaagacaggaagctcatttttgttttgactctacttctttttttttttttgaaacggggtctcactctgtcacccaggctggagtgcagtggtgcaatctcggttcactgcaacctccacctcccaggttcaagtgattctcctgcctcagtctcccaagtagctgggactataggtgcccaccgccatgccaggctaatttttgtattttaatagagatggggtttcatcatgttggccaggctgggctcgaactcctggcctccagtcatccacctgcctcagcctcccaatgtgttgggattacaggcgtgagccaccacgcctggtccgactctacttcttatgaatttaaattatcctagttacatacagagagatccacattattttgaataaactgctaaaaggaaagcctcaatgggtattacataaagtaaggataatcacaagtatattttgtgtttgtaaagaactttacggtagaacggcagtgtctttccggattatgcttcacatagcaaatctctgtgtccaggcatcagaaggagtttaacaccaagccttagtcctcagaaggttgctgtcaccaacttgaaacctgagttctaagagctcatgtgcatttatcttccagttcttactcctggcactgtattcaggtcttcagccctcttctgtcgtcgttgcttttttcttcctaaagctggtcagtgacgtctctgttttgcacgttcctgttatgtggatcattccaaagacattgtggtcatattctccctgccctattcaaaaatctccagttatttcaattcctgataggtgtgacccagaggccacagcataacgttgaaggtcctctgttgtctagttttcctcacattttcaacattcggttccattctcttccctcgtggtattatgctttgtatgttgactcctccttcttcatgatcagggatttctcttactgtgatagtgttctacctcctaaaactatattacaggcccctgtcagtacctcttcctttctctcctgtcatagccactgattccctccacctctgagttcctatggtagtggaaatcaggatgacacagtacaaggtggtatagagaatgtgggacttaggatgagctggcctgatccaaatcctgcctgtaatacttgataattttatacttttggacaaataacctctctgtcttccgtttcatttgtaagcataaggtaatacctgccttttaagaataccttgcagttgaggataaagaaagactttagcacagtgttactattgctaatattctgcagttgaccattcattcttactttctttattactcattgactttttagctgtgtattgcttgcattgttttccgaatacattggcaaccacctaaaagaagcttgtccctttggccacagtcaaatctggaatagagccttacataaattaatgataattatcataatttattaagtgcttactgtaagtcaggtactaagctatattaacccccaaacaatctttgaagtgaattctgttatcatcaccattttccacattagaaaagttgggcttagaaatccaaggtttcatagcatatgtgtggtagaacaagacgttgaaccaggtcaaaaggtttagtgttaacattttgacttctagaagaaaaagagagacctaggttcaaatcctggtttactactttctagatctgtgacattaggtgaatttcttaatgtctacatgcctcggttttcttttctgtaaaatgaggctattaatagtgcttacttcctagggtttttctgaagattaaatgagataatccatgataaactacttggcatgtttgaaaggctctgtaaatgctattcattaatacttatttattatgtctataaaacttgtacacttaaatctcatgcacaatgccatgttggtacatattttccaattgattatttttatatcactgtctctctggaccaaaacagttgaaataattcatagaaaatccaggactgagcaggtacatgaattgacttcacactagaacataaagcaagatagtgttttcaaactctgaacactttcaaggcttactgatggagtgataataacattccatactcaccttgtagtgtccagtaaatacatatgtttggttttctcagtgttatagagagagtcaactacattaaagtaatacacctccctgggatttgaggaaattattgcacttcttgtgccttatgacaccacccagagtgtgttataatcacccagaaaggcactgcttgttgtatcttgttgcgtgattcattatctagtagaaagaaggagaaggaggaggaggaggggggaaagaggaggaagaggaggagaaagaggaagaggggaaatggaacaatgctgtgggaaatccaagtagagcagtcctcccttaccctcaggaaatacgtttcaagacttccagtgggtgcgggaaatggacagtaccaaaccctatatgtacaatgcacatatttcttttttcttcttcataattttatggatagaattattcttaccttacgtcttagcagcctcagcatccttttttttttttccgttattaagtggagcacttttacttttttacttagaagaaacactttatggcttcttttggcatatccgaattaccagcatcacaactcttgtgctttggggccattatcaggtagaatagggttacctgaacacaagcactgtgacaccctacagtggatctggtaactgagatggctactacctgacagatgggtggaaagcattagcagcttggatatgctggatgaagggatgacccacctctgcagtgggatgaggcaggacagcatgggattttatcacaggattcataataatgttacacaatttaaagcttataaactgcttatttttcgaatttttcatttagtattttcagaccactattgagcacaggtaactgaaactgcacgaagtgaaattgccgcaaataaggggggagttatatacactcctttgagggattttgagggtctgggcaatatatggtgatttttatgactgttgatctcaaaaaagtctccagtggaactcccatatttctcaaagcatttattctttaaaatgcaataaccatttataatatatttaaagccaaactggatcagtaatctaggaatataacatctaagagtgtcactactcagaagggaaattaacacaggagagatacttggagctatatctgtgcatagcttttctctcctgggaaagccccagagtgggaaattgtcacctgaggcaaaattatacagaagattgatttattttcagtccacctaggaaagagctccccagtatcctcatgtacccaaccgggttttggaccactggcagagattgttcctctattgtaggatatatggttgttatatatatccattcattcatttggcagttatacattgagtgtctaccgtgtgcgatatgcttgtgcctttgggcctgccacagctgaatctggaatcgaactcgtggcagtttaagatttaagaaagatgagatccctgccctcttgtcgcttgcattacagttgagaaaaaaaaagtcagtaagcttggcgataagtaaacacaattacttcagctagtgatttgagctgtgataaaaaaagataatgaaataataaaacgaagagaggcaggcaaatggggctatttcacggcagatggtctgggtacagcacactcactgagagtgtgacatttgagccaaggcttgaacttggtgccagccatataaagacctggagtgttctcggcagagaaaatagctacaatgaaggtcttagtatagaacctgttgggcgtgtccagaaatagaagttggatgtggctgaagcatagggagtaaggagcagtgggtagagtagctggtgcaggcaggggccagcttatgtaagtcgtgcaggccttagcatggaatgtgagcgaactcatgactgctcctccaatgtggagttcttaaaagcacagaaatgagctgtcgctgagcatgtaccatattcctactactgttccacacaagactcacctcacttcctctaagcatgctctcactagacctcacccccctgggctttgcctattctatttattttgcaaatgttgctttaaacttcacttccttagaaaagccctccctgacccctcgactccccaccctcaggcaaggctaggacacctgccacacactctcataaatactttaccctttttaatcatagcccagattgtggattatgattatgtctttgattatttatttgcccctctctcttgattgtgagcactgtgaggtcaggaattgggtcagttttggtcgctgttattctctcagcccctgccatgatgcctggcacctagaacctagtcagcaaataccaaacttcttgatcctggtggtatgttcactgccccaagaaagtgaatgtcagtgggtctgattctgccatctcacatctgcagcaatcctgtgggggttttaaacagtccctgtagatgttgctttttacccagcctctcagcgacccagtagggcccacctgagagggctgtagaggcttcctgttgagttgggcttgacatggaaagtctgtcccataagtattacaagttatcatgggccatgatagtgtctatggagcaaagcatcttggatccaaatatatcaggttacccctcaagaaaaaggaagttcttagagaaaattgttctacatgccttgggaataaattagtctattacaaaatatgtgaatacatataaatataataaaatgccaaagtgacactggaaaaatcaataattctactcagcactacatattaaatcagctctttaatacatatttctaaggcagccattgccgccatatttaaatctacccagttgagagacataagtcaattgtgaatcccacagcgattaagttttttacccgttaatttcaaagcagtttgtttattttgttgctttactttggacttcatttggagcacaccagtataggtgactggtatacacactaggaaaattcacgcacacacaccatgcacatacatggaacatgtgtgtgtgtgaggtagctttagtacccagcacagtacctggcacaaagtaggcactatgtagctatttttattcaacatatcttaaaaaaaatactccatgaaaggaaatgccctgctctcgatcacactgccaaaaataaaacacaaacaaacaaacataagtttagatgacttggcaaacatgttttattgctttaaagtgtggtttctctgtcatgatttcgtatcattttctgaagtaaaatgaacagagttgatatgttatgagtaaggagtagcagagggagaaattgagaacacttgcaagactcctagattttgtactaaacaacatcagtgaaagagcaaatctatgagaaagtttaattttggatgttttgagtttgaagtattgctgatatatctatatggagatgtctgggaggcagtggcttaagttagaagatagagttaaatatttgagatccaggagttggtagtaaatacagccacagcgaagctaacaatgcagaacctgaggaggttcgctaagtaactcagaggcacatagatttatcagacatggcccctctgttcaaggagtttacattcctttcaggttgacaagatatacttgtcaacacttgcaagttcaaagttttgagaagaataaatgattaaggttagaatagttgccacaggcttccagaaaaaaaaaattaagacttgaattagcccttgaaaacggagtggaatttggagaggaaaattttcagaagacattcagggataattggagcaaatcagtcaaaatattcttgaaaacacatggcaaatgctggatttaatccaagctaattttacttcataatatcaggtagagtttcatctaaagctctccaagtgttagcttaagggatctttctaaagcagaactgaattggtggaagcaatcaacctaacagattagttgtagccctcttttcccttcctccctttctccctcttttctttttttccttccatctttataataatattgactaatcaccttatgtgacccaggcactataccctcctatataggtgcaattctacaaaagaaattaatcaatagaaaactgtgcctggaaatatatcttaaagaatgtagcagattactttgcagtccctatgtgaagggcagtattttttattaccaacagccattttgctttggttcattggttcaaacccaagagagaaatttccttctgttatcaggaatggttgggcgtttcctgagcaactggtttgtttctgtattatgaataccatgggtgttgtaactgtgtgtgcttcctctttaaattagttgtggaaaacttgggcttgggaacaaatttgcggctaagatgtactgaatcataaactgcagggttgggacaagggattcaaaaaatctcaacaagtgatgctcatgattcaatgaacttaaaaaccatggcttttgtttctgtttttaagaaacagttttgtaatgactgtttggccagtgactgcattccaatatagccccaggaagcatgtccagtttgcaatcacaagcaaggaattcttctgatatttggcatagaatttgcaagtaagttcaattgtaaaattccataaggttagagaagagttctagaaagttaggaattctctatttgtagttttagggtgtacttaaaagaattgcagttatttacgttagtatttcttgttatatcaagcacaaagaaggtgctccataaatatctgaagaacttaactgattttttttttttttttgagagagagactcagaaaagttaaatgactcaatcaaggtcattcaactacttagatgcagaaaccactgctggtgctaggactcacatttttgattcatagtccaatgttctctctgcagtaccagctccataaagaaaattgatggctctgtaaataaagcttcttttttttttttaaccacgtacttaagcttaagcaatcccatctgaatccccttagttccctagcttactcagccagggtgaaactgttaaacaaaccttcagtctacccagagcagtcattcatttgtcctcaaaaaccttttctttactttttttatggctacaatcatagagatgagtggaattggagaggaaaggttttagaggacattcagggataatttcatgaaaataagtattcatgaacataactaaaaatttaagcattgattttcagttgatgggtccatggttaagtttttggtagatcatcagaacgttatgagatcctagcatgttgaagtctcaactgggtacccctacaggcttaaatattgactttgccattatctagagcagtggttctcaaatgtggtgcaggaaggagctattgaacttttcatttatcacatccttgtaaaatgttgtgtacttttaatagcacatgcaataataatatgtgtatataatctatatacagagatatataatttacaaataagtatacagataatgtgggtttgtgcctttacaaatggatatgaatacatataagtttcagactactgatagagttctgaaaactaatttttctattgtatctacgtaagactactgagagtagcaaaccacagtttgttttttccttctctccctgtctctctcctgcccacctttcttttttctttttctttcttttcttttttattcttcctgagaatgttttccaggggtgtatctgcattttcaataaactaaactcagaaaggtaccacttacaaagttaaaccaatcaccagtcacaatagtaaataagcatttcagccattagccaaactcaatagctgtattgccactttgtctcaaaacattctctgaaatatcatcctaatttccctaaatacaaggaatctggctatgatcagtacagtctttttttttttttttttttttttttttttgagacggagtctcgctctgtcgcccaggatggagtgcaatggcgctatctcggctcactgcaagctccgcctcccgggttcacgccattctcctgcctcagcctccctagtagctgggactacaggcgcctgccaccacgcccagctaattttttgtatttttagtagagacggggtttcaccgttttagccaggatggtctcgatctcctgacctcgtgatccacccgcctcggcctcccaaagcactgggattacaggcgtgagtcacagcgcccggcccagtcttttcttaagatcacacacttaactttatatacttggcaagaaacacataaggaggaagtttttgttgttgttcttttgtttttgtttttatttgttcattgaccagttattttaatatgtttctagcctacttaaaaataaaagtcaaaaagtctacttaattatttttaaaatgtttagttcaccttctcacgagaggattttcacatatttaaaagcattttttctataaagaaataataaatcttttagctgattatggaacattctaagtattaataattagatttaagaggattcttttggagatgcaatttaaaaattctaaatgcatgatacacacttctgtgaaaagcataataatcacctatacaattagctaaatgattctcttgagttcaagaatataaattggtgagtggctatctgcattaatcagataatttccatgttttacttcgggatgtagacttttaaaaatattgccttgcgagttttattttaaataataactcattgaaatggaagtggaaaagtagatttaatccatgcttaatatttgtctgatttttgaaggatttagcactgttcctcagagaaccatggaggaaaggtaaaagagcccatctagaagcttcttggattagtttgctcattcatttcatccattcatttacttaacatttattgaatgcttattttgcaccacagtcatgtatgtcagctgtagactcatgcataacagttgtgattgctgacttacagggtatcaacttcaaatgatagactgacatttgataagaataccaatgatatcctattacattgattaatcattacttataatttgttttaaaataattgtattgtacatactaataaaataaccacaacttctagagctatgtttgaggccctatgctagtccctttagattttctctcatgcttttaagtaccctgcaagttgacattgtgtcacagtgtgggagctaagaaacgggctggactcagaacccagaaaatgtggctcggctctcttagaatctgagttatctgagtgacctagaacaaattatttgatctttcattgcctctgttgctcatgcacgatatgggggaaacaaaatcatctatgatttaaatacggctactgtaaatgttaaatgaactgataatatgcaaagaacttagaacagcacttgacactaagaacgatgtgtttgctatcactatgattgttgctgttgctatctgtattttaattgacaagaaataatatgctagtattaaaaagagaattatttacatattaactttgcttgggatgaagtaaagcaagcctgtttatcgaaaaaaatatgatttggtccttgaaggttgggtaggatttcaattcaagtaagaaaatgcattccagggaggaggaatgaaatgggtataggcatggatatatgataatgcaaagtaagtataaaaaaattagaatttagaccatttgacccagcaatcccattattggtatatacccaaaggattataaattattctgctataaagacacatgcacacatatgtttattgcagcacaatttgcaatagcaaagacttggaaccaaccccaatgcccatcaatgatagactgcataaagaaaatgtggcacatatacaccatggaatactatgcagccataaaaagaatgagttcatgtcctttgcagggacatggatgaagctggaaaccatcagcaaattaacacaggaacagaaaaccaaacactgcatgttctcactcataagtgggagctgaacaatgagaacacatagacacagggaggggaacatcacacaccggggcctattgtgggttgggggaaaggggagggaaagcattaggacaaatacctaatgcatgaggagcttaaaacctagatgacggtttaataggtgcagcaaaccaccatagcacatgtatacctacataacaaacctgcattttcagcacatgtatcccagaacttaaagtaaaaaaaaaaaaatattagaatttgggagtctggcatgtagggtatatggcaataagaatacaaaggccagattataaagttctatggtttggactataaagacagaacagggcaggtgtgtgtgtgtgtgtgtgtgtgtgtgtgtgtgtgtgtgtgtgtgtgtgtgtgtcagggggcatgcatacacaagtgcacatgcattcattcacactggaaaattcattgaccaggataacagtttgactctcaagttattattttctttctttaattgtccacatataatcttagcacttaccaaaagctgatctgaaaaggagctttaggaacaaaggacatcacctaggcacaaataatcacttaatttatgttaatagcaccccaagtctggacagcagctatcagttaaatagaccaaaaattagactgagatcaaaattactagcccaagcacagtattaattttctgattgatggtgagtaagagaaaactactgggctgagcttcagctgtatttcagggaacctgtacatttcttctaatttataaagtataataaatgaattaccaagaaggattagaagacagagtgtgaaggatgaagcattcctgtattcccctgatgtcagttgatctattaaattaacaagcatatagatagattatttaaagatcaatttagccacgaattgctttcaaatgaatacatcaggcatcaagccttttctctgagatcgttttgtaattggaatacatattacacacaacttctcatcacaggactcaagcagtttcaatcaggaggctttgctctttctgcaaagtgtgtgaaaatcaaaaatgagcagatccacttcattatgtataatgaggagatctgtagttactctaagtaatcgctgaaaagaattgctagaaaaatactccttgctcacatcactggcactgggctaacacttgtctctcagaaaatcttttcagcatgaaagttttggaattaagttcctaataaacttagaaagtccaacagctgtgagtaattatgatacaagcatatcaatccatgtgcaaacagatttattcggtaagctccaatcctcttgctaacccttcactgcaataattaagcacactctaatgagtttgttagtaatttccatatgattttcctcctaattattatttgagttgcccatgtttataatacttagtaatatccttaaagtatcaatggtgaagacacaattttggctggtgtattaatttgtatttccttattcatatgctaaataaaccaggagaaaacattcatttaaaggtcaaaatttttggaataggattttatgtgtgtgtatgctcatttcttatacacttattcaatacccatgaagcaaatgagtcatcttagcctaaatcaggtcatgtcattccctgcttaaagaactccgagttcttatcatggctttcaaataccattctgactttgtctcttaccacttgctacacaattggcttcagaatactgaccttcttcctgcttcacaaaaaggccaagctggtttatatcatagggtctttgaacttaggacagttatgcctggaatatccttttcccatcattttatgtagatggctcccttttatcatcaaaaaggggtccactcagatatcacttcatcagggaaaaccttgacttttagctgcaatagagctttagccagccattctctatcatctcacccaatcttattgttttaaaaaaaacccatcactctcttaaatgagctagttggtttattcactcctctttcttacacctagactctaagcttcactgttttcctaaaacagtgcctggtacatggtaaattcttaatgaatatttttacaatgaatgatttgttgaatggatagctggagcaggaaggaatgtcagctgtctgatctaccactcagtttatagatgagtaaactgacatatatttgcatctatgatttgtcaccaaaatgacacagcctgatagtgcagttctaggaaattatgtcccaagcttcctgactcctggtccaatgcactggtcatcctgctgcctgccttcactttttttcaatctgtctggttgtggttgttgagatatatgtttacacacaatatgtacttgggcactatttaaagattttgagaatcaaaaccctaccaacttcaattctttctagctatatggacaagtcacgtaacctccccggactttggttatctcgtttctaatatggatagtagtcatatactagctgtgccccaccaggcaagtgattgtgagaacgaagtaacaaaacaaattgcagatttgcttggtatggccgggcgcggtggttcatgcctgtaatcccagcactttgggaggccgaggcaggtggatcacctgaggtcaggagttcaagaccagcctggccaacatggcaaaaccctgcctctaactaaaaatacaaaattagccaggtgtggtggcacatgcctgtaattccagctactcgggaggctgaggcaggagaattgcttaaacccatgacgtggaggttgcagtgagccgagatcataccactgcacttcagcctgggtaaacgagagcgaaactccatctcaaaaaaaaaaaaaaaaattatttggtaaactggaaatatataccttgcaatgataataattaagacccggataccacttagtaacacagtataaagcagaaattaattcttgttacgtacacttttaaatagattctgacactgaaattccatagatatcacataaggcagtgttacctatagagaaatagaaacaaaaatagaaatagaaatatatatatccatatatatatatatatccatatatatatatatatatatatatatatatatatatatatatatatctttctcttaagcttagtggttctcaaagagtggtcctcacatcagcatatcaccaccacctgaaaacttgtcaaaaatgcaaaaatcctgaccgacctcagacctgctgaagtggaaaccctaggagtcagctaaacaatccgtgttttatcaagccctccagggaattctgatgcccactcaagtttgagaacttttgccttatatgattgaataaggcaaacaaaataacttttgtaattaatgaagccttactgtgtccatgcatgtttatagaagttcattgcaaaacctaaaagttaatactgcctcaaaatctaaaaaattaaaattgcatcaatacgtgtcgcctacttattttcatggcagaaggctcgcagaaccaaataaaccacggggagtagttatctataatgagatgggagaccaataatttatcacctatatatcatggctgattgcagaaggaggtcattataattacaaagacactccttctaattaggcagttcagtgaggaagtaaggaacttatcaagatggttcaggaaaaacaacagcaaaaaccacatttggtttttgtgaaaagatggtcactggtgttttctcccagaattcttgttgcatttctcaaacaatccttctggaattgacaagggaacagaatgtacggctgtaatggcttactaaatcttacaaagacagtaaaagttactgagcatcaaaatcaattttaatcatgaaacaaataggtattagagtcaaatctgtccacttcacttagaactcactgaacctgggctagttagttaactttctctgagcttcagcttcctcgtcagtaaaaagggaattataaaacctgcttcagagaattgttgcaaagactaaataaaaatgcatctaaaggacccactaacataccaccatgcctggcacaaaaataacactcacggcagagcgtggtggctcatgcctgtaatcctagcactttgggatgccgaggtgggcgaatcatgaggtcaggagttcgagaccagcctgaccaacatggtgaaaccccgtttctactaaaaatacaaaaattagccaggcatggtggtgcgtgcctgtaatcctagctactctggaggctgaggcaggagattcgcttgaacccaggaggcggaggttgcagtgagccaagatcatgccactgcactccagcctgggcaacagagtgagacgctgtctcaaaaaaaaaaaaaaaatatgtatatatatatataaacactcacttactggtggcttcccattttcatcctcctttaggtaaaaagcagcaaatagttctctttaaggctttttctctttgcttactctccatttttctgaaatatcaggtattcagggaatgagaaggagacaatgaatgtgagaagagagacatgatctcaacatatagcaacttaagtgtcagcatagatggtatttacaaaatgagccctgttctgctgagacaacagaacacagttgacagaaagtcttaagtagctatcccaaagatatatgtgacacacaagtagactccttttcactcctcctcctcatcttcctacacacaaacatatacatttgtttttttatacacacacacactcatgcgcactaaactgaatctattgtgagcctttattacctatacgatgtgaagccattgtttcttatcattcttgtgaagtataatacaagcatcatagcagagcttaaaagacttaagagagaaagaaaaagtgtagtagaattgtaaaaggattggacatacagaattcttcagtggaggaaatgcaatgcttggcttaactcagtgaactcagagaagaaattaaggactaatcttgatatcatttgcatgtgcatgctaagtttctgcatagacaccaagccccccttagcatgtttgtgtggatatagtatgtgagaaaggggaacagtgcagggatcatgtcttctttggacgagggtgttggaaattgcccctacatgtaaatcacaggacacagcaatgccacagtgctcagcggatgttcccaccgctcactgcaaaggggatgtgactttgtaatgacaccacagcagaaagcttctctcaaacagcctgccctggaattattgttaaatcatctatgtattaattacagctcctgggttttctaacagttttatagaggtatattttgtatgtcataaaattgtccatctgagggtagaattcaatgatttttggtaactttactgaaatgccataaccacaaatcagttttagaacatttttgtccccccagtaagatccttcatgaccatttatagttaatcttcattcccacaccccgccctaggcaatgactaatctgtttcctgtctctataaatttgccgtttctggaatttgccgtttctggatatttcctaccagtggaatcatgcagtatgcggtcgcttgtgtctagattatttcacttggtgtaatcttttttgtggtttaaacatgatgtagcctgcgtcagtggttcattttttttccactgctgaataatattccaactgcttctgttaaaaataaaaaaggctataaataaatgaatatttatttatacctctataaaaactgaagggtaacacatttccagtgaagactaagatccagattcagagtcaagttttgttctctggatcacacaggaacacttgcctgattacactttctttctcattcatttgttcatcttgtgaagaaaacaagtcaatgttggcttccctacatcacttagaaataataatttcacaatagattattcgaaccctaaatggtggaaatataaaagcaatttctggccaactgtggttaaaaaacaaagttctaggcattcatttggagggtgctatgatgcaaatacgtgttaagtaatgcaattgagttaaaaattatcatagtattgagatgagtcataggaatctgaaaataagtaggagcttcattacttttaatatttggaagtaaattaattcagtatcgcatagttttgctgatttcatttttttcatattctaatattgtatcagaaggattgctgcaatatttacatattgtctttgctgcatgcaatatagttaccctctcaaattatccacctggatccatttattttcataatgggcttctttggaagttgagttgtggaatgtcataaatgttcagggaaagcatgccactgtggactcagaaattacattaaaaaagcttccagtacacatgttgaataaaaatgggtcctataaagtttattaactaagcaaattaaacaaacttggtaataggtgtttcacatgaaattcctgaagcagcataaatgtgctttgcaacctgagtcccttgttattctcacataacatgtggctttttctcttttcccaatttctcttctaagtgtagcaaatgtttctttctttccctgggatgagagaagtccttccaaggatggtgtggatttcaagactcaagcaattccagagtgttgaaaaagagtcagtaggtggatttgtaatgacaaaacaataatagtaaaggtggtgacatgcactcagtaaatggtagctactattttgtatcaggcactctgctacagacattacgaggctggaataagataaacgcctcatgacatagcttctaccattgttcccatatggcagatgaacaaactgaggctcaaagaggtcaagtaacttgtccaaaatcacaaaactgagtgtcagagccaggacttaagtctagctctgtgtaatcttacagcccaggttcttaacaatcatactaaactgtctttcaaaatgacaggcacaagacctgtccctttcactcctgctggtactcagtgacgtacagtcatgcatctttcaacatcaagaatatgttctgagaaatgtgtcatttggtgatttcatcattgtgggaatatgcgagtgtacttacatgtatccagctggtatagcctactacacacctaggctgtatgggatagcctaggctgcacacctgtacagcatgttattatgttattgtactgaatactggaggcaattgaaacacaatgggaagtatttctgtatctgaacacagaaaaggtacagtaaaaatatagtattataatttcatgggattactgtcatacatggggtctgaagttgactgaagcattattatgtggtgcatgactgtacactaacaagtcaagtgacctcttaggacttagtctattaatctaaaggatgagaagtacattctaacatcaggtgtcttttctcgagcacaatcaaattttcattttcccaatctcttataatgactcatgaccgggtgaaggaggaatcagtgcaaattgcttgttgggatggaaacaggtgctagaagtgaggaaaaagcaatgttcaaacgcaaaggaagggtggaggaggaaaggtgtggagttgccacagggactcatagcaagcaaaaataaaatccagtttggaaatccaccagaaaatccccctcaatctcggaggcttctttcgtgttctttacaggaaacacttgtgtgttcctttccctttgtcagggacatataatttagaaagcagagaatttgttctttctagtttttccttttttttttttttcagtaaacatgaaggattaaagggaaatagacaacagcacttttaaaggatgctttttcgtaagactttcagtggatgttatccagtaaataagagtttcacagtatgctatcaatgttagtttggagaaggaaaggtcaaaaagtcaaaccttgatatctttatcttttcacaaaggttatttctgaaggagctatatgtaaaaggaaaaacaaaaggcaaatatatacacacacctatatatgtatatgtaatgcatatattacaacatagttcttccaatcctaattatatgcctaatgctgggcttgagtgtctattactttttaaactacacttgtgctattatttttcttataataaaatgagaataaatatggaattctctccaggtccccagattgctgtcacagccagcttagttcactttatattacccacctagctccagtacacacctgaatttgtgtctcttgctccaacacaacatatatatatacacacacacatatatatgtgcatatatatgtttttatatatatatgttgttttcatatatatatatgttgttttcatatatatatatatgttgttttcatatatatatatatatatatatatatatatgttgttttcttatatatatgaaaaacaacaaaaatcctttcctgtgtcactccaggtaatgggtttcactgtgtaactattcttttctgcaaaaggtttgtgttattatccttgggtattattttctgatggtatcagtgaaatgggtcattattgaagcactggcttacttatgaaagatgttattaaatactgtggaaatacggttatttccattaaaataccaaaaggaaagagaaatataaaaatataagaggtagttctgaggaaaccaagctgaacctcggaatatgagacaattggtactaaaaggtgttgttgggactaattttttcttggtggcgatcctgctttgcttcagttggacaaacgctacggggcaagagacacaaattcagctaggcaggtaatatcaatgcgtgaaccagactggctgtgatagcaacccggggacatagggagaattccatatgtccccccatcttatcaaatgaaaaataatagcacaagtacagttttaaaagtcatagacattcaaccccagcattaggcgtataattgggagtggaaagactacggcaagccagatggctcatgaaaaggacgcagctataattcaactcaagccaattgctccttccatcttttctgaaagtttgggtcaaattctaaagcaggataacagttgttcgcagttgaaaggagagaacgcagcaattgaaaagccattaaatacccggataggttttggagatgtgggacaattcctctaccttgtttatttcttgtaggtaatttggaactctcatgggttccaggagttgaggcgtgataataccaaagatgggactttaaatgactctgatgatgctatgtaaggtggcttggaataaggaaaccagtcctaagacattacggtagaagtagactgcagaagagacataaatataggtattagcacaatagcattggaaacgaccagacagagggaaggctggtggagttgatggatccacggtggggttaaagatccaagaaaatagccattgacagagactgttgagaacgatgactccactgacaaagcaggaccataagaaaacgaggatggccgggcgcagtggctcaagcctgtaaatcccagaactttgggaggctgaggcaggtgcatcacctgaggtcgggagttcgagataagcctgaccaacatggtgaaaccccgtctctactaaaaatacaaaaattagccgggcgtggtggtgagtgcctgtagtcccacctactcgagaggctgaggcaggagaatcacttgaacccgggaggcagaggttgcagtgagccgagatcgcgccattgctctccagcccgggcaacagagagagacttagtctcaaaaaaaaagaaaaggaggatgttgcgaagggaaggtgctgaattcattcagcatttactgaattatttcacaaggggcaaacattctcaaggaacagggaaattaataatgcacgactgccctggaggtgccccatgatctgacccccatctgtaggaggtgcttgtaagttcagttttagatagtttgagctcaagacactggcagaacccttcccaatttagaaactttggccttgtcttgactttccctctcacttatctcctacgttcaatctttcggtacagtttcactgcaagtcgccctgaagttttgtttcaaagagtgcctggggcacaagctctgtaaaagctttgggtacagattttctctgtccaaaaagcaatcctcaggacttgctacgatgtatccctatgtgcaaatacctttgttgaaaaacacggaagccaagcagtggtatagatgaaagcatggtgagccgaactaatcaagtgcatttttgaatgtcatattaaaatgccttagtaagagcatcatgggaaatgacccattctgcacagagactgaccagctttgtcaggcttatgcccagcacctggcttagacaaaggcttcgacaaatacacatgggtgtttatcattatgcaaagccagtgtgtaatgctttttctttttatattacaaaaagtatacacacagaaaacatatttttaaaaatataataattaggaattctactatttgttgatatgcaaaagaagggaattatcttttgctcactatatgtcaggcactgctcagtttttctttaccacagtgaccctgtttggggatctgttccagtgatggggacaacaggactgaatattagaaacctagatcatcctagaaaatctggaccatatggtcacgtacccgtaccttcctcattttctcctaacagggcctggaaactccagcaagttatttggaagtctgtttgatgtcagtctccagggagaagcgatgcgactgttctcttgctgcagtcggatggatgtctgtctgagaaagagggcggagggtggaagaggtgcagggggacccttcaccacaggctttgatctcccttgactcctcctgggatatctcaccttttgatgttgggaatcagttaattactagtcaaaattggtttgagggactaggaaacagtttgaaggctctgttctcaaaatgcctgtactttgttctgaggaactttcaggcaactttctgaagcatctcaggcaaatgagaagggctcggtctgtggcccctccctagtagcggcccagattttgatcctcttgtgctaccatggtaccatcctgatgcagcagacttcttttctcttcagagctctgtggtttcattggtagtgaaatgatgacttttaggattagattgttaaaacatctgtcacaccacaaagagtatgtagcttaataattccctctttaggtcttaatttgaaaccaccacctctcttttctgagcaacacctgattaatgctaccatgaactttttctgagcaacacctgagtagtgctaccatctcttgcaacacaaccttgatttgtaaggcactatattaaattagtgggctagaagtcaaatctcctgccttgcctttgctggtgcaagttaacatcctccaagttgaccttaaaggctgcaaaatgcttcaggagtttgatgggcaggtggtgctggagaactcagcattcttttctcttccaaacaaggctacacacctgacaccttgcctagtaatggaattctcctaatgaacacgttcccctagtctaaggcgcttgcactgtgaccataccacagggctgacaaagagataattttcagtgctcagaaaaagaaaaacacacacacacacagaagtcttttgagactgtctttttttcttatgtcatggcctattatggcattttcattttaattgcacatgaaacccatttaaagcggtgctgtaatgggactgttcccttggaaaacacagacaggagtgatatggatgtgtttttgaggagtccattagttactcagactgtcatcattgtgtgccttgagggtgctaacaatgtattaggtatctaagcaaatgtgatatatttgatcctcttatatgtgaatcccctgtcctcctcctataagtagtagattcatatcaaagtctctggcaacagagtactgctcagtatttcaaagataaaatatgcattcttatgcatgtatgttttctagtttttcaaatggaaattgagccatatagataaagcatgcaaacattgagactctggaattacttattgaaaagaatgattgataaagtggttattgtggttgcttcactcttcccacctccactttggaagatagacagcctgtacctcaaagagttttagaacttcctgaccttctgtaagtaaaaatgtcagttcccaaggccagagaaataaagccacagggtctttttccataaaataagctgcattccctgggtctcaatatctttagtcttctataggaaactgaaagaatttccactttgctttgactttccctgctgtggtcccttcctcatttagcatactttgttctttatgcataattggaaattaattttctaattaggttcttcacatttatgaagttgtttgatggggtgtcggttcttataacatggcctaaaggctaaaggagaggtaataattctttttttctggctttgcccctaattcagctaaggttcttaggaaatatatttaacttttatgagatccccgtaatacatctttaatgctgatctacctttgaaaggttgttagaagagtgctaactagggctttaagactcattatgatacagttgattttatttgtaatagttgctgaaacaaaatgaagtcatttctttggcaacatgaagggtatttagataactacaagtaacaacaactgcagaaaatacaatcagatgatactgggagacaaaataacattgaactgatacttgagaagcagaagtgaccctgaagattaaaaggcgagtatttttactgtgaatatacaagtagaactaaatcaggtatgagctgtatgagtccgtcacctggatgttctgtgacttgttatatagaacttgagtctatggttcaacactctctgatctgtgaaggcaagccagtataaaccaatgcatgtaaacagtctgtttcttgatttcagtataaaagttgaaagataaagctaaccattagacttggaagtaaaaactaaattctggagtcacaacttctacatatgtctcggatcatgttacttattactacaggtacaaaatagcgtgcatgtgaggagaacaggaaccaatattgcacattggtaaaagaacatcctcattttataggaaatcatgtcatcctacttgaagtgtggctgaagaaaaacaattagatgaatactcctcagcagtctccaaataagaactaccttgcacactaatttccattgtgcatcaatatccttatttgaatttgccattcatgtatatgtcacggctaggcaaaaactgtaagaacaaagtgtaaggctgaatatatgatgattaaaggtaagtgatactcaacctcagaaaaaatatttgtctgactcttgactcactctttaagttactttctaggttctgcacaatggaaattagtgtgcaaggtatttcttatttggaggctgctgaggagtatccatctcattttttttttcttgagccacacttcaagtaggatgacatgatttcctacaaaatgaggatgttcttttgtcaatgtgcattattggtgccgattctcctcacatgcatgctattttgtacctgtagtaataagtaacatgacccgagacatatgtagaagttgtgactccacaatttagtttttacttccaagtctaatggttaacttaagatcttgttaagtatcagcatagaaagaggctacatggtagaatgggaatatcactctgccctgtgggactcaggaggcctggtctgtgtgtccagctctaactctaagtgcttttgtgaccttggacaaattatctaatctctttggtccaatataggtcaaagaggttctttctgttctgaacacacgtagcttccaagttcttacctatcacatgcaataccccaagaaattctggtcactgcaacttcttgaacaagatatactgaacccaccagaagagagtatagcacagtcattaagagcacagaatgcagatggcatatttggttttcagcattgccacctctctcccactacttaattgtcttagccttaatttctacagctgtgacatggactaacgatcttatttcactaacctttttctctttcccttgctatcttatgctcttcttttcagttcttaatggtagggttttcttttgttgtaaaggtctagacagaagaccttgataaactagactatgccaagagcgaggaatcatggattatggattcatctttgggactggaaattacttgaccttaaatgcactttctctatggcatccaaagtcatcttttaaaaatgcaaatcaaatcacattatgcctttgtttaaaaactatcaatagtttctcactgtactatatttagcataaaatccaatctcattaccacatttaacaataattttgggcttattccttgctttttcttcttctttattatttttatcctcttctataacttcagtctcctcctcctcttctgccttcaggaggagaaatctatagctccaaatatgtgctcagtcccttcttgcatttgcaacagtgaggggaacacatcccccttgaatcatcccccttgaatatctggtcagtatgtcaaagctggaattcatcctatccttcccccaaaccaccaagcaactagcttctgacttctgttagtagtattcctattattccaggtaaccagcctcacagtctcattccatttgactcctctccatgtctctctttccttaattgctatcctttctatgtatgcctttatttgtacttccctttgcatttctactgccacagtcgtcactcacatcaggtctttcggacctgaaatagtgaaataatattcctctgagtcatctaacttctccctctttcgcttttattacaggttaaaaagctacaagattaattttctggagtacaactctgatcatttgatgtctgggctcccaacattagctatgtgataaagtctcaactctttggcttgactttcagagtctaatgcaacctgaccctgattacttttctaggctagcttactgcttttcatatattattctattgagtcatctctttatttttttcagcaaaaaatgattgaggaccaacagtatacaacatcctagtggtatgctaacaatacaaacgtgaaacttcgcaaaatagaagagagaccaaacacgcacccagacagacacacacacacactcacacacaagtattaagtggaataatagaagcaaagaatgtgatggaaaatagagtaacagggaagtaattttatatatttatttctttttctttttcttagagatggggtctcctttatttcacaggctggaatgcaagggtgaaatcacagctcactgcagcattgaagtcccgggcttaagacaatcctcccaccttggcttccagagcagctggaattacaggcacaagttaccatgcctagctatctctatatatttaagtaactcttaaaatattcttgaacttgaccttagttggatagcttactaattctaaatactatctcatatttcccactttttttttcttttgcttatatttcttcttttcagaatgtgctggtttttaatattcagtatctggtccgtatttaaaggcatacttattgaacttttatttttgcatccccagtgtctactttccttggctccatctcttccaagccttcagccaaagcagtttgagtgaggattgagcccttttccagaggtgggtcatgtgacctagggctaaaccaatcaatacgctacatttctctggccatagggattggttctggggtggcatgtgacaagctaggcaaacagctaatctgagggcttttgaagaaaccactgggaagaagtctttattcctgttgaacttgcagctgaaaggttggaaggtctggggttgccacatccactttgtctgttggagaatggagccaatctaaaaggagatagagaaaaaagaaatcaattcttgacactgtctctcctccaaatcaagtcacactatgcctctggaatttttagttacataagtcaatattgtttttttcttacatcagtctgagtcatgttttctgagagagaaaacaaatacagccatccaatttcaaatagtagtacttttactaactttttttttttactacctttatgggtactgccagttcaatgcggtttttctctaccattttgtgtctctcagttatggcatgtatgctgttcaacctcattttagagttattggtaaacttgcctcctaccagatttgaatggacaaaaatttctctttaaagctcttcattggcccagtaaatagggcctgaacaaaagtgagacaagtgaggtgcacaggggtccacgatgaagaagcactcacttccaggtgccaagtctgcacttagcagtctggagagcgagtgcctccttatcatttgctccctgggcacctcacttgctttatctatttctgatcctggtagtggagtaactactcaatacgtgttaggcgaactcgaaagaatttcacattttgcatggggatggagatgatccagaattgcattttctttgctattatactcatctgacatatctcattcacttttttttttttttacatttacttcattttggagtcatctagcattatgcagtgattgcagggagggtttgtgatggtattactctaaaaacctctaaatcccatttcccagcaagaagacaaactaatagctctgctaagcaatgcatccagaaataacatggaatatggggtagtgaatttcattttcactcatttacttatattttcatagctcagtgtctgttgtggagcctgaattatacaactcattatctaggtcaatctagtgagctatcctgtcagcacagatgtgctacttttgcaatagaattctcagtggtaaagttgcttccaagctggcacctattattagtaaaagtattaaataaataaattatagaaacagttgaagcaatgaagcctacacgataagtgcaataggttataaacattatgtcttcattatataagcaattgtgttagttatttaagattacagacgatcgatagccacatcttgtttgcgctagtgttggttcactggttgtaagcaacagaaactgacttcaaatagagaaaaggttttacaaagaaatatcagaatcaaatcaatgaacaggttcaaaagaaaaacactagaacagacaggaagcaagacagctccagtgaactaggtagcaggaatatatgttgaagtaataaggcataaataaaatgaatctacaccaacaatttttccatatatgattccactaaatttttgtcattgcattactctagtcaagaccaaatcctaggacaataggttcattcctggttataatcatatggccacctcttgaccaaggaaaagcaggccaccttgattgaaagtcctaccaacactgtatacaaacaacagatgtccattactttagttcagttagaatctgaaaggcttcaactgtgctacttacacatattctgggccaattgccaacttgtgttgaacatgcacaaaatcattttatcatgacactttgctgtatcagtcacatcacatttgttcaaatttgggaagcatgaagcttcaaaaatattcatagatgtgtaggtgaatttggtaggaaataatatttggtctttctgtatgttaattcaactatttggctaatcaaagtatatgatggtgtcatctatcagcaaacaaattggactgatcttactgtgagttttgttgaaacgtttttgacagtagatatggagaatgtctaagacacaagttttaaacacaaaatactatcctaaactagctcttttccgcctgccagggccaccttttgaatctgtgacctgtgcagttgtctgtgctcagaacacttaggttaacatccttctgtcctctcttgactctcttgaagctgttaataatttgttaacaaaagacctgcagtttcatattgcgccgggccttgtatattatacagctaatcctgaaagacacagaaccagtggaagccagaattacttgctagtgggaatactcaggccataaagtgctgcaactttgagactctttaaataaatgccatcttttaacactctaacaaggtacaaaaatcccagaatttgcacactccatattcaatgctctttcttcattggaagggcagcagaggtaagggatgggccataatggtagagaagaaccatagaagaaccagtggatgccactgacttagcatgtctcctgagcacatgtgaatgttacataaatactcattgaatctttaaaaagatgaaagcatgagcacgcatggcctgtttgcaggtccctgaggtgtgaacaatcgtggcatgtttgaggaccagaaagaaggccagtatgcctgggacagtgagcaaaggcatggtggaagaaggaaagaatgaagtttatgagggacccaggaaccgtgtcaagtaagggctactaggccagggtaggaaagtaaacatcatgggaagatgacttacttattataacatcatagtattttggtacattaagtctgaagcataaaactttttttttgaattttatcttattttcattttattgtacttattaaatatatgcgtttttaaaacaagttgtgtgaaggaaaacatattttatatttactctgttacaggttccaaattaaagaaatcccagttaacttggttacattatatatcaacagccctttcctttaatatcaaaaggcttttcttgccttttaaaagctttatttttaatgaacacataatgttatacatatttatagggtacatagtgatattttgacacatgtaatgtatagtgatcaaatcagagcaattcacgtatctatcttctcaaagatttatcttttttttttttttgcattggaaacattcaaaatcttccttctagctatttgaagctatatactatattattgtttactgtagtcctaccagtggtacaaaacacttgaacgtatttcttcctatatagctgttattttgtgtcctttaacaaattctgcctatccccttcttcccctatgtttcccagcctctggtattctctcttctacttttaatctctatgagatcatgtttttgtttgcttttgttttttatctttcacatgagtgagaacatggaatgcgacgtttaactttctgttcctggcttatttcactcaagataatatccttcagttccacccatgttgccatgaatggcaggatttcattctttttttgaggctgaatactactctattgtgtgtatgcaccacattttctttatccattcatctgttggtggacacctatgttgattccctatcttggctattgcaaacagtgctgcaataagcattcggggttcaaatgtctcttccatacactagtttcctttcctttggataaatgcccagtagtgggattgctggatcatatggtagttttatttgtagtttttttagtaatctccatactgtccttcacagtggctattgaagcataaagcttaatacaatgtcatttagagcagaggtgggccaacgttttctgtaaagaataataaatattttagcctttgctaactgtatagtctctcttataacttcttacaactactaaactctctcactgggctgagtaaacataggctatactttgggtgaaagtagacatagataatcttaaatagaggttgctgtgtttcaacaaatcttagaaaaaatagatagtaggccaaatgtggcccattagccacagtttgccagtccctgatctagcagagcatggagccacatgcatctatattagctgcaatgcacattaaaaatgcagatgtttgtgtcctcttccagatgcactgaacctaactttctgggtttgaagtctgaaagtctgtgcttaataagttgccatagaaagtgttattgcatgcttgtcttagtctgttagtgctgttatgacagaattcctgagactgagtaatttataaagaacagaaatttatttcacttctggaggctgggatgttcaatatcaaagcaacagcatttgaggtctgatgaggaccttcttgctgtgtcctcacatggcagatggcagaaaggccaaatgctgtgcgaagccttttttttttttttttaagaccgagtttcactcttgtcgcccaggctggagtgtaatgcacaatcttgggtcactgcaacctccacctccagggtttaagctattctcctgcctcggcctcccaagtagctggcgttacaggcatgtgccaccgtgcccagctaattttgtatttttagtagagatggggtttcataatgttggtcaggctggtttcgaacttatgatctcaggtgatcttcccacctcggcctcccaaagtggtgaagcctcttttatcaagatcttaatcccattcatggcagttctgcccttatgacttaatcacctcctaaaggcccccacctcttaatgctatcacagtgaagaataagtttcaacccatgacttttggaggatattcagaccacagcaatgccaaaattgagaaagttgagaaccactggtctagaagccagtctatccacttaggtccctttctaaggtattaaaaattgtaactgattgacctaggatagcacatggggtaatttctcagggtagaaggactaatgtttggaatggcctgtattcaaattcagaatggattgttccaggagactgtaagaaagatcatgtagcaagaataatagcaaggagagaaagctctgctagataaggctgtgcagatcaatcctccctttgagttccctggttttaattattgatgctaaatatacatttcccttaattgttttgtgaaaataagttaaataaagaataaagccattctatacatgcacaggcaaacattacactcttttcaaataaacactgggatgattcctcggagtgttcctattcaaatttggttgcaaaataacacccacagaatgtatttccaaccacaaaatactgtgacagtaagcagccagcacaagagagcctgttatggtttatagattgcaatgattatattgcgggagcagttgatgcatttgttggtgttcattctatttcacatttgcatttaaattcctgtggaacaaagataagataaagaggaaaacaaatgatgcttatttgttgttgtattgaactcctattataagtattgttttaaaggagagtgaagctttgcaaggaagcattccacatgtcctttacaaaacatgaaatacactttcaattgtcaactagaaatatgcaggaaaacatatccctgggctttcataaaatcataaatcaataaggaataactgaaaatgtggttgaatacaaggaagcaaatgaaatactcagtactttcctttatacatttatccacattttattgatacataagaaatgtagaactgcaatgagttttgaaacactattcgttttatttcaggcattcctttaaagcaatgcttgatatgtttcctctttcaaataatctgtgcatccacagcatcgtcctttgatgaatttatgcagatcagttctacatccagggtaatgttttctgctcctctaagctattttgctgggatcacagggaaaaaaaaatctttttgtagagttcgattgtaccttctagttactgactgggtataaggttcctctactcatacaaaaagcacatctgcctccccatatgatgtgtttgccataattaatttcagaagaagaatgagataatgttacctcttcctctcaaattagtaagttgcatatcagtgcctagaacttatttaaatcatttttaaaacatcacactcatttctgtaaatacacctgaaataaggtaaaaattaacaattaaatgacaacagttaattatatgatgtatctgaactcataagcaaaaatttctctgactttaccatgctttacggtgcttttctcaaaggaagcattagtcaggtccttttctggatgctggcagtgacagcctggaagcattccttaaagggagggctgtagaatgtccttaataagagatgttggactgggcgtggtggctcaagcctgtaatctcagcactttgggaggtcgaggctggcagatcacgaggtcaggagatcgagaccatcctggctaacacggtgaaaccccgtctctactaaaaatacaaaaaaaaattagccaggagtggtggcaggcgcctgtagtcccagctactcgtgaggctgaggcaggagaatggcgtgaacccgggaggtggagcttgcagtgagccgagattgtgccactgcactccagcctgggcgacagagcaaggctgtgtctcaaaaaaaaaaaaaaaaaaaaaaaaaaaagatattacaccaaaattaaatgtggtggtcaaattagaataattatgtctaaaaacctctgcttcctttttgtcccttcttggatattgataatgtatactgacatattaaaggctctaagaagtcagaaaaaaaaatgtctttagctttattttttcaaactttttgctgacagtaacttatcattttttaaagtctaacaccttgcattggcacttgtatttctggaaatgcatgttccgaagttctgacctaagtagtaactagtatctaaaggaaagtacattctcctgtctgtattacatattttatgttccttaacatattatatgtatcagccatatttattcattcatcatttattcagcaagtatttgaagaacttctctgtgccagtagcttgtgggtgctggggactcatctttttaagagcatatttttattctattttcaaaatgtatgaaaaacttagttgttagtataaataacaagttatatgaaaaataaaagtatcacagtgcatagactcagcattttaagtcaagcattcagaagaaatgcaaaatggtagatatttttccttagatgccattagggcacgttgcactgagcatgtaccttatttactgttgtgactgtccctggaatactaacaatgatgcatttaaatagcttatagttatgagttttagaatcagaagcaaataaatttgaaagcattaattccagcctcctgctttagctgaatttctattatctaaaccagccccttcaaatgttttgaaaatcagatcatatacaacattttataagcttcctatcttggaacgtgaatttagaattcacactctggctcatttttccaactgtaaagtgagtgagttgggttaagaaaatctatttttagaagaagtagtaagcattgaaaaagttcacagcaatttcaagccatagatttgaatattagcacctggaaaatagtaattctaattctcattcttacttagctggtgccacttgagtgatgtccctggagctgaaagggattgccaagttaatttggtcaagtggttttcacaaactatacatcttattaattattcctttgatgggctggtctaaacccagttcaaactgacttaagtaaataaggacaacagaaataagaattaataaataaatactaaaaagtgatttagaagatattgtttcacttcacctccgagcgcaggggtataattagcttcaggcttgcctagagtcagtggtgcaaaccatgtcactgatagcttaggcatgtttgtctgtctccctctggcttagatggatctcaaacaggccgtctactcactggttcccagaagctgcaggcttgcataatccttacaactagaaattcaatagaaaaagcattcaccttcttagttatcctcaggattgactctccttgggctgccctggtcttatgcttatgctgcaaccaatcattgtggtcatgggaatagaagggcctgattggccaggtttggaagatgtttctatctatggagtaggcagagactgatgataaaggatatagagtggggtggggtggttttccgcaaaggaaattaaggtgcagccaccaaaagaagctgatgcttggcagacaaaatcaacaggtgcccattgtatttattttttaaacgagcatccacacagaaccatgaggtacaaggtaaacaaaaagaggagattcttgctagattgggtatggggagttggggtggagagagactcagagatctgctcattcagccacatctcacagctcttgagagaagctgaccccttcctcgtttgcctggcatgatcttggtttatgtgtgttgttcattttaattactgataacaccccgttttactctcaaaagtggcgtggtttgcttaatagattttatggttactggatcgtggggattctttaagctttattagttaattcaccccaaacacttgtaaaactcttgatctacatccaccaaggcatccacttccataaatcagacttctgtgtttcatctgaataatatgaaaccttggaagagtttaactcatcatctcctctcattttacttgtttcccatgaaaatgaaacttattatcatttgatgcaattaatatttgtttttatttacccacatttaacaaatgttttgttcaccattgtttcttgaatatcaatcttttccctgggataaatttttacctttctgaaccgttcctttgggagtttgctactcaaagtgtggtctatggacgaacaccaccatcagcatcacctgagagcttatcagaaatgcagaacctgaggctcactaagtcagagcccatagatcaacaagattcccaggagttcagtagacacagtcaagtttgagaagcccattttagaacagtgaacttaacacaagatgttttcattttctattccattttgtctctgattctctcatattttaacctctgtgtctctgtcttcaatattatggataaattatatcttatctttcattgctgtctgctcactgtagtctcctaggtggcttaaaaactaagtaccagtatacacatttttagagatagagagacagagagaatggggatggggagagagagagagagagagagagagagagagagagagagagagagaaagagagagaatgaatgcctgggctcctcctcagaccatctaaattaaaatctgggtaaggaccactacaccaagagctcctttagttaggatttattggtgacatgctctcatttttctgtttgtctaaaaaatacttatgattcattattgcataatagccagttatacaattctaggttgctatttatttttcctcagtgtttcagagattgaaaagagtgtctttaatttttgttgctatctgttgagaataaactctttttctctgtaggcaatctgagttttaaatttctgctcagtactaagattcttattgtcttcaatgttatgcagctttactccattgtgactagatttgtatttcttatttcttattgtatctaggattttttgcagtttctaaatctgaggattcagattactgtcccatcttctatacattctttgctatctagaatgttaattggatttgcacaagatattttcattttctattccattttgtctcttattctctcatattttaatctctgtgtctctgtcttcagtattatggataaattatatctttcaattctaatcatttagtgaacatatatgcgtcaaatttttctatttcatgattttattttttcacttgaatgtccatttagaacatatcacttctagaagttcattttataatcagactggtttttccttgagagtgtcttgctccttgctcaatttgaaaattctttaaaaaatattcaaatatagttataggctgaatctcataatttcactatctaatgttattttctgttgtttctgctcaatactgctcatgaacacctgtctcttgttcatgttgcaatttgagcggagagtgaagttatgttatctggaattgatctgtggatattttgtgaggcctgagttgagggtgcattccatccttgtagagaaatttgtgttgacctctgccaggctctgtaaagtacaactgagtcaagaccactttgatttcttgtcttggggtttcctgaaatatgctggttatgtaaatttcaaagccccttggcctgaggataggcctgcgattatgtatttttcagaagagatgttttctccttctagaattcagcattagataaacaaaatccccttgcctaggtcttagttgactgtcaaaacttttttcagtacaatctttccctgaggggaaatgcccagctgtcaattattcattttgttaatgaggaaagtgaggctcagagttcaacttgctgggagtcacactcagcccctgaaagcagaaatgaaaagagggcccagatcttctcatcgtccagttgttttctcctccgacaaaacaagctacagaaatagcatcaccttcttctaataagaatggcttcacctttgcctccagttggacaagtaacagcaagattcagttattcctcatggttaagtttgatgaattatagaaataggttacttagatatattttaagaatcataagaacataaaaaagtcatatgagctaagacttatagtccccactattcagtattttgtcttttatagtagtaccaagggacattggtgtgacatgatgatagttgccctttgtgatattgtcctcaaagggggcatccctaactgggaaagatctatcatccaagaatttctctaaagccttcttgaactctcattacatttttggtttgtacaaccttaaggcactgctttacaaggaattgatcttatactagtcaggacatgggctaaataaccctgaagtccttttaaaatatgatttcaagtatcataaatcttgttggataatcacactctgcaaatggagggaatacagtagagtgatactgagctctgaagtcaaacagcctatgtccaaatacaggctttatccctatgtcctaactgtgtgaccttgggcagaatcttttactcttctgaatctctgtttcttctcctggacaagggcagtgactgtaggattatcataaggttactgggaaaaatgaatacaataatatacataaaattacttagcacaaggcttggcatacagtaaacaaatgaaagtattctcagtattaccattagtgatattgtcattagtgtcggtagatgtcattagtgtcatcctggtcacagacctcaccaaaaaagtggctgcgatcccatttcatatgttttaaaacatctggaggctgagggcagaagaggatataagagaccaaaaaaaaaatgaattattatactgtgaaagaattttaaattttatggattccagtatgtactaaataaatcacaaacttttcaggaaacaattgttaaaatatctttggatgtgctgttgtgggagtgcttcatattgaaaaagagagatataaactaaccaagtaaataaggttacttgcggttccattctgtattttacccttacataaattgactctgatatttggtcgctgggtttcctcaattattttatttttgccaaaaaacaaaacaaaaataatgtggcgtgtaatagctctaatgttaataaaattgaatgtttatttttccccctggaaagtggcctctccactctttcttaaatgtcccattctgcctcgacatttactttgcactagtaacaacactcaattttcattgacattatcttctaaatacaatcagatcaaaaatcgccaacatcattctcattcctctcctgcaagcagataatacaagacagggtctagctgataacttccacttcagtaacctctgattccactacttgaaatgctttgtgtggttttctactagaccagaggcagaggtatttgtgtaaaacaggcgattcccgtcagcaaagatgcaagatgtggcatttgcctttaatttccttttgctgggtacagggactctgtgaatgggcaggtccctgagggtgacttgtaccaactggagcctgtgccagcacggaccttcccaggcacacacttaacatttttccccaggggcttgtgcttaaatctgcaggttgaaaggaactgaagtgaaacttctaagaaatggtggtgagcatttaggatgttctaactcagttcacataagtgttgatgtgttctgtgacagtctcaaccccaaacgaagtgcactcatgtttactggcaaaattgggaatagtttttcaaaaatttaccatacgagtaaacttcccagtttacttaagctctccaagcctcagttgcttcatctgcagaatggaaacaaacattaattatgatattgaataaaaacattacattattacatgtgctaagttaaaaaatctcaaaattactaatattaaatattaatatttttagaattatttgagagttggctgagatcactcaaggacagtacttagagggcctggcatatttacatgtactcttcatatattactagcttttcatagtagtaatcctaatgtaagcctatgctaggtttcttttcacaaatggtctgaaatattcattcttctgtatctggaaagcaaagtggcctactgaagacattatataaattcagtccaaatgctatttgcacttgatatgcccagatgtttgaggtggaaaaaacatattgaattatctggatacttccttaatttgggggagaataaatttcctatgttggatttttgaatacatttaaggtgctcaaccatccaggtttgcctgagactgaaaggggtttctgggatatggcacttctcagcaatataactaggacaatcctaggcaaactttatgagttaccttatacattatagctccctgtaaataatgtaagacactcaaatatgatgaacttttaaaaatacacaggtcttttgtcaatgcaaaaaaattctttggtggagaaggagagagctgtatccttacatctgctttcagttgcaaaaatagctcaatactgaactaaaactggcttaagaataaggcccttgagtctggaggtggatagtttctggcttggttcaatagttcacaatgcctttgaggactaaagaatctctgtattggtgttggccgtatttgcccttgaagtttcattaggcttcatcttcaagcacctctctctgccacagtgacacccaaaccaggaaaggcaagtcaggggagaatctacctccagcatctctcttttttcatcagggactaaaattattctaagaatcactcaaatttctctcatgctttattagacaaagccgagtcatcagtccacccatcagtcaatcaaccaagtgcatggaattattagatatttagacaaaccataggtcatcctctggtctaagagagggacacagcttctctgagcacctgttaatatgaacaaaaatgagatttggccaggaaagaaggagggaggttggagaaacaactgctgtctactgagcagacaaacagtatctgccatgggcagtggagaggagacagtcgtctcactaatgtccactcctgttctttaggcagccatgtatgtcgctgataagagggcttcttgctgttgatttcccaggtgcctgggtataatgggaatagggcagatgtgccaccttctattgaatggcgtgtgttgtgaaggccagggaattcacatgaaacttctacatatctcagtttctctgtctgagcacttaagatatggccagcagcctcctaaaccagaagaggcatctaaccaaggaaaacacagtaaagaactcttcattttgaagtttgtttcttgcctgcaaatcaaataagatattgatctttcatctcaggagaaagtctttcattggcccttgatggcacaattctcataacaaagtccccaacaaagaaaatataatctggtgttctcacctttgaaaatctcctccactccccaagttgctccctctaagtgagctgaatgtgtatactctaccctctttcctggggctgcttcgtttatttaaggatgagagttcaaggtcactgaagaaaatctttctcagctccaccaagagtccccttatgaagaaacagaaatctagctcttgtgtaaatgatcaaatccttgtttaacagagacttaccttgtgatatcaaggtttgttgtctgatttatactgcttatgactcctgtgagggtgttatgaggtttcatgaactaatgattatggagtttaatattttttaaaaacgttccacaaatgttaaatgctattactccttgggtcactccctgtttgcatttaatataacttcctgcatcattcatacgctgtaatggagaagcagattccagggacattccctggctacttaggaatcaacagataccagtgcagcataaggtttaattttcctttttgcttttaaatgattcctaaaaccgttctgagagaccatgaatgagaatgatgtggaaatttctgatagtaaaggcttattgtaagcacagtggctcaaaactgtaatcccagaactttgggaggccaaggcgggcagatcgcttgagtttaggagttctaaaccagcctgggcaacatggtgaaacctcatctctataaaaatacaaaaattagctgggtgtggtggtgcacccctgtagtcccagctacttgtaaggctgaggccggagaatcacttgaacccaggaggcagaggttgcagtgagccgagatcccccactgaacttcagcctgagtgacgggagtgaaaccttgtctcaaaaataaataaataaataaaatatttgaacagaagtcgaagaataaattaactgcagaaggtgcgccattttaactgagcacacacttggcataacaataagctgattcttttatttggaatttccaaaacgaactttaaaaataaaagaggaggagcatttctaaggaatgcagtatgactttggtgggctcacggttctcagtgtttacatgcatccttgaatgtgctgctttatacatttctctagcagtttgtggtttgtgtttgtgttcagatgtgcaaggataatagatatgggaaaaagagtgatgcattttaaaattataccgtttgtagattgtggagaaagttcttaataagaagtaaaaaattagaaaatgttcatttaattgatttggtgtatatagttttgttcaaaataaatgtgtgaacatgtcttgctcaagaaaagcagcatttaagagggaaactcatcagactgatggttctatccgttgaagacagttaagatggaggaagcgtaaagaaaaagaaaaacacaaattagtatgagcacaaagaatgagcttaaacaaagctatgattctctcattcacaaatattatatattgtgcttttttttttctgatatcccccccttggctcctgcttctcattcctgtaaacagcagtgacacatcacacctgctgaactttttcacctccaactccaaattagaggaaagttggcttcatactgattgtactttactggggacagacggcagggtggcagatgggggagggagtgcctgtaattaagcaaaacggtttaaagtgtagctttcttagacaaaccgtggttgtaagttatagctgctctttacttgctaataattgcaaaatctattgctgccacttttgaggtttttttttttaaataaaagactattaaaatggaataaaagcttaataagtagattagttagaacaatagtcctcatgagaatgttttgattctgagtatagctgctaaagataaccctaaatgcaatcaggtttagctccctgcatgtgtgaaaggaaggtaataccctcagagattttgccaacagatgacattattttttaagtatctctttctacatttaaattagtctttcctctgggcacctgcaacaaaacctttgttaagaatcaccagagaaacagagctctgaataaatgctcagtggaaaattatttttgagaatttggttttagatgtttcacatcaaaaagatggatggcaatgcatccaagagggagcgctttgtgatccttctctgtcctctttgaaattttaaggatcaaaactcccaaggtgtccagagataagtacaaagggagccctgcaattttactaaacatatacacattataaagcgcaatgtgatccaatgtcaatgaaagtgtgtccatatcctgtcctttttgttttattttattaatttcattcctttggccagatatttattctctctctgtctctctctctaattctctccccctctctctcatcacatttttttttctgtgcactgaaagacctgtatgagactcaggaaacaatcattcacagacttgatcattcaaattgcaatgaacgttactactcaagagtgttcttcagacaggatggcacagacgatactgagagtcttcattacctcctgggacatgcacgttcacagtgagcctgacttccacttcctgtctctatccttccacttttttccttggaaggtattttcttttagattttcctatgtcagtgccctctagattacacatgctgttttcaacagcctgctgggcaaatctatcaggttccaaagaagtagtctgttttgcattcctccttgccatttttccttccccattcagttcatccttgcttcttttttgcatcccaagccattgcatttactcagctctgtaggagagactgggaaaccctggcactatcccaagtatgtagtttatgaagtcccctgtcaccaaattaattaaagggactctttcatttgcctgtctacacccacccaaatatgacaataaatgtgtaatcttgtgacttgtttcttttttccccaccatttgaattcagccttagactcatagttgttgaagtatagaggatatagaagaaaggcatcattaatatgatttggtctgacacacacctaccccaccccatagttccgtagcagtgctttatgaggataatgtgaattaaaatgaagtttatgttgagactattttgctgttgtataatagccctgacataaatggagaagcatttgagagtcccatcagccaaggagtaagctcatatttatttagcatagtcataaaacaggttaggtatcagtcactcacactattattttgaacagtagaattttataacctgatgttttaacatttttctcgggcatagctgaagtcagagtcatctggagactttattgaactacacagactgggccccactgcaagactcatcgacagcttgagtaaggcccaagctggtagatatttttagtttcccaagtgatttgacatcgagttaggcataagaaccatgaaaccagacttatacaaataaatattgtattttatagtgatctattatgtatgtctttatgaataagtgtgtgtctattataaatatccatttatcaccatgtcatgttaatccctttagaacacctataatataggtatattctacgtaaataaaatctttagctacagatatatatatatttatagctacagattatatatatatattatatatttatatatctccagaaatatagaataggcacagatattttcctaacaattatacacaattcctgaatgatacattctgcttgtaatatggaagttatgaattctctgggctataaacatttcaatagtcatagtaatgatcttttatggaactcattctatgtgcactgtgctgggataaatgtttttcctgcattatctcacttaatcctcacaacaaacctgtgaaactagtgcttgcatttctgctctaatgtaatatatgcattctttaaaaatcttgcaatgtgcaaaattatgcagtgaaaacaaaccaagatgatttatagtaaatctgtgttagagcagaccattcaaaacctatacaaactggtaactagggcatcaacaaaacaaaagacaatttcataaaataacaaaagacaattttataaaataacacactgacagagtatcataaatgtctgattcatttgtgtttgtgtgtatatgtatatatacacacacatatatatacacacatatatatacctttattttataaatatatgtacctttaataaaaaagatagattgattagaacctgatttaatatataacattaatgaaataaagataaattgattagaacctgatttaatatagattcactccccttgacataaaactgagatccatgcctgtggccttctggtgatctaacctcaagtactagaggggtgaatggatcacatacataccccacaggcaagtttcctaacccatcattcctcttaggctttcagtagaagcttagaatcaaataatcttatgtgatactctctgaagaaggtttggcattgcaatatattccactggttatttaaaatagatctgtgcgatctgaaaatcaaactgggtgttaacgcggtggattcctaaatgaaagtttactttaaaagatgtaagttcaggtgttcacgcaggcacctatttctctcagaagaggacttttgacaaaagattgacccaaggacaaaagaacaagagtggtgtgacaaatcattccaacagaaaaactttgctaaggatagctaatgaaaagtaagccaaaaattagttctactcttctaccctctctgtcaggcaaagcaaaaaaaaaaaaaaaagatgatttctcgaactcttaatagctcataagaggagccatgccagtttctctggagataccagcccaacctaccctccaacccccaaaacacacccagaattccaaaagattccaatatctttaaggctttgtataaaaagcattaaacaatcatgtctgttatggctgatagcagtgctaccaatgtgtagatgccacttattatatggccatttctatacacgtacctgtaggtaagactccataaagtaatttaaattatattttattatttaaaatctttcaggtttggggcgatggaaaatgtctgctgtgtattgttcagtattgtttcaatttttgcaatgtgtatatactgtttcaataatcataacaataataaaatgattctaattttagcataaaagatggttcccattaacaccgttttgacctgacccctatgccaaaataagtttgctcagtactcagtgagaaggatgctggtcctcttagttgtccaatggggaagttctctgaaacatcatttgtctctactaaagcccttgacatttgttccttcaactaagatgcatagaacatccactatgtaaactatatgtcaagtacttgagaatgtgatggccaggttcagtatttagcataccaaatgcttgtagtagcataggaggataatagtctgtgattgaaaagaaaatccaaatcactgctcaaatactcactttcaggctggtggtctcagaaaagggggtcaagtttagagaccccaattgaatctacagcttctattaaatttgaaccctagggacaccttttctccaataccttatttttttttttgagtgtagaacaattcatattatatacacccttctattgacctgtctatttgaaccctgcaggcacttgacaactaatgaataaaataatattgtgtgctcttggggctactgcagactcttttgtgtctataacggctcttatttttccagcaactgggagaggatacaacatggtgagaggctgtgtagaataactgagatagcatgggctaaaccccaggggcactaatgacattgtatccacagagcaaaatttgaatgttctgtaatgatgtcattaaactcctgaaaaagctaacttattgctgactagaatttctccattacattctctttaaaagaggaataaactccagggtgtgtagctatgcatgggtgttgacgttgaatagctgcctccagtcactctgctgaaactggctgaccttcttgcgtgcagtttagtcaactcagctgccctttcaatgaagacaaatgaatttccaggattatgcaggtcaggtcaccttaggtcaaaaactgattatacagtcatgccatcacctttgttctacctgggtatctttgaacgtttattctttaggtgctcacctttgatttggtgcccccaaaatgtttattcctgtaaaagtacatatgcaagtcaaatacagaaacccataactgatgcctctaacaaattcacattttttcccatggaggcagatatgcaaaactgacagtcaaaagcatttatttgaaaggcagaattgcagtaaaggaaaataataataatttttaacagacattaaaaattcgagaccaagtttctactgcttataacttgccttggacaagttatatcatctccgtgtgtctcaatttcctcacctgtcaagtgggggcattaatagcacccccctcttggggtggatcaagtgagataaagatttaaagtacttagtaagtattcagaatgtggatcgtgcaagagtaactgtacgtgaacttttatcagaggagcattagttaacagaaatgttatctttctaaagccagaatttaggttgtgtttctatactagctggtcacattgtcagcattgaagcttttataaatgtcttctagcaaatcaccacaatttttacattgttgggctctgctgagctctagccccagacaactccaaatttgcatttctcacttttgccttcttcatttcactgtctcaaaaaacaaatgcaagaaagtaaatcttcaacttagaacacccattctgtcaaactgatgtgctgtctgatgaatggtgagaaaaaaagaaacacatcaccccaggaatatgtaagctctccaaaaatatcaagtaagcccaatgccaatataatataatgagagtttgtaagtgcttatagtctaatgaaattggcatggtttattaatgggctgtgcctcctttgaatttggaagacaaaatgtcttgtttcctgtgatttggtgtgatacacaaagacttttgatatctgctgatatttaaatgaacccaaggatgtagaattcgatagtaaattgtcacttgaaattctcaagaagagaatctattttcagataacagtgatcctctgcttccattaataatcttgggctctctaaaattatatgaacccacagtacatttttgtaccatgtggctgatgcacaccttgaaaggctatgtctgagtgttcaacgacttgttattgctatgttcacgtgtcaccaggactgcctggctttaatcaaagcatccctggggtcatttgaaaacaactatttacagaaactttggacattttcttgaccacatgatttaatgactttatatgggaggtagtcttgcacagtggataaggaggttagaatcccagctctgctacttaaaatttggtggctttatttcagggtctgtatctttctatcaacatagtgggaaaaataatagtacctagctcaaagggagtaaatgagatctggtacacgtccagaatgaaaacagaagcaattgttatgttaagtcagagagtcgcattttcatgtagacagtaccacaaaaatattgttagatccaaataataacacagtaaatttatcttccctccattttcccatgttatcccagttactgtacactgctcaggttgcttgggtagtacatgaatgtcaaagatcagtctgactttcaaaaccttaggaaaatttacctaccccatgaagcctgacaatgacctagaacagacaacatgaactctcaagcccattcaaggagccatattatctaagccctggatcactgtaacaactccttatttacacagcacattcattccacacatggtcaaattttccagaatatggatgtcataggtgtcattgttttagaggcaggtccatgctattaatctttgattattagtatatttttctacctctgctattttcaacttatactgcagcctgtttctttacacagattttttttgctttgaaattaactacctttatctcactcattagtccccttctttactcattcttcttcatccatcgctaaacaattatcccataaaccagctgtcaaaacgcaagatgtggttcccggtttaattgggaacatacagtctgggtgaaaagggaaaactcaatgcacctgctctttattcttatttctaatgtctggtactcaagagtactttgacaaatcagaaaatgaacttgaaaatgtgtacaaagcaatatggcaagtataaagctatcctgtcacacatagaatatatacatttgtgtctgccccagagaagagtgatcacggttaaggggtttcattcacagaaagaagacttcctggagaaagagtgtgtgtgtctgtttcagaagctgaaaaggctgctttgggatgatagtttttatgcaaagtgactgctacctgctgctttattctgcattcatctcttataaataatatgtttttaataagccactgtatcttttgttggaacaatgcttcctagaattaaacacacatttccctcactttcaaaacgcccttgaaaacgttgtgattatactgggtctttctttgtgactcttatgtgttttgtcatcaagaaaaagtcaagctaattgaactatatgaggacagtgcacctgaaaatgacctcctgaagtcagctgctgtctataggtaattctctcaactaaatgtatgcatgttggacaataagggcacaaggtggtcagtggcctttccctctgcgctccatgcagactattccatctgcctttccacatgtggaggacaaaggaatgtcatcaagtctctttctcagttcctagtctaacagcgaacccttgtttaataatatcccagtgtttctagttaccccaagagaataatataacctgaaatgattccctaaacacagcttattttaattattcctaatgataagcaaaattttaccaaacgattctttaaagcaaagaatcacatttgctttgaatatgttattatgcatattgcttgtcacaccacacataaagatcttctttacaaagatctgcaaggaaacatttcttatgacagtactggaatagatgaggtagagaacaactgctttttttttttctttttaagacattataatttgttagaactttttggtttctcttggttggtaggcaaatcagagcaaaaggtttgctgtgattgctgtcttccatcaaaatctgtcagaatacattatggcatgtattctgtgtactaaccttacctatttttttatttttcaacttttattcaccacccaaaaagcatcatcattttgtaaaatcttgctttcaacatagatttctataggaagtatcaagtggttttggcgaccatttagttccaaaatatggtttatatattttaatgatatttatatatgataattatatgtttatatacttattatatatttatatatgataattacagaaaatactataaacctatttattaaaataccagagattctaagataagtttgaatagaatgtggttcaaattattaatttctcttccccaaatttaacagatccaagctactatactatttataatgtagaagaactagaaatagtctaaaagttaatcaataggcaattggttaaatattgatatgttgatgtaataaaataatatgtgactgctaaaatcatgatatagaataatacttaaagacatggaattatatttgtggtatattgtaatttaaaatgacaggtcacagagtagtctatgactgtttctgttatgcacaagaatagattttaatacatatgcaaacacatgcagaaaagattaaaaatatctgccataaaattatgactgtctctagataatggaattacaggtgatttttctatttattttatttttgtgatttttattttgtatttcctaattctctacgattaacatatgttatatttgtaatcagggaaaagtaaatgtctgaaaaagcaagatacgaaacacttcttgttatcacgtataacagattagttcttccttttaaaataagccattaaaaaggattcttatatactcaatgcagggcgttttttacttcagtggcaatggtatatagtgcctgaagattggtaaaaatagctaataagcagattctgtgcacagatttatccttttcttccctctgtcctcccaccggagtctgtgtttctgtcacagcacttgttacttaaaagtccagttatttgcttattatcctttgattccagccccagccacccattagactgcatctcatttgagggcaaagatgaatcacatttttttaggcattccataaatgtttgtggagtgagtgagtgtgtggctgagtgaaagtaaaaaaagaagaaacccttggtgccaatcaggccagaatagcagcagacaagacgccttctctcacagccaattttcttggctgactttgtcagtataattgcttcaaatccgtattttctctacctatctagctccagcctaaatgttgaatattgtattttccctcaaagaatgtcaataaagattttatttttttcaattactgttgcagagaatgtttccctttaggaaaactaaaatttaataacttttcttcggcaaagttgacgatctctttattctcgccatgatgactgtagtcaatcaggagtcagttggaagccaagctgaacataaagtaattaaaagaaaacccaaacacaaatgcaccctcttgaaaacctaatcacattatgagctctaagcatgagttatgaggtagctgtggctggctgggttttgatgaagtacccataatttcatatcagctgccacaggactttctgacttctctataactttaaaatgtgatttaccctgttatcatctacttatacagtcttcaagatctacctaggaataaatagtactaataacattctaagctgtattgctgtaagattcttatttttccatattcatatggtaaaattcaaatgataaaaataaagtaggtaattcattagatttcaaagctctggctgttaaaataaaagcatttcctcaattcagaaatcctggcatgaattcatatgttatcagctagtactatagatgaacttcttttgaaaatatgtacattatttttattcactttagattaggagtaatttgatttatttaaagttaagcgggtatgcggtagtgattaatttcaacataatatattcataattccactcttaccagttttctctcttggtactgcatgcaaatctttatttttaaaaaggtaatttaataggaaaacctttgaaactaatttcttaggcagttttcctgaaacatgttattagaaattgatactttggcattataagcagtgtagatttctattgtggaccagtattttgcagaaagagttacattttattgatgaaaaatctaaagtatagtcagtgtccctacatgtaaaaaaaggaaggctgaaccttcttgcaatgttcacctggaataggctgggagcttttctagaatgaatgaagcatttatggcttatggtccatcatggtggtaatgcttttttaagtcagctcttttcattggccaagataacctttatttttaagtgaacacactttttataaccatctggttaagtgtcatcagtctgtctctgcattaccttctcttttccttgttaactccttaccctgtgtctttaagacacaggctttggagaaagtatttcccagcctgtagtggactttccttctcagtgctcccataggctttgcagctgaactatttaattcatcgctccatcttccaaccaatattgagcccatttaatgccagttatagtacttggcactgggcatggtgataaaaaatcatgcctgtctttatacgattatggactttcagaaaaaaaatagccacaagtagggacttttgggaaaaattatgccctaacatagaataagttaaaaaaaaaaaaatccctaagaaagagttgggggaaaggtttccaggtaaaaaggcattataaagactgggggcaaatgaaggagtggtggttcacaaatcagaagttacaggtcagagggtgaaggctagaaatgaagtggggagattgaaaagggtgagatattgggaagtcctctaagttacagttaggatgttaccttaaagaccgagaaatatcttaagcacggagtgacacgaggagatgcacagtttagaaagcttagtttggccaaggtgtggaaaataaatagacaggacctagttgagaagctgtagatgctgtaaaccagatgagagacgacggtggcccagattagcagaagagtgtggagatgcaaagtactggactgaacccaataatgcttaggaaatggcaggactttgagataaaaacatctatctaccacgcatcctcgtcattccaaattacaattgtttattttgctagatcccctgtgtaactgagttttttataggcattttttataaatctggagcctaactcactgcttaacacattttaagtgcttggtgcacattaaggaataaaccttgattgatgctgtgtcataaacttgaatgatgttgtttttagtgtatccgtgcctctagaaaacagttctactgaaactgtaagagaaatgaagttgtgatttgagttgctaactacaaaatggttttcaaatttaattttctgttttcacattttaaaacaattacgaagtcaaccttcaaaatgggaatttttactctataattatatatgcttataaattgttttaatatgctccctaaaccccatagttcaaaccacattttcaatattattgtttcaattatttcagaatttttctagcatctatatgcacacggacacacacattgtttttcttcttttcttcttttttaatagaaaaggaattatacactacatatagttgtgctccttgctttttcctaatagcatatcatggctatctttccattttagacatatagcctagctcattgaacagctgcagctaatttcagagatggaagtacaatgattttattattcccctactaataggcatttatgttatacctattttatgtgatgtcataagcaatgatggaatgaataactttgtatatatacttaatttctactggacagatacctaaaattaggcttgctgaatgacaggatatatgcatattaagagtatgtgtgcttgtgtgtgtatgtatatgtgtatatatacatccatattctagctatgtatttgtttatatatatatgcccatgttctaattatgtatatatgtatgcatatcatatacataatacatacaaatatatgtacacatgcccaaattgccctccaaaaagattgtaccaatttgttatcccaccattagtgtaggagtacccagttttccatatcctcatcaaaactggccaaggtaggaaaaacatttttatctctttcaattttatatgtctgggtgacttctagatgttacttccaaatcacctattttctctttaactatgttcattctgccattctattatccagtcctactcttaggcatgtgtgtgtgtgtgcgtgtttgtgtgcgtgcatgtgtgcacatgcattctgtgttccttgagaaaaaaagcacacacacaaagagagaatgcccttccttccttcctttctccttccctttcttccttccttccttctttccttccttccttccttcctccatccctccctccctccctccctccctccctccctgcctgcctgcctgcctgcgttccttccttccttccttcctcccttccttctttttttctttcttttgctctgttgcccaggctggagtgcggtggcatgatctcggctcactgcaacctccatctcccaggttcaagcgattcttgtgtctcagcctcccgagtagctgggattacaggcacacatcaccaagcccagctaatttttgtatttttaatagagatggggtttcactatgttggccaggctagtcttgaactcctgaccttaggcaacctgcccgcctcagcctcccaaactgttgggattacaggcatgagccaccgtgcctggatgagaatgccttttcatagaaacttattgttatggatgcaatactctcttgcatttctttcttgataaaatgattatcaataattttgaaaaattattcttcttggattctggcaaactcctctgggataggtgtttcccttctttcatagtattggtgttccttttatatggagattctttgttaaccgttcgtatttatatgtacaggcagagctcaggctgtaatgctcgctcacctgccattcacctcctgctgcgtggcttggttcccaacagacggcctggggattagagactcccaactttagatggtataggcacagaactgtcaggcaaactggggaccctggctgtaacagcaagacttatggtattagatgcttgataaaatgtaatcagactttctcatagtttacattacacagaataattatactcaggctttgtcctttgttgttttattggtgaggagacaaataattaacaaagaggaaacacagtaatgacacctttctttccccaggaaaaactttcaaattacctataataagacttgatttaaaaatatatatctcaagacattactgcttttaaagcacatgacatctgtttaatgtattggacatgtctgttaccatagtctcctgcactaatggataataataatagcaactacacttatttctttcacagcaattataatctgtattaattgtgtacatttgtttgagttagagatttattgcctgtatcctctaatatctctgtgacatgaaggaccatgtctttttttttttccccccctgggcatcagaaataaaaagtcaagaaagtagatatggccctggctgccatttttatattagtttgtcctagttgctgaaaagaaagatggctcctatgatgtcatccttcccccggttgcacaaatgtcactaacctcttaagagaagaatactgtccatgcaaaatagaataatgtccactgcgcttatcgttaaaaactagagtgtggttttgttgttgttatataaatacctggttgaatgtaatataatcccaaaagctactgataattgggtttatgtgggagaataaacataggcagcgttagaaataacattgccattttctccatgccccaaatagcatggtttcttgagatagggaaaaccatatttgtcagacctgaaatttatgtttctctgaaaggggcacctgacattataatgaaactcacaaaagcatggaaagaggtttggaagaaaacgaaatgttccaaagtgtagaaataattgatggaatcataataatgctaattttaataacaatcgatctatgaatggcctgccagcttcactctccaacacattgtactcttatttatgatgactgtaatgtaattggaagtatttttcagttaaaaatgcgtgtagtacttgcataaaaggaatgcatcttaggtggctgggtggccattttgcttgcctatggctccccaagctttcaaaaagaagacattgcacactccatgtggatgtggcagtggggaaaccagaaggtctcctcctgcagctggcgaaagaaccaccagtgccagcttctcttctccagtcgtcattcaataaaaggacgcagaccaacactaaaatttattttgacgaggaaaaacaggaagtacatacccaggcctctgtgatgaggtctctaatacccactgggtgcttttgcatgagacagatggtctcagccttgcctacccatcccaactggttggtggtctttccaaatgatgccacctggctcttggttcttatgtgggtgagcacaggggtagcctttgtctcacataagcacaaagcaggaggcttttgcattctggagactctcagttcattctctgtgccttcagcatgaaaaatgcaccactttctgtatctacctgatcgagattgagggcacacgctgacattttatccatggtgtaaatgagtaagtacgtggggagaatgagtcatgcaacaaataaagaaatcttgtgctctcagatagagcttgggtaatatgtaaagaaagattttaagtctaaatcccttgtctgtttttccacattgctagatgggaaacaaagagataatttagttaaaacattttgttgagaggataaagtatgctataggctattttaagggtactaaattatttccttccatcgccagaagtctttttcccattactaatacgaacagtcgtatttgttgtaatgttataactgtcctaataagaatactcatctttactgagcacctactatattgagccatcttcacatgcactatctcagttgatctatgaatattttgttaataaatatccagggtctattaatgccactatatcatagatgagagaaaactgcaacatacagagctgaagccgtgagcctaaaggtacattgcttgtaagtggaaaagctaaattggaactcacataagatcttatggaatctagaccaccagctctcaattggtactcagtgctgccttggtggctcctatcctagggtcacattttagaaacagactctgaggacctcatgtggaattgttagtcatcaatattgctaagcctttcttctcattactgtcgaccttttcagaaggcaacttaaaaagagaatggtggaatgtttgtatcattgaatataagtgctatttttgaaaagtgactcaaatgtatagtttaagggagaaaatgaaatcatctgtgaacattaaaagttatctcttccttttagttatctcttccttttatttttacatggcacatgtctgccatgccaaaataagctctgccctcctgttttcaggccccaagcctgtgaaactctgggtcttcataagccatcttgaatcaatcagttaagcgatatccttttatccttttcatcaccttcctcagccttcctcggccttctttttccttctgtactcaattgtactctttcctaaagaatccccgatgtgatctttcacatgctgtgggaggaaatgtattttcaatatctcagtggttgatactgctggttcattgatatatcagtagtttttagagaatgtttactcctgtcttgcacttaggagtgtctacctgttcccaatgtgtgtagaagtgcaaaatctttttataagagtttaccctgaacatcatcaaaagaatcatgtagttgcaattcatgataaataggttatctgtaatgatatatgatagtctgtggtaggtggtaaaaaaaacacactgtgttcctgttgctaactatagggcacatttgcctttgcaaaaatgattgaagggtatagagggcgtgcagcaccaaggctgggtgagaggcctcatacgctttttcaacagtgtatggttgagtaccagcttgtagaagcaggtagttatcagcatgtggagcaaaataccctgagtttaaatctagcactacccctagtggtggtgttaccttgagcaagtcacttccacatcctcgtcagtaaaatggaaataataaaagtatgtttctcataagattgacataaagatgaaataaaataattcattgaagagcttaggctagtgtctgacacataataagacagcgtgtattgatcacttactattattttccaagatccaccatacttgtcccgtggcaaagaacatctttgtaaggatacatttgagaaggataggctatttccttcctaaatgcttaaagcaatgcagattcatgcttaatgaccaaaaagaccatttgtgtggagcctatgacttttcctatccttaatgttttagattagagatggaaaagtctgctgtcttaggtgaataatgatgcatgtctttatgacttaaaatgttcaaaggagctgtagagcattttttaagagtcatttcttctcaggcattgtattctgcaacccaaacgttgcttgctgtgtagttacttggggacctattttctttaggtagtgtctgcatagtagtcactctggttcaccgagggctttaaaaatggaaacgtttacaaaatagaaaggcaggtagggctccgcacaagtgaggcctgatgtgtttctatggtaaccccattccatatcacaagggtcaatctcatggaatgagatgatgttcagagatatgttctggaattttcttggctgtcaacctaactatttgggatttgaaaaaccaaaaaggatgggtagaccacttgaggtttgctgggatgcctggagccattagagatgacttagatgaatatggaacctcaagaaatgaggcttctgacacctcaggggttccctcagcttaggagccccatttctattaggttgatgcaaaagtaattatgtttcttgccattgaaggtaaaattggtgaaataattcaccgagcacatgttgaaatccaggaggagagagggaggagcatcgtccaaaacagccccagcttcatccccagagtccccacctgttgaaagggctattctcaaatctttaaaaacacattgccaaatacttgtaattaacaaaagggaatctagagtatgggggaagttatatctctgccttaatttgatcatctggtgttttgttactgaccttgtgtgatgtgttctccggttacctcggggaaaattgactcaggctgtactatagggcaccaagaaatggtttaagtttgatttctttaagtcaaagattttaaatcaaaatggtaccaatgtcacattacatttgatttatttgcatatctagagaatatatacgtatatgatctaagtattcagtgtaattgtcaatatgtattttttaaaatatgcatatgcacaaaggttatggagacccttattttctgaaggaaaaaaatagctggctgaattttcatcatcaagtagagaaaggtgaaatggaagcattgggagagggaacacatacatgtccaacttagttatctgggaaaaactatttatgtgggaaaaactatttctctacctacttaatgttttcattttgttccaggctcacgttgatggatatgcaagtttgctcacttactgtgctagcattgacgttgagagttcacagatgtttcagttgagatatttaaaaagaaattctaaatgatcaaggtactttgagtttaaaacttaaaaaaaaaatctactttatccagccaacttcacactatttatagtagcagaatttggtacagcaaaaggaagtgagaattgttctttcttcctctctgtctctctcctttccctttttctttttaaatggtacatttttgtatgtgtgagaaaacattagaataaacaaataagccaagaaaaaaaagcacttgaaaatagactgcagtcttgccatttagcaagaatcactatcaacattgtgagaaatatgcttccaggactttctctagaatgatatttaatgttgtaataaaatttacaacaataatagcggtatttattaacagttactctgtgccaggcactttgaaaggcactttacatttaatcctttatgaactatgtgcattgtttttatcattcttgatttatggagaaactgagggagggatcagtcaagtgatttcagcaacgttataaaggtagtcagagtaaatggcagaccccagtttgttctcaggaagactggttcaagattaccttctcttacccctctgtcatactgcttctcactgtgtgtattttgaaacagcaatggcgtggcgttttactattgctttatagtcttttttctcttactgtattgtgaactttccccccatgtttttatgtattcttctgtggcatcattttttatgattctccttgtgattccatctaaaagagcatgtgatcacatccttaaatgatcccctattgttgggcatgtagactgcaccacaatggagaggttgtttaattgagaatttccgtcatcatcctcaaaacactagtgttccaactaactcatgtaccaactttgtttgaaaaacaaaacagattgcatgttgcaagacagagctgctggcaaaatactccatcgtgtcagatttatacaaacccatctcctgtgtattgcaccatgtcctagaaaactgaaaaccatgaaaacaagtgctcatattttaaggaactcaatgacagctgataaaatattgcattttctgtagcagtttttacataaagcttccaccttaaagaaatggatttgatgggactaggtggtaattttttaacacaagcagtgacaaaataaacaccatctgttagtattgacttattccacagcattctcaggctgggtgattttatttcacttttttcagaaatggttaatgacacatctggtagtcagtgaaggtacactctgggtgattaaatgtggtcataagtttacactaaatgctgacagaacatttttttttcttttccattataagcaacggggcacatcggagtgcctggctggctactcattttaaaccttgtgtaggattaactgtttggcggtcgttgaacttccggaaaaacgttgttattttgagtcttctgagaagcagataccaagacaggattaggtatgcaagaaatttattgagggaaacacctgtgaaaactaaagcagaggtgcaggagaaggcgagaacagccttcagatggcaatgtgagtctggcaccagtgaagggagagtgggaaggaaagaggagtgggcaggaagagccccaggcagcagcacattctaaaacagtgtcagccaggacgctggggggtcctggagccccagttgcccatccgagcttttctgcatcctgcataaatgggcatgaattagtttcttcactgtgtccagtcattggcagagaacagacctaggaacctcagtacacacacagtagtggatctgaaggggatagccagtatggccctccatcaactctgttcccacagccagagatccgaggagtgcattttcatggtcaccaaaaatctcaacacaaaaaaatgaaatgatcaccgaattcatttatctctgcatgtctttttaaagaagaaaatacaatatttaaaatggccttttctcccctaatgtctccattggtctagcaggcatggcttgcactgcagaagactagcgtagctggaatagtaggtcccgtttatgctaaattctatcagtgaagggaaaggggagagtcctgaacactgttcttacctcttcatctgttcttttttttctttttttctttttttgagatggagtctcgctctgtctcccaggctggagtgcaatggagcaattttggctcctacaatctccacctcttgggttcaagcgattctcctgcctcagcctcctgagtagctgggattacaggcgtgagccaccatgcccaggctcttcatctcctcttaaactctcagagactctgctgctgctgttaattttgctttcagtgtgaagggttcttttggtttgccataattttgggcccatgacccgggaacttcacctcctatttgaaaagaaaatcatctgggaatggaagaggcgaaatttaggaaaaaaacacacttttttttttttttttttttttttttagtaattcaaaccccaaaacatattttgaggggcagaaggaaaaataattaatgctgtatatgatcacttcctacatgtcaagccattatattgttatcatccttaattcttaaactcttttgagacaagtaaagttatatttttatttacttttatgtatttttttttaagtttaacagaagaggaaagtgaggttcagaaagatctggtgactttttattggcacacaatgagaaagaacagattggggttttttccctgtttttcttgagttggtatacagagtagatttgccaaagagctcctcagttatgccagttactttacttatttgggaaggacttctcatatttatacagatatctttcttcacatcctgaaaagggcactgaacagagagagctgcatgctattaccattttttgcgactaaatacttgtgtggctgtgaattagttatccaggccttggttttttcatctgtaaagaaaggagattgggttagataacatttatcaaacttcagccattttccattttctatcaccttgatttctgtcccatctttaatgccacctataatatattgcttgatattttatttaaaataattcctccttgcaacttaagtgtctttaaaataaaaacattttgtcaccgcttaaaaggaaataccagtataaacaagtaaaattacacacacgcaatcacacacacatatatgtttgtatatatgtatgtacgtatatattcgtatatatgtatatatttgtatatatatccgtatatgcgagtatgtgtgtgtgtgtgtgtgtgtgtgtgtgtgtgtgtgtgtgtgtgtgtagagagagagaggaatataagcaatgaaatgctaggaacaaactgagactttctccttaatataaccagaaactttgaagacaaattgaaaacaaagtatttctaatgaaaatgttctggagacccaaagttgtttgacactttgtcacacttagtatcattttctgggcaaccaatgtcttatactgtgtcagacactggaaaaacatgacttatatattctgtctcacacacttgtgattttcctccctgccccaccccaaccttcatttacctttggcctcattttgcctcatccttccaattgcaaaatttgtaaggaccatctctcctctgactgcagaaatactctctgcatcttggctcatgagtagaaaaaaataagacctggaacaaataagaacaatttcttcctgttcttctgggaagtttcaagggaaggaagtagacagagctcgatagtctgggtaaagcctgaggcaagtcacactgtgtcttccaccagcaggtgtttacccagttaagatcagtttaaattgaatagtgtgcaaatgaagatggagttttcccttatatcccatttctccaatcttattgtgccagtctgccttccccgcttctgtccctcagcaatcaccaccagaaaattgtccttcactacatattccttgatggtattttagaaagagtagggtcattgcgctcaaacagaacttggttcaaatcccaactctccctgacttcagggaagagacgctgtggctcctggtggttaggagaactgggagttctccaggagagtcttcaggaaattgatggacaagggggatctcgctggcaggggaaagagaagtcagaggaagagaggttgggggcatagccctggtcccaaaccagttggcttttgcagagggtaagtgatacacaaaaaactatcttaagtagtttggacctgagatctgaagttgcccgtgtggttaaagtctcacctattttttagcaccatttgcgggagaggagtacctccttcttgaccctctgccttgctaccaaaccctctgccttcctgaataattgcttgatagccttctctttcttcctgccctctttgccaccccggaataccactacctgaaatgatctcatttctgcctatgtctacttgcttagtgctggtctcccctcactataatgtaaagttcataggacagaccttatctgccctgttcacaagttgttctcagggtctagaacagtgctggcaaatagtattaggtcaataattattaaaaaggtcaaatgaattggccgaaggcaattgcccccattcactctaacttagtaaattagttcctaattctggctgtgcactactgtcacctgaggctttattggaaacacagtttccagatcatcacccctggacagtctgattccatttgtttggggtgaacctgaggaatctgtatttttaattaacatctcaggcattttggacacagccagtgcctggactgataggtgggaattactcccacaggaaatgttactgaaaacagaactttattatcagcatcacctaaaccacatttcttatgttacagactataaattaaatatatatgcatgactttaaaaatatatacctccaagccacttccagtttgtgtatgtgcttctggcagaagcaattgtatttattcataccctgtatccaataaggtagggagacccagctgttcaagcaggtgcctccttcccaagaaaaagatagatcgattagattaacaattaagtggtgaactgttgagaggttgcccaaatggcctttgggctttcttctagaatggcatcaatgcacagtagaattgtggcagatggacgatagtgttgcatatgcactcatgctgggaatgaggccattttgagctcctccactggtccctcaaagggctgcctggtcggcttgatggcttgagttggcagtagggagtaacaactgagagcccgagctttagagacaaacagccctgggtctgaatcacagaatggccactgattaaagggcattttacatagcctttgcgagagcctcgtatgtttcatctgtaattaggaatgctgttctctaattcattggtttgtgctgagctattagtagagtgtggctggcattctgtatatacgatgctcaataaatgcaaatatcataacctctgggaagactgacttataccattccactgccgcaattgccgtaccaaatctccaaagactaagaaatctgcccctattggtcaatagaggggctaggcaaaagtgtttggttggtcatggaaaattgaggataatggaactttaatatgttaaaaaaattccttctccaaatttcatttgacacttgctatatgaatagttaggatttaatgaatacctttttatagagttacataattttcctgtaagatgcattgggtttccagaagaatgttgaacttgattcaattttagcttgattcgggctattcaaaatttatttcctgaggaatagtctcattggataaacttaggagttgttactggaagactgggtaactgtcataatgccaaacatcggtgctcctctccctcactgttacctaaattttaagaaatttctaggcaaaaaaaaaaaaaaaaaccacttgattaaggcagaggttattaagtatgggcaagagtgaagggcctggagttgatagtggaaaaaatatagcttagggaatttcatacccagaagcaaaaccaatatgtacatagatcttaatgctgtgtttcacttacagttcagagtccactgccttgcctagcatgttcaagatgttgtagtgccaccatcactgtatatgaaggctaattacttggaatattccttactgggtataagtgttccccaaagatttagcttaaggatggaactcaagagcccagcacaatcattccttttaactatttaaaatatattttggatgcacaacagactaattgattgaatgcacttttcacaattccacttatctaagatttttagaaaggcaccagaaatctcaagttgagattttagtattatcagaaatgtacaaaaatcatcagcctcctaaatcgacatcttgcttgagttcctctattcactctacctcctctgcacttatccagctcaatttctcatcccaagtgagcccatttaacatcttgtggctatcaacttacaaggtaagacagtaagagagggctggttctcaattatggccttatgttggaagcacctggggatctctacaaaactgggatcctgattgaattggtcagggtgtggcctggaactcaggctgttaagagcttcccaggtgattctcatccacagcccaggttctgaaccaatatttaaaatagcagagcatcccttaaaatagcagagcatccctttccccaggactagaggtgactcagctgtattttctgtgcctgtgtttgacgaattagttgcaaattatattcctgcttttacatagtaattaaaacagtcatgttttcatgggaggttccttcatgctgagcctatccactctgtcatttctttgcttccttagtatgttgtcttttaaatgagcttagtggaaaaagtctggttggtgcattctgagcctgctaatcatttctttcctttcccatccttttgagaatcgggccccagctcttaatctcttggtgtgcatgaatagttctcattagttgtggtaagtgcgttaagtgaaactaactatagaagctcactgaaactggaccgtgtaatcacattgttcatcagaagggattttaatgtttacatgcagaaaaaaaaattgtcatcacaagtagataaatagcccattattttacacttgagttggtacagcaggagcaaacagccaccaaactacttctgttgacattccagttgagctgcacataagagacatgtggatgtatcctgtatattctcagacaacattcatctactcttgcttctgatgtcatttcccaatggggtaaatatgtctctgaagctttattcctcctttgtgggaatcggatccccagtttttagccatgcttattcacagagcagaattttccagagtatgggagctacacataccataggcacagcacctgcagtggcattaaataagttgggtcacataatgaggggtaggcaaactttatctgtaaaggaccagatagtaagtatcttaggctttgcaggccatgaggtctctgttgctactactcagttcagccattttagcactaaagcagctgtaggtaaaacgtaaagaatgggtgtggcaccaaaaaaacttttatgcacactgaaattggaatttcatataattttacatgtgaaatgttattcttcttttgatatttttagccattaaaaaaatataaaactccttcttaactctagtttgtataaaaacaatccttgggccagtttgcagactcctgccattggaggagtctcagtgggatgctagactttaatgcctctctaaaacatatgaattttacattttaacagagggaaagggttcaggtttgtctctgaatcagacaaaaatagttagctggaaataaagcatattgtgttgaactttttacattttattttaaacattttattttaccctctatctgtggctactaagtgaatttctacttagaatggtgatttaaaaaaaaaaaaaacaaaacagaattggctgggtgcggtggctcacgcctgtaatcccagcactttgggaggccgaggtgggcggatcacgaggtcaggagatcgagaccatcctggctaacatgatgaaaccccgtctctgctaaaaatacaaaaaattagccaggtgttgtggcggacacctgtagtcccagctactggggaggctgaggcaggagaatgatgtgaacctgggaggtggagcttgcagtgagccgagattgcaccactgcactccagcctgggcgacagagcaagactccgtcaaaaaaaaacaaaaaaacaaaaaaaaaacaacaacaacaattgatttacaaacaaaaatattaagtaaagaagaggccaggtgatacatggctatgatgaaaatcatgaggtgatatttatgatatttgaagggttggtatttgggaatctgctgtccaggtttgattacctgtgagtgttttttccttgggaggaatatctgtagttctgaaaaaagtagcttattattttttcactacaacttatgatattataaaaatttaaaaagagcccctgatgaaacatacacatttcctctgatactttcatcaaagccagccaaggtataaaaaccaaggtaaagtaaggttaaaacttgtgatgagtcctgaaatgcatagaacaatagtagttccattgtctcccttcacagtctgtggatttcatgtagttctctgccacactttttatctcaacacttcacatgtttttactgaaggatcaggagctcacttatttatcgttctctaaaatggtgagcctcccttttctttgtatgaaaatactcaatatatgtttaaacaaatcaacagaaataggaaaaacagatggtgaaaggattatgaggcattctttgaaaagagagtgtgctgtattttctacacgggaatgaccagttgctctttgatctcaaatgtctccgttagcgcgaaggccctgcttgcactcaaaaccacactttgtcggagagactcgtgctacagcctcctgaggatctcccagctgctcctcttgcacctccctggaaccattccttacttcccacctcctcctcttccattctcacccagcagccagtaagaccttaaaaagtgaatcaaccagttaacagtcttgcttaaaaacctcaagaagctcatcacctaacttgggaaaacaagcgtctacactctctatctgaggccgtcaaccaggccctgcacagtttagccctgccattccatggcctctgcgcatgcttcctcttccttccagcccttaccctcctccagtttctcacacttgcctggttcttgcctgtctttagatgccaatagcaccacagtcatccctgttgtgacaaccaaaaatgcctctggatggtgctgaatgacctctcaagggtaaaacccctgtctgcctgagaaaggctgctccatctggaacactgtcccccatgacacccgctccttgtttgaagctcagcaggcacttcccttccatagaaggccctccttggctcccacttttagaaatagttcctccgatttgaacctttcattctatatttcacttttccttataaggacttatttcgaattgtaatcacgtatgcatcctgtgttcattagtttaatatctgttgactagattataagctccctgaagccatgctaatttgttcactgctttattttcagcatttatcacagtgcctggcacattgcagtggattaatccatatattttgaatgaaagagttatcaatttttttttgagatatagtttagctcttgttgcctggagtgcagtggcaccatctcggctcactgcaacctctgcccccaggttcaagcgattctcctgcctcagcctccctactagctgggattacaggcacccgccaccatgtccagctaatttttgtatttttagtagagacagggtttcaccatgttgggcaggctggtctcgaactcctgacctcaggtgatctgcccgcctcaacttcccaaagtgcttggattacaggtgtgagccactgcacccagccaagagttatcaattttaagtcaaatttatatttcataatcttgtggacctactattctatcaccatccctagctgttatgcttaggttatttaacaaagaaaaataagtcatcgggaacttgaaatataatcgcctgacaaggtatccctctaagtgattaaatttctgttttattagggttcaaacaagtgctcggtatttgcctttattttccaagaaaataaatctatctccaaatgccacagagagaaatttatcttttcctttactcattgtatgcactgatcttgtgttcagatctgattacccttaacaggcagcctctatgtgcagtaacttgagctcttttccttagtttctcctttaccagtaactccctggttgtttttaccttcgtaactacctttccggtcaaagtactgcatctctttctgtaagatgatggcttcagatcaccttctcatttttctcacgtttattttcaaatgtgtctccacacaagcccagcctgtcatagaccatgttttactgttctgagtgacttgacattccctgaccagaccatgctgtctgtctctccatcaggctccacactgttccctgtgctagaacactgtcatccataatggtctcctaaaaacagccccttaatccccaagattaactggatgtctccccgacccacctacccaggtcctggtctcctgggtggccactgcacagatatactgtactgcagttgcctgtttatttggttttcccttccattgcttgaaaatgcatagtgggaagaacagagaatggcttccataaatagtttttctgtgtgtgtgtgtgttttgttttgttttttgttttttttttttttttttttttgagacataatctcgctcttttgccccggctagagtgcagtggtgcgatctctgctcactgccagctcctcctcccggattcacgcctttctcctgcctcagcctcctgagtagctgggactacaggtgcccgccaccacgcccagctaatttttgtatttttagtagaggcgggatttcaccgtgttagccaggatggtcttgatctcctgaccttgtgatctgcctgcctcggcctccctgattgctgggattacaggcgtgagccaccctgcccggccccataagtacttttaaaagaaataatgaagttccttttaaagtgtaaaccccttagaactgagaattaattctacagttagctagttataaaagtctagagaaaatggaacataagacagccatatcttttggctttgattagtaaaaagaaatatatatgactgtcacagaagatagtcctaaatgtgtaagatgcttcacaaaacagagataaagagtatgtcctgtccttaaaattaaaatttggaaggattaatagtggctcaacacactagaatgctgcgttaagtagtatgtgaagtctcatccaagcccaataaaatgaataatttgatccatcagcaaagtgtgctatgaatatcaagcagggaaggccagaggtttagtgtctaaaactaaaggggtaagtaaagatgtaaaaggaacacccaaacgaaatctcggcttattttaccttatttttaagtcagagaattgtgtacttgaaaagacctctttccacatccccaagtcttactttacagatgaatcaccttactttcagctgaagcagctaaggttctcagaataagtatgctgagcatgtctctgctgtagccagatagaactagaacaatgccctgccctgctgattatctttgtaagaattctgaaccctgctgagtttatggggcaacattcctatggcctgacttgcagcttaagtggcttctgaatcgaacatccctcctccagtggttgagagacacagactggcacttagtaacaatgcagcaatgatatatttagtatcaaccatgagccaggcttttgctgaacagtttactatgcagtaggttccccacaagccccaacaatcctatgtagtagaaagtattagtttccctaatatgcaaatgagaaacctgaggctttaaagatgaactgacttggaaaaatcacatagctagaaatggagagagctggactttgacccaatcagtctggctctgaattcacttctgtaaatgcaataatatattggggttcagggaaaatttttacatagcacttttgaggacatcttgagttcttcagacctcttcacagacatgccatatcatagaaacagaaaaaaatttgcaaagacacttagtgtctctgaaaagatagaacaggcttaaagagtacctgactcaaaaaatttacaaaatcccactgctcccttgatagagagatcagatggaacatgaaataaagtacttcctttaaagtcctttaagaatttaaatgtgaagatagaggtcatacatgatatacattaagatgaaagtaattaagagctagcattctctggggacctgctaagtactaggggttgggccaagtgttttacaaacattatcactcgaatccccacaacccttgggcaggggcctgcatgttcaggttgtacactgcagaactccaaggggcaccattcatttagactaacatgcatggtagctttaggtggtgcagtggcctgacctatgagattgttaaacgtttaatggttagttcagacttcacatagccaggaagggactgagctgggattggaacccagaacactttactcacagagtccttgcttctcactgctcttggtacacctatgcccctgtaaacatcctctctcagggtagagaatcaggctaatttaatcagcatggccatgcttttctgggttatatgaaattattctctgtaagaatctcaaagccagcagttaatgatttggtaccattatcagttgattgtggatatcacaattcggtccatcttgaagtggtatgttttgataaactgattccatttaaatgtgtatcgattctatgttcagtaccattatccttccttttagtataacgtgcactgaaaaaataaaattgcgttcagaaataatacttagttcagccccagtacacacagttgttatatttcttaaaaaaaaaaaaaaaaaaaaaaaagctagcaagtttttggggaactccagggaaaacaatatgtgaattaattttcgtttcaaaagaacagcaggaattattcaggtaaaaatatttatgttaatatgctacaactgccacatttcatctgtgtgaccactagtgctttctaaacagctgctagaaaaatgtacacaagaaatgtgtgaggtctatggaaaatgtaatttttgtattctagctattacattttttcccagtcattacatctcccccaactcttgcaggatgtgggttttttgcataagttgcaaattcacagttaaatgaggcaccttttggacttggctaaatatgtatgaacatgaagttatgaatctatgaactggtttgaaaggtagaaccatgtgatgttggcattatcgtcatgttgggttttgggtgtttgttttttttttttacatcagtttaaaattactttgcatgaaattagcatagagtagcaattactcattcttactctgtataccttctcacgttccagtgagaagaagaaaacaacataggttcgtgacatgtaatatttgagaccattgactttgcttctcactaactgcatgtgataatttgggcaggtcactgaagctctggttctgtgtcttacttgaaaaataggaaggataataagccctcacctcatagattgttctaagggttcattaaatagatacatacatacaatgtttggcaaagtgcctgattcctagttagtggaactctaaattgtagttgttattactgtattgtattattctctggtctgcattgggaaaggatctgcctgcattgctgtataagtattttgttattttaatgatagtttctaacttttcaggtgacctttccttattgatatttatgttcatgttgtgataaactggaactatactaaaagtaaatatgtctctttaaatgttattttctatcagttccttctagagaatatttgttttggcaagtagaggtatatcctgctttaatcaacccatcaggcttattcaattcaaggaattttcaaccattttgaagattgcaaaagctattgagaactataaaatgtgttccctgcctttgaaaagatctggaaaaggattattgacatctttttatacagaagaggaaacactctgaaacgccaaagaaaggtttacatcaaatataataactgatgacatgctgatttaagcatttaatgagcaaatcctattaactctgcccacccattcattcagttacacaaatgaaataacatctgaacttccatgcatgggtgaccaaatcccatacacaaggtaatgaaggatagagctgcttgggttttactatcatgtctttccatgggaaagttctgcctttcacgtgtgtctaggtgctctctttattagctgaattcatctctgtcttgccaacacacttgcttatacactgatgctatgatttgggtcttgtgtgtctctatggggccagattactcatagaatttcactttgttttaataaagaaagggctaatttatatatgtatgtatgtatgtgtgtgtgtgtatatatatatatatatatacatatatatatatatttctttacatagtaaaagttttcccaagaactgctgtgtttttttgtttttttgtttgttttgtttgtttttattgtttgttttgtttgagatgcagcctccctctgttacaagactctcaggctggagtgcaatggtacaatctcgactcactgcaacctccgcctcctgggctcaagcgattctcctgcctcagcctcccaagtagctgggattacaggcatgcgccaccatgcccaggtaatttttgtatttttagtagagacggtgtttcaccatgttggccaggctggtctcaaactcctgaccccatgattcgcccgcctcaacctcccaaagtgctgggattacaggcgtaagccaccacgcccagccacttttttattttcttcaaaagtccttgcttacacacacaacctctctccctctgtctccctcttgctctatttctgtcttgttcttgatttctctctttcacatatgcacaggcagaggcactcatacctacattcatatagaccttttagtctttcttctcatggtattattccatatgccacaattgcctcggctacaactagtccagaaatttccaatccatagccatatatgctaaatgacacctatagtaagtggtatacagccttaaaaagactacattaagccagacatagtggctcacacctgtaatccgagaactttgggaggtggaggtgggtggatcacctgaggtcaggagttcaagaccagcctggccaacatggtgaaaccctgtctctactaaaactacaaaaattagccgagcatggtggcacaccaccgtaatcccagctactcggaaggctgatgtgggagaactgcttgaacccaggaggcggaggttgcagtgagccaagatcgcaccaatgtactccaacctgggtgacaagagtgaaaccatctcaaaaaaaaaaaaaaaaaggctacattaactcctgatttaagcagcaaatgaattgggtgtgagtcttacttgttaaacaaagaagactctccgtaggattactttatatcatttagaaaaagacagtttttatttttttctggaaatgtacggtagaacccaagaagtagtatactaaattagtactagtcttcaaaaatgtatagtctcattgatgtactgatttcagaaaaactacgtcagcaacttaggtcttttcgtgtgatgtagcaattagttttctgctaggctgatagaagaaagtaaaaagaggcaaggatttgttcctcaaattattgtgcttaggtgttttgttgtgcttcaaaagtttgtgtttggtttttgtggttatttaacccctctttccagccccctttcttaacctgaagaagaggtggaaggaatagagaggaacaaggaaggaatcaagcttttgtcttaataagagaagaaattctttgagggtgcaaaattatttctaggtagttctgaacttggtttcctcagagaactgtgtggtggaaattggccgtggtacaagcctatgttggattaccttgcttaaagcttttaatcactcatttgagttccaccttggtatgggatattgagaggtagctggagggaggatgcatcttctccacttaccttcatgaggccacccaatcagtcttttcacactctgggtccctgtctgaacagaggacttttatttgtcaatacagataattcctctgggtgtaatcttagcctatactttaatttcaactttaagaattttgtttttctgagagctacaaccatggcacatcttatccaacaggagccattcctactcattcatttaatacaaacgcgtaagaccaaaatcagtgtgttaggtgaagtcattccttgtgaggaaaagtaaatgcctctgataaaataatgtttcaccctcctgcatcatcataattaagaagataaaatgtattcaaacagaagacttaaataccaatattaggtggcatgggattgagtacagaaatagcaatgaaggaagagggcagtacaggccagaaaaaatcaaggaaaaagaaggctttgaataagaactgcacagagtgactttgagttgcagtaaccttatgtgggttaactggttttgcgttttttggctgtgttgatggagttgaaagaatcagccctttttacttgagtactttaaatttttgtgcattatctttaggctatggttcttgatgttgaaagaaatatgatgtcttcgaggcttttctctaggatgccaaagagtggcaccttgggtataggaaaagagcatgtgttaggtctgctggagtgtgtgtaatagaggtagatggagctggagtgtattgattctttatttcttgtcagtccttggcatgcattattgacagtggagattgaatactttgaagttggtaaaagtcaccatcaagaaactgtgttgctttgagtttgcaggaataactgaggagagaaagacaaaccccttgctgtgctctgcctacccctgggctttttgtgcactggattatgaaaagtgatagaagactggaactttttatggtaaatatctaaagggaaaactttgtccctatagtaacccttttagcaaatatggttgtcatgttcctgctgcatatgactgggactgtgctgagctcaaacgaggtgatcagttattatcaacatataaccagctaatggatgagcaaatatttaaggaaacaaaataattatcaagatcttgacttcttatattcttggaaaggtagagtaattgatagaaacctgagtgtgcctgcaccacccacacaccctgcccagcttggttgatctggatggaactttagaagacgttctttatgattaacctgtggctgtattattggactcctccttaccaattgtctacctttgctatctatttctgaatatagaggtaaaagagggtgtacagtaaagctttgttatttattggctgtggtggggaggggaaataaggattatcataacactcaattagagttacatcctgttcagggcagttctccaagtgctccctctgctccaaacttagtgataatttaggcttataaagcaaagagacattattaaaaatacatcaagtttcatcattgacacttcctaccctttgacaaatacttccctgtttcccctactccccagcccctgcagtttcccattcctactctctgcttctaggagtttgactattttagatttaccatataggtggtatcatgtagcagttgtcctttatatctggcttatttcagttagcatgatattctccaggtttatccatgctgttgcaaatggcaggagttccttctttttcaaggctgggttatatatatatatatatatatatatatttatttatttatttatttacttatttatattatatattatatatatttatattatacaatatatatttatgccaatagatatacagtgtgtgtatatatataattataccagtatatatgtataattataccagtatatataccagtatatagatggtgtgtatatatagttatactatatattatgcatagtataatcatatactatataattatatagtatgtaaaaatatattatattattatatagtatactatatattatttatgctgtgatatatattatgataagtatatattatatatgtatcacagtatatataagaaaatatatattagaaaatgtgatacagtatatataagaaaatgtgatacagtatatataagaaaatgtgatactatatatatatatataagaaaatgtgacactgtacatatatataagaaaatgtgatactgtgtgtagatatatctatatctatatctatatatccattcatctgtcgtggacatttaagttgcctccatgtcttaaactattgtaaataatgctgcagtgaacatgggagcacaaatatctctttaagagctggttttcaattcctttgaatatttacccagaggtgggattgctgaatcatatggtaattctgtttttaattttttgaggagtatctatactgttttccataatggctgaaccaatttatattcccatcaatagtgttaaagggttgcccggccgggcgcggtggctcacgcctgtaatcccagcactttgggaggccgaggcgggtggatcacgaggtcaggagatcaagaccatcctggctaacatggtgaaagccccgtctctactaaaaatacgaaaaattggccgggcatggtggcaggcgcctgtagtcccagctacttgggaggctgaggcaggagaatggcgtgaacccgggaggcggagcttgcagtgagccgagatcgcgccactgcactccatcctgggcgacagagtgagactccgcctaaaaaaaaaaaaaaaaaaaaaaaaagggttgccctttctccacatcctcctcaaaacttgttttcttctgttttcttcatagtagccatcctaacacatggtaggtgatatctcagtgtggttttgatttgtatttccatgatgattaatgatgctgggcaccttgtcatataccagttttccatttgtatgtcttctttggagaaatatctattcagttcctttgttcatttttaaatcaggttgttatggtttttgcttgttttgctgttgagtaataggagttccttatgtattttggatattaaccctttatcagatatatggtttgctaatattttcttccattccaaagatagccttcttgttttcttgttttctttgctgcacagaagctttttagtctgatataatttgacttatctatttttgcttctgttgcctgtgctttattgtcatatacatggaaaccatttccaatgtgtttgtggcatggatcatagtaatggtttcatgggtgtatactcatctccaagctcaccaagttgtatatattaaagttgtgcagctttttggatgtcagttatacctcaataaagtggttttgaaaatgcaccaacaaaaacagcatgaattgtacatagtataattctagaaatcttagaacccactgcctgaatgccgtctagaatcctagcaagtctaccttctgtatttcattaggctgtggtctcagatcccgaaccagactgaagacacatagaaacatctgaacatctgaaatctgtactgtctcttcagtggattctaagctgcctcagctttaataaaggtctttaagtaactctacttagtagagactctccatcacttagaagaatggtggccagaggcatgtcaaagtcagaatattaggtatggtttaccaaggtgaaaaggaacggtgtggtgctcggagttttctggtccaagcatttgttgggtcaatgaataagagcagggcttacctcttgccttgctatgtttaaattcattgatattgagagacagtccagggttggatagacaaatcgatcttatctgaaattctgattcctattgattggtagaagctgcctaagatgttgagttaagaagattataatgtcatgacatctggactcagtacaaagaagagttatcacaactgaagagtgtatgctacggggaagaaagtgatggagagagagagagagagagagagttagatgataggctatattatatatacataccttttagatacaaatatactgtattatcaaaatcatatatgcacttttaatattgagagtgtcactgttagggtgaaactgcaccatatagatggcagatactgtctacttgcccaccaaattattccctttcttctcaggcaaacaaggcaactggactacaatttcatcctctcttgaagctagacagggccatattcctgagttctagccaatgagatatgtagaaatggcattcctcacttgcagacatggaaaataaatctttccacatgtgagtcccagttctatttctccattcactggcagaagggatggagaggacttgggtagaggaccgaggagagggcagccacaaggaggagcctgagtccctgaatgactgtttggatttgaggcctccccgccagcctctccccctctgcctgccaacctgcattgtcatacagtgaaaaagaactatgcttttaccgtacagtgccacagaattggagttgtttgctctaactgactaatactatatatgttaaagttttttttataaaaacataaagcacaatgggagtatataagagattgtaattataaggtagcaaaaacaccatttctctttctatacaaacctatattgttatgtgtgctaagaagtctccccaaagcattctttcccttttatgaaatgggcgagtctagcacttccctcccctctgcatatatcacacagatgcctcaaactgtctatccaatacagtcctacctcataatgactgtcagcatctaaatccaagtatagtcacagaaactatgccagagctctggaggaagtctcagtggtgggcagacaggggacacttctcccccaccgccccatctgcagctgcgtgcatcctccactgcatcagtttcctgctttgtagtcctgtcttttccaagctgagttcactgcgtggtcttctcttatccccgggttatttgatcttttactctaattttctcaccagcacttttctatttagtttttatagaatttatttctccttccctacatgtaattttttgtatctatcttatttgaatttcatttcatgtaatccctccagtgcatccaggccattttggattctaaacgtgttgtctcttccctgacagctgggtattcagtgtagagtacaaatatatacttagctctaatgtccacaacacttataacagtaaaactagagtgaaagtcagaagaagagatggtggcggtccagaagcccagtccaactggtctttgctcttgcaacagggcagcaggagtgaatggagaactgacatttaggacaggttctctgtctctttctcaggacagctttgtctctgtatatcgtactcaatctcccctctcttcagacccacattccttgaccacacgaaagaacatggctgttgacaccccaaagttttacaccttgtctcttcaagaaaatggctcttttaggagtggttcaaaaaatgagagagaaaccaaaagcgagagtgagagtgagagagtgtgggaggaaaggcaagaatgagagagagaaagagagagagggggagagaggaagactctttttggtttaacttgatcaaccatctacatttggtctaaaaaattctagaaaagagagcagagttttggagtaaaaatgaggctgttgggatctcgaacttctggataagttgaggggaatcattataaatcaggcaccacccccaaaagatctactggtgatggtagtagagaaattaaaaggtagataaacaaaggaagaaaaagaagtaatgatttaacttcctttgaacataaaatttaccagtaacaatcactctttgagaagaagcatgttgttaacatattctgttgggttctgtttgactctgtggtggtatgtgtgtgtatacatatgtacacacacatacaggtatacacatgcatacacacacacatattcagtgaatacatactatttgacatgaattacaccaggtactaaagtagcccttatttttaagtgactttcgatttcatgggggaaaaaaacaacaacacacaaacagagaagtcacattcttatatctgctgggcagaggagccctgggagcacttaagtaacctaggaaaggagaatgacagaaagtcttcccagaggaacaagtgcctgagctgactgtgaaaggctgaacaggaaggagccagatgaacgacaagagagcagaacattcaagacagaagggataatgtgaatgaaggtgtgacaatgagaaatagtatggtgtcttctggaaagggtcagcccagacttgccatgacataaattaggaagtaaaactaggaaagcagtagggaaagatgaaagggcagatttcaaagagcctttttgggcaggttaataaatccagacattaacctgagggcattgggaaaccactgaaaggttttaagcaaaggaatgacacagtcaagcttgtatctactacagatcactgtggtatgacagaaatgcacaaaacgggtttaagatgaagacaagctgggagacagggagactagttgagtagttactgcggtaatctagggcaaagatgatggagagctaactaaagcagaaatagtaacaatacagctatctattattcatgaattcaacaagtagtcattaacatgtcttctgtgtcctacactgtgctaagcattttacatgaatcatcttactgaatccccagaggcctatgaagccaggtactggaattgttggtgagaaaaatggggctcagagggctgaattacctggccaaaggttcaaaactaacaaggaacaaaggcagtattcaaatccaagtctgacaacaaactttagtaatcaaccaccaatccaataataatagctataagcaggaaggaatacaggttaaaaatacatagatgaaattagccaggctaggtgattgactaacttccgggaatatgggagaagaaggcaccaaggataattctcatatatcgagtatgggtgtctgggatagtaagtgcagaaaaactgttttaaatgtttgacattcattccaattcactgcaccaccaggaaagtcagtcatctggcaacatcgctagcccactggcccttccacattctgcagctagtcaatcttcccatccttttcggcctggacccctgggccaatatttccagcaatctgctttacagtgacttcagtctctttgtcccctggcctttcacaatgcccaccttgccaatcacatcccttacatcaaacccactgtttatctgtgccagcttctgggcagccattcagtgatatctgtaaaattcagccaggtactggtgcttttgctcaatcatctcttttccttcttctcccatcagtcccccttcctgttttgcactgcgctcatctccttagacccaaccagccacctgttctttgcagtgtgcctttgaataccaaggtcatgcaagttgaggtctctctacatgtttctctatctttacccatttttctctcttcactcttctttcagagtaacactcttatttcagagtaacttatttcagagtaacttgccaccaactgaaccttgatctatcaattgtgtgcaaattatttttaatacattgcttaaaatttactcatggtacaaattcaaacttatttttaatccttatcatatctatgaaaaatactgtctttgttagcagagcattcatcatcctaaaataaactatgagaagggctagactttcctcatctttatctcaggacaggatgaagtaggttaagctccaatcaactcgatcttaattagcccccaaatgatgctttacttccatttctaaagccttagttagtgaattactggataaaaaataagtttaataagtaaagaaaggcaaaagtcatgaatatctctacaaatgaggtattttagtgtatattccattaacaagttttaagatgtcatcaattgtaagatattttttaaataagaggatttgggggaaaattaaaagtacaaatgtcaatttaaaccagatttcagaaatatgaatatgaaaatgtgagaaaaacaaactggatcttataattaagacaacacagcaagttttccccctagaattatgtttctgtctgtctagtatgtagctgtctaacttggtcattttacaaaattcctattcatgccacaatcccctttgttaaaaagttttgcttcattttttgttttatagggaagaactatctgagacacctggtaaccatttctttcttagtttagaaattggttttgtggtactattactcaataatcctattcagaaatataagcatagcttcagtaaaggttgaaatatcaaaaggaaagaaaagcctataactgagggagcttttttgaatatggaataaaacatgaatctagacattagaaaattggaacatatttttccatgttctaccccagtagaagtttagagaagaaaagagttaacttgctctaaaatgcagtatatttctttcggcaaacacccatatgtgttagtgtgtgcatgtttttcttattaggtgaaaaaatcatgctaggtctggattttagcatcttcttgctagaagcaactgattgtacctatcaagcccaagacagagcccagacaaaagtattttcctgcctggtgggctcacagtttgtgcagctttatgtatgtatgaacatccattcatatatgtgtatacatatgtgcgtgtgtatagtgtgtatacacatgtatatttttaatgacattttggaaaggatacaatagtgtttgtattttgcagtgagtgcgccagttcataatctatgtttattagaatgaactaaattccttgagcctctgccatttttcctaccccctacgaagattctgttttcccctcttctaaaatataacactggagagaagtgccaaatcaacagcccagaaatcgggaagctccttttttaattcccatcctgtagtactccccttggatttctgtgccaaagctggctgagagcgctctcacttcagcttcctatttaacttggctggtactatcttcctggtgaatcatttcacgaatttgggcatgggtactgatctcatacatcaaacacacaagtacatacatacaatgcacacacacaaactcaggaacacctccatgaatgctgaccacatgcacttgcatatgcaagcatcaggcatgcgcacacccccaccaccacattcatgtgcatatgcagacatgcacatacatgtgcacctccatgctcacatacatgcgcacatgcaagcacaggcatacatgcatacatgtgtttatacacatatgcacacaatttggtgagcacacatgcacgtacatgcatatgcatattcatgtacaacacacacttatactcgtgcgtacgtgcacacacatacacacgtagacctgatgccctttttctctttagcacctaaaatttttcctctgctcccattttctcatttcccttttccccttcagcattcccaatattgacatgcttgaggttattatatagttcatcattgttcagaatatgctatctctactcacaaggtctggatttatctttccacaagaccattgaacagtcctgtgtgccagctatggaagttttcataacctgcctgaatagaagaaacatcaaatcactgaagcttaaccctaaagaagtgagggtcacctcagccttgccttctgactcaggctgttcatgttgtaataagtgagggacatggaattgagcacttcacaaagccttctttatagccaggagtgtgatcacaagtagggatttccatgtatttcctgacacatttccctcttactttgttgtgaagggatcttgattttcatgttctagcacttcccccatggtgcggttttctttgcactagactgaagaaagagagttttaagttgcttcttctgcaagggcaagaagtcgcatggattggggagtgggtttacccttccctatagatcttatctctgctctttcttctgttgtttcgtgcattgagaatggcattgttgggtctgatgtctgctaagtctctagaaaatactggaaacaagagcaaggggaaggtggcatctcttagctgaattacccaagtccattgaatcctgccttcttgttttgcatgcacctgggcttcccaagcctctgagctcaggattttccaacctgctagcgtatggcccaacaaaccaatggcatggaagcccttgaacaataaacaaataataggaattggcttttctaagaaaatcagacaaataaaagaaacaaatttactgaaaggatttattagccagacttaagaaatgtcgaccagcaccaatcctatgaggttcttaggatattttccctgtcttttgcttatcactccaacccagaccctgtgccaaaactcattaccactggggctatctcgacagccccacactgtagcatttctccccaggattggtggggcctggaaacgcatcataggtgaggaaatggcttccaaatgttagcttagaagggctgaactactgatgtagataattaattgaaaaccttctacccatttctttttttctttttaggttctttaaatggaatactctctctttcttgttgatagaacttaagagtatctactttatactgattttagtgtgaggctcaaaggatgccaagaaacacaggacatagcttctgacctcaaaaatctcttggtcttggaaggaagaggcagataaattagtattatggcttatctggagtacataatcaatggacaatgattgggaaggctcaagcaaagatcccaagagggaagctgtgttgacatgataggccagaggagatagattttaaattatgtgttaggagaaagagtacagttagttacaataatctaaaattcaagcaggggagaaaatatctacaaaaaaatagtgaacacctggtttctttgaggatttcttaagaagtcttcagctggaggcaggtggcatgggctacggtagaggcccagatgaaggggctatagaggccatgacaacccgttaatccaaaatgagccattgaagggtttaaagcactggaattaaaatatcattttcaattgttttaacccctgggatgttttgattttatggttatgaacaaagatatgttcaacagaattctaccaaggttgataaattattattgagacaggatttcctagggacaataagactaagccaatttaattgctcaatcggtttcatatacctttccatatagtgtcatttatgcagagtaaatgataaggtcacattttctttagagtcaaaatgacagatgaaaaagttcacgtagcagagtggtgggttcaaaacttgcctctttggattctcattttatatagaacatgcaagcttctgaatacgaaatatattcccactgcattctactatttttcagtttgaggattcagctattttagaagtttccgttattagggattaaacaaattatatttttttaagcgactgaacatgttttaaataggatttttatgaagaggaaaagtagaagtccagcaattaggcacactttatttgctgccatcgctctgaaagtggtggagtttggagtgaaggtataatccttgcagccattgcacagacccacaggcgtctgccagtgtgtgccaggagcccgaggctcttcaaggccatggaggagcatggccccccattcagcccacattaactctggagtgcagaaaagtgacgaggtcctttgtagtggaaacagtaactcctgtcacgaaggcttgaaaacaagtcacttgggtgttgatgatgactggaaaactgtattttgaaggatcccaaggtatctctttaacattcatgccttctcccacaatctgctagtctgccgacttcagctttcatctcctggaataccacccagttctcgctgttgcatcgtatctgtgaaatgtgcatcattcccctgcctttcatctgagagtttataccaagattcaagttttcatcggcagtgggttcatgtcagttagaattaatggcagtttcactcattggcttttattgttaatatttacataccttccagattgtggcttttgggtagggaggccaatggaatgcaaaatgagccaaagtcaagaagcacagagctttgctcctttccttgaaaaaaaagttgcattttatttgtttttaataaataaaatgagctttacagcttccagtaaaatagccaaaaataaaatagaagactgttttatgcaagtcttaggaatccaaatgaatactaagcagtggtatttgggagctgggtaaaaactttctgacacaagcattactatgcctataatacagaaatccgaagggaaaaaaaatcagtttcaagtcttttttataactttattttcaagtgactaaaatttacataaagccatctttactcaactttgggtctttttttatattttattttattttattttattttattttattttattttattttattttattttattctattctattctattttattttattttatttttgagacagtcttgctctgttgcctagactgctggagtggagtgcagtggtgcaatctcagctcactgcaaccttcacctcctgtatccaagtgctcagcctccctggtagctgggactacaggcacacactaccacacctggctaattttttgtatgtttagtagaaatggggtttcaccatgttggccaggctggcctcgaactcctggcctcaagtgatctgcccacctcagcctcccaaagtgctaggattacagatgtcagctaccatgcccggccaactttggtcctttctagcactaccaagaccactctatcctgctttcctgaccttggcattcaattaagtattttgaatgcttcatcctcaactatgaactgaccctcccgctacccgcctcactttaagttctcaaaatgagatgacttagaagtaggttggacatgttctcaagtatcctaaaataacctgggttgtatgtgaaagattcgatggacataggcacctcatactctgaacactttgcctccttgaatgcttattaacttttgctaggatgctatactttttataccatccatctcttctgaaattttattaatttcagaataaaaaaattaattaattttttttggcttcttgagtaagtgttttccctttctggttgaaggacttatagcaaaggaattgagcatgacctttggaatcagctcttcaatacaatcaaagctgcatcgagaggctgtgtgcccttggtttacctttctgagcctctgtttttgaatctgcaaagcgggattgattaaaataaatacagactgtaacctctgtggggtagaaactgtatctgtttgctcacaggtgttattccagaggaaatgcttgggcaagcagaactttgtctaaaataccacagtgtacttcctgttggaattcgaagttggtagttctacctttgtcaaataccctgacttctcttttgagattttcacactgctaattcccaaaggagatttattttaaataggtgatctttgaaggtctctgctgttctgaaagtctgaatatctagcatgcatatatgaattggattttagctgtactgtcattgttatttccggaatcaaagggacttactggcttcctgcaacatgacttggggaactccaactccttttgcaaagtcaagctcgggggatctatcacccaatttatttttgtataaatgtttttccatgtcttcctaattgactccactccccatcctgttgctgtggaactggccctgctccgaggacctcacctgaagctgtgtggtgtagaaaggatgtgctgggcttattgtctgacaaattgggtcctgttttggggccactcacagaagagctggtgaccagggcaagttacaacttccctgtagctcagtgtctgcatctctaaaacagggtaatcaccactgtcctctctgcctccctggagacaatgtacgtgaaagcagtgtgaaaaatctcctgggatgaacaagttcaggatgagccattggtagtattgaaaagcacagatcctacagaaccctctgggactaaagggggccaaagtcaaatacatagttcaaaacaggttaagtgagtcttgatatctgaattattttatccattgtatagtggaaagaatatgggttttgaggtcatattatagatcgggattcatacaaattaaaaataagccaatttctaagcacaacaaagcaggcttcagttaagaaagtccagtttgagtcaatagtttgggttggatttttttttttcttttcttaagaatttaccggttcggtgatctctgacatatcatttaacctctctgagcctcagtttccttatcagcacaatgatgatactactgcccatttttcagcttcttatgtgtgaattagagagaaaatatataaagcactgagcatagtcctgaagacacacatgcccaaaagacatatttattattgtttctagtttttatgtttttcaggtatacaactaaacctgatgttgaactcaatccatatgttaataatgctttttttaggtatgaagcattattctgcatttatatgcaaataaagacaaaaagatgtctacccataaaagcaaagacaggttgggaatgtagttaaagtagatgagaagaaggaaattctttgtcaaattgaagattccattcctattaaaaacacgcataacttacgagctaaatttcaggatggaaacactttttgaaatggattggcctacatacttgtgaagactccgcgggaccaagtcctgttcttctgtcaatacccatggtttcaataacatagcacagaggactagagagagaaggcagttctttggtgacaagaattgagattttaggacaacactaggatgtgagaaaaattcctaagggtttgagttcagagatcctggagaccagaaggaagcttcgaacagctggagtggggtttccacaggaaaagatgtgtttctaaggaggtaaaaggtgaagtgcatgtttgatgaactgagaatgagtgcagaatgacaggcaattaatagcctaagctgtggaagaagttcgagttaggactaatggacagaagaaagtaaaatctaaataaccagaatattggcaataaagtacatgcgagagagtcttctgcagaactgagcagatcctccagaacagtggttctcaaccagtggcgattttgccacctcaaggaatgttgccctgtctggtgatgtttttgttttgtacacgtgggtgagtgctactagcatctagtggatagaatccagggatgctgctgaacatcctgaaatgtacaagtcaacaccctcccaccacccccaacaaataattacctggcccaggtgtcaaaagcacacaggttgagaacccttgctgtagaatggcatattccaaactgcactccactgcatgcaaaggataataacacattttctgtgggttaaaaagaggggggggcttggggaagggaggttctaagatccaataaactgaggaagctctgtgtctaataaacagatttctttattatagaatgattctgagtacttaaaaacaaaaagcatttccaaaaacaattttctaagaaataactttgaagttacaagtgttccacaaaacacgggacaggaaacactgatctagtatttcatattaattagtttttgatagaatattactaattacctacttgaaaaagagtagacatatttgacattaaattgttaaaaataaacaaacagttaaacataaaacctagccatgcatatgaaaaaaatatgaaagcacacaaagattgcatactgacagagaatgcatcatccggatagtccaggcagtgatgaaaccaacggatgttccagtacatacttcccttctaccatctgtagcactaagaatgacaagagtctgatgtctcatcaatatgccgggatgctaatacaaccttttccttagtaggcactctatatttgaatttattgtagatacttaagtgattctccccacccctgtttgtaagtgagtagttatagcagatgctcacatcagattgctgtgtttgtaaaaggattctattcatttgcatgtttttctctgaaatattgcatttatttatttcagtgcatcttcttagaagatgtattcaatagggagcaagaataatatatactcgtggttgaatgcgagaccataatttaaatagaggtattggactgacatcagagatttgagtgaaagtggaagcccagaggaaggaaggggacaatttattattgtttacatattacactgcagctttagattcccttagttactacttgaatgtaaaatgtattactcagaagaggatctggaatgaactctatgcagaagacgaagttgggtgggtgttgtgctggaatgaaagctgcagtcgtctttgcagatgccagtgtactgggaaataggcatgtgtatttagcataataaagtcctgcattctcattgcccaatcacttaattttctaaaagaaaacttatatcctatctctcttttgatcctacttactacaatattaagggatttaacagccttaagaccttttgtccttcaatcattcattagtttgatgttatacctaatccccatttccatttgcagagaagtcagtgaatagaatcagctaccattattaaacaggttttaaaaaacgtaccacatcacttgaaaaaaaaaatgatgaggattttttggagtggtttaattttgtatctaatgcaactaaaaaccttacatattctttttttctattgctgtcataacagattaccaccaacagacgcttaagcgaacacacattgattatcctacggttctataggtaaaagatccgactggatttccactgggctaaaatcaaggtgttagttgggtttcgtctctttctggagcacatagcaaagattctttcttcgcttggattcctgcttcaagaggctgtttccattccttggttcatggccccttccttcatcttcaaagccagaagtgtagcctctctttgagcctgctttagttgtcacatttccctctgaccacagccaggaaaatttccccacttagaaggacatgtggatgagttcaaactcacttggataatccaaaatattctccccacctcagggctcttaaccttaatcacatctggaaagtcccttttgctatgtaaagtaacatattcccaagtcctaggcattaggacatagacattgttgggaattcatgattctgcccaccgtgctttatttccttccatttccaatgcgatttgacagaaattccaaatgattccccccaaaatcagaaaaacctatttcaaagtgttttataacacattagctgttacttctttagctttgaagtgaaattaacccagacgtgaaatcctcagctctgtttccttcccactcatgctgtagaaataaacctcccaaagatgctgagtaggctctgtcccagggccaatgatggctggtggaggttggtgggacatctcccctctccacttccagctataaatccccatgtgtcacccaaagcctgcatggctcacttagagaagctcaactgagtgacttctgcctcccctcaggcactgactcctacaagcagacaattactggtgtcagcaagcatgtgcctgtggctcgctgcatgattagccgttaatatttggttttgaactccatcagagataagctgttcttgcagcatatcaaaccaggcaatctaatgcaaaggatgctatggtcagaataaagagttgctcattttccaagagataagtaggtagatagattgatagatagataaatagatagatggatacatagatataggtagagatacagctatagatttagatacagatacagatatagatatatagaaatagagattttttaatagactagtttttagaattcacggattcttgttgagggtgaaaaagaaaaagggatacagatcatgacgtcaggagatcgagaccatcctggccaacatggtgaaaccccatctctactaaaaatacaaaaattagctgggcgtggaggtgcacgcctgtagtcccagctactaggcaggcagctgaggcaggataattgcttgaacccgggacaaggagactgcagtgagccgagattgcgccactgcactccagcctggccatagagtgagactctgtctcaaaaaacaaaacaaaacaaaacaaacaaaaaaaaacaacttttgagctaagttctcaaatatgtttctacttcaattttaggtctctttctcctaaatatcagaaaatgtctttgtccaatatgagtagtcacggagaaatgaggcagtttattggtagtgagagtgtgatgaggcaaccaactacaaaaaccctctttggagctagaatgatagtgttagatttctatatccctcaaggactttaacattataaccactatgtctgtcattaaatacacctgaggttgtgtattcagtgattataaccctattggcatgcttttaaaaaaattaaggctattttttagtctgtgcctgaaaaccacatttttaggtcccactgttggctaaggaaagagttaggagttcattctttgcccaaggtgctgggcttattttattaaaacatccttgcatggtgactttccttatattcaaagttcattccagacgcccagcctgatttggcccctgagtcctcatctagtgccactctctcccttgctcactcttgtgcagtcatgttgggctttttctgtttctggaatgtaccgaattctccagtctccccacccttgcacttgaggctaggtcttttcccggctcctccttcattcataagtgcattctcagcaaaaccgccagagggcgcctgacacgtgagctctgatctgtcttcaatggcctcccatttcactcgagatacaagccaaggctcttatatctagcaggaaggctgtccaccatttgaactcagtttcttctctgacctcctcttctgcctactttcttttggttgcacccctggacttcgctgtgtgcctcaaatatgctggatatgctcccacctcaagacctctgctgctgctgttccctgtcctaatagtcttcctcttagtgtacacaaggctccctccctctcttcctgcatcctactgcagtttcaggttctagaccaagcatgtagtaggtgctcaagtaaatatctattgaatgaatgaacgaaagcaggcattactgttcatggagccctttctgacaaccctttatttagcaaaatgggatttgcactctgctaaggaacgtgaatctaatgtaaaagatggtgtcccagaaggctgtgaactttagtgttcagacacactgaggtataaatatatgagttccacagcccttctgactttctgtgcagctgacagtacctgtttgatgagaattaagtttcctgggtactctgtaatttaaccaggacaattgttgcagtgagaccagagattgtttcttttgcttttgcccattcttgtcttatatatctcattgcatcttatatcagtacaatattggtaaatactagcacaaatagcaaactttctatgtagtacacccgttaggcctcagtgtgacttgccttcctctccaacagcagccttgtaaatggttttggaaaagacaatctgtggataaattactagttttttttttttttcccatgtacttactgtgtgactttgggcaagtttcttaatgtctctgaatctcttcatgtataaaacagggttttaaaaaattctacttcatgaagtcctcatgtattcatttaataaatatttcattgagcacttactatggttgaggcattatttaggtgctagggaaagagggatgtacaggacaaataagatgcccaactttcattctattgggtggagggaaggagggaagacagtagagtaggaaggagatgacgaattcagtaaggtatttttcatgagtgatgagtgttatcaaagaaataggcccagggaaatgaaatagaaagggaagagataggaacaccacttcaggttgagttatcagagaagacttcatttctttgtggctgagatctaaatgctgagaagaaaccaaacacacaaagatcctagggtataatgttccaggcaagggtaaaagtaaagttcaaagaccctgagacggacagtagcttgatggtttggggaacagaaggaagactgtcgagcccgcagtcgtagtgagagtggtattaagggagctcagagacataagcacaggctggattacggcaggtaagctctgcaaaaagtttctggcagaaatcatcttaccactcttcctggcacctcataattatctaataaatttaaatgtcctttcttttccaaatttcaattttctaattagaagaaggattatatttattctccattaaaataaagggtatgagcaaagttatgttcaaatagtttggtatgcttgtgctaatttacatttgtcaccaatcatgattttaattaaatacatgggaaatggattcttattaaaattcaataaattttttttttaccccaaatgtggtcaagtgttttcccctggatttatgtaagcataactcctatgatatggtgtaaaatgaatcacactttttttttaaagatgcttttgtttgagtatcttcaagaaaaatctgttgtgagaaagatcctaaacatatgtatgtatagatgcatatctttgaaagcctatgtgaataccaagggaatctgaactttttctttggagatgtttacataataaatctattttcatcaatctggcatatttttctcctagcactgacttactgaatgccgctgaccacgtgctgcctctcatgctaaatgcttacttaattcatcaccaaattctgtagactgtacaggctaaacacctctaatgcatttacttattttcatcctcactgtccatcacactccctccctccctgtttctgcaacagcttcccaattggatctttttaaatgcaaattggatcctgtgttctttactttaaaatatttgtatggctcgccagtgccctgagtggtttaggggttcttagcttttatcccttatttacttttctaagtgcatctgttaccacttcctacaggtcagggtcacgcttaagctcctcccatcctcaaagaagccttactctctcgctttgccttgtcccttttgcctgaaatccccttcctctactctactttagcccctccaccattaccagactaatctctactcatccattaaggcccgcttcagccctctcccaagggctgcactccacaaaccccgcccccacatgtctagttattagcacttcgctgtgcttacacaccttctagaggtatcagaattatcacaccccattgttaggactggctgcctagccatcccactagattgtcagatggtaggggcaggcatcatgactatggggttcctcttaaatcccagtgctgggcacgctgcacggcatagagcaagtactcaagaaatgtttcttgaatttaaaaggtgcctttaaatcaaatgcctctgaaaagggagttgataatgctcctcattacctgaagtttagcttcatgatctatggtcaaaaacatccagtttggtcctacctgtggaagcatattgactgcccttaactcaagcccttaactctctaatttcactgatttctataatagaaagaagtattattattacattgtttatcatggagctaaagtttagtttttgcatgtgaataggcgaggccccttctcacccctttccttaccttcctttttatttatttacttatttattatttttagagacagggtcttactctgtggccaggctagagtgcagtggcatgatcattgctcactgtagacttggcctcccaatctcaagcgatcttcctgcctcagcctgccaagtagctgggactacaggcatgcaccaccacacctagctaacttttttattttttgtagtgatggggtctcattatgttaaccaggctgatattgaactcctggcctcaaaggatcctcttgctttggcctcccaaaatgctgagattgtagacatgagccactatgctgggcccccttttcttattcttagcaggagcattccaaactctggaaatctatgcccaaaccgttgctttcattccacgagcttgctaatggccacagatgcctgcaacattcctcaactcccctagctttcagttttatcctgtaaaattgattgctttgaatttctattgttagtaattaattgaaagaataagtcttcatgataggtcaataaatatgttttatggatgaaatcccagcagtgcaaatgcaaaacttgtgtgttttaaattttaaatggttaccaaaatgaagcctccaactctactcaaactacagcttgcaaaatcagtaatgaatccattaatttctttttttttttttttttttttttgagatggagtcttgctctgttgcccaggctggagtgcagtggcgtgatcttggctcactgcaagctccatctcccgggttcatgccattctcctgcctcagcctcccgagttgctgggactacaggtgcccgccaccacgcccggctaattttgttttgtaattttagtagagacggggtttcaccgtgttagccaggatggtctcgatcccctgacctcgtgatcctcccgcctcagcctcccagggtgctgggattacaggcgtgagccaccgtgcccggccatccgttaatttcttgacattgtttttcacatgccttgtgtcagctcccctaggcatctactgagtcccacctaaaacaaagactactccatacatctgcaatttttcagctgaggtagagaaatggagaagcttactactgttgtaacgtagatatatttgttcatgttcaccttgatctacttttcgacatcactggccaaggtttaaatttagattcatctaacattttgtgtgcacacattgtgctaagaacactgctagatactttacatgtattttatctgtaaatattcaaactccaggaaaaagttatttatttactacagcaccattatgcagatgaagatattgaggcccagaaaggtttaaatgtttatttaatgccacacagctgttaagaattcaaatctaagttattgtaactccagtacaaactctttcctttatattgtgctaccaaataaatcccagggaccctttgcccttttgggataaatattaccattatttttctggtctttgtgtctcattgggaacttgctgtgagatcctgagagtgtcgcttagcttatgcaggtgtgacttacagcctgtgtcaacaatctggccccaagtaacatgccaggtaacagtttcaagcctgggttacttgaaaagaaggctgagtaggttggtgggaactgggaccagtcttatgatggaggaatatgctgttgctattcttgaaattcttttcctccaccccacttcatcccctaccccttgttgttggcaagatttatcttcaggtatccagggaagatgaactcaagctacctctcctccttcccttcattttgtctaggtcctcagtcctgcctacacacaagtattagataagtctccctaattttaaatggaatggctggccaggcatgatggctcacgcctgtaatcccagcactttgggcgtctgaggtgagaggatcccttgaggccaggaattcgagactggcctgagcaacattgggagacctcgtctctactaaaaaataaaaaataaaaaaaattaacggcatggtggtgcgtgcctatggtcccaactactcaggaggcaggaggattacttgagccccagaggtctaggctgcagtgagctatgattgcaccactgcactccagcctgggtgacagtgaaaccctgtcaaaataaataaataaatgaatgaatgaatgaatgaatgaatgaaatagaaagagtggctgagggagtatgtgtttcattctgtgttttatctacagctcgagaagcctggaactctgtggtcctgcacctccccctacaccccccaacaaaaattagcctccaatcagctcctggagacaatgttggtgggaaccacaagggttcctgggcatgcccaatctctggcactgaagaggagattcaatcaaaataaatgtatgctgtcgaggccaggctggccatatgttcctgccaggcagttgtcaggaggagatatttgttacattcaaatgtggacacaagctcctacgaaggcaaacacttgtcatttaaagggacatctgaatatggcagcatgtttccagtgataacccaatttcattttacagccttttccttccctttctcttgggctctgggcctccttaccaacacatcctgttggccagcctgctctatcacagcagtatagttgaaaacctaggcacagctttctacccataagtagctttgtaatattcctaggaggaacttcctttctcccttcctctcccacattgcctctttgtccagatgttaacgtggaagcatattgactgcctactttcaagcccttaactctctaatttcactgatttctgtaatagaaagagctattattattaagtttttatcacagagctaaagtttagtttttgcaagtgaatagaccactattctccttcctgtgttagtaactgctttttaaagctcttgtgttctattaaaataacaatataaaattatgtaaatgtgctaattgctttattgaaattaatacccttatttagcaagttaaaccttgcaaaatgaccatttttattaaaaattatggaagcatgctggctgtttaaaggctaatgtaattgggtgaactcagcaactgggaaatgtcaattaatgagagattgttaaatagtattgtttaaacaatcaattttctcttgcagtttggaaaatggtcctgataaagtaatagtgactatctaaggcctgaaggaaggtttgtgagtattttttcccatctggtttttagatctgttggattttcttctgggtgtgtcaaaattagatttgtttagtaatagaaatttgaacttggcagtttatagaaaatcaggatagttctcctctgtgaaggtcattttctagctggcaataaatggccacatgcaacctctgccaccagaccgtgagcacttgttgaaatagttggagacatctaattactttctcctgagatggtttgcctttttcttagaacaggattttgagactataaagagatctatctctctgctcttgatagttagaattattgcgtctccttgataagatattgagtatccttcttatgggtctgagtttttttagcttctctaccattggaaataacaataatgcttgccacgaaaccatctaaaaatccatcgtctttgcagtagccttcaaccggaactactgatagctgttcctgcagtgccgttgttctcattggagcatactacagaaacctatttatgaaaatatcttgtggtttccaaatagttgtaggaaagggaatttttggtcacttatgcaatttacagaattgaggtcagttgaggatgttgggatagttctgactggagctgtgaagacaaaggtatgagtaatactctagatctctaagctcatttccaattgtatattgtttgtgagtcattggctttgaaaaccagaggagaggcccacatttgagtttatctgtaaacacccgtttttggtgtcatccagcatttgaaagtaatagttgtaggtggtggatcatgtttaatttctagggctttttgtgaatagatgataaagtgctcctttattatatgataagacacagctctccactctccctcccactctactcccccgtcatcctggaactaaatcaccagagggtttaatctatttcaattttctttgttcacatcagagatgttttgggtttgttctgtggacttcttatgactaagagtattgattttattaatccaattgtttgtgaacaaaagctggctttttttattgctggaactgaaaattagtgacataaactctgatatcttaaaaggctaaactcacatttttccccagaggcatttaccaaactggctgttacatttatcctttcctctactaaatttatgcaacatgaactgcaggataataagcgtaccaatatacttaggttcctaagagtttcaacataatacttctcacagtgaaatcattggttcagttataagacactccatgcactattgaaatacgacctaggatgcacctagttttactctgatttctgtgtagatgtggatgcaaggattcttttgattgaaacatgtccttagtttccatgaacaaggcaacatacacctgatcattccacccttgaaagatgcaaataatctttcacgttttatattaaaacaccagataaaaaccccatgccagttgactaaaatgagtttctaccctccagacagttttttttttttttttagttctaaggaaaatagttcaattttagctgtatcaatagcgttttgagcgagatggaagatgttcgcctccgttacagagggaatttcaggcattgcattggagctgaaatttgctggcacctgctgagtgagatttttctggcctgtgctctgagaacatcttttatcaagtgcatgatcatttatccagctttttgagatctaaaccaggtcattctttgatctttatcttactctgaacttcctaatggttgaacccggtcagaagagggtgaatctcagtcctccagacccttcaggaagaaagtcatcctgttggtagtttagttttctttgtaacaaaagcattttttttttatttaacctattttatcacttgaaaatctactattttgtttctgccatcctagagtgtgtttggtctaattgaatctcttcatggactctgggtggtcactaaagcatcaatttctcagaggttttttttttttttttttgaaatatttaaggctatttgcttgcctccaaatggttccagactactgcatgtagtttttatgtctttctttggtagtatagccttctcatttgttgctttcatgctgttaccttgtcacaatgcctggcaaaaagtaggtgctcattaaatatttcttaaatgaatagatgatagtattttctcttccttttctaattgcctacttctaatttgttgatgttttggaaatcaagtaggcatacatgataatattgtgagcaaatcaagattaaacagtatataattgcgggctttaatcccttggaaagtaaaaagccaggacttattttgtgatactgatcttgtgacaactattttgactactaagaggtggcttttaaaacatgctttgtgctttggaactgagctctgaatccacaaaaactgaaatttttgaattccaattaggtgaggtatctttgtagttagttttccatccaatggtcattaccaacacctaagagtactcccagaagcaggctgtagaaaaatcactaggccattactgtgtttgtgcttattttaattagatttcttttagattttttaaagctgtccagggagaaaatgtgtcccttgtgaatgcaatgtccattatgtaaaacttaagtgcatcaggggctttggaaagtgtaaaatttatacttagggccctgtttagtcaatgtgatgagatttaagatcaattataggggaagaaaagaactggatacattattgtttttaagaaaacttaaaagatgataagtatgttttttgtctcactgccaaatggttgacagtttgcttttttgaattgcagtggagctttttgagatgttggtcagagccacttctgctactctcttattgtgttctggctagaagtgttgggaggacaagaaaatttctcattagtgacatgtagtgacacttcactttattgtgcacggatgattttctgacagagatagatgacatggttcaagtttccaagaaaatgttattccatcattgaatggggaagctctgaaccaatctttccgatttacaaacagaccatagatgtgccaaatatgacaaactgatactgaaatgtggagccttgaaattgaagatgtttccttgttcattgttgggtatataaggttacaggtaactgagtacattaaccatgccatgtgttcacttttcattaagtagtgacgtggatggtgcaaggtcgatagagaaaagtctccattagtctgaattttttgacactagatttttattttcctatcaggaaatatttttttctggagcagaaagggcaaaatagtttcctccattttctccaacaggagcatctcctcaataggattcctcagcttgactcgctggtgtcaaagagaaaggcatattcccaggcagtggcggagttgattggtcacctgctaccccttcccttctgtaacatccactaactcctcatctccttgccaatagtgcccactttctgtttgacatcaaggaactaaatatagttagttctgacagaatgtctagtcagtgctgtgtcagtaaatggttaataacaggcactgagggcctgagtgtggatctgcttgtaacatctgatgatttgatttccatggtgtaagtattctcactatgactaatttcaagccaccaaagtaacatcgaatgtgaaattaaaaagaaatactaacaactggctcccatgatcccataatactcaataccagcatactactacctctattccaaagctgctgttttacatacaagaaaactgtgatctaaaggagtgaagaggcttttctgagatcgcacaaacagggtaagacttgcgccagagtacctatccccaacttctgaagttagtttttaataagctgatgatctgatttacttatgtttacatatgtagctgctaactgaaacaaatttatttcttttaaacggaagggccccttaggttctttgcttaagaccagaaaactagccaatgtttcacaaagtcagtattttagactctgctgcccagtttctggacaagaatcccagtgtatcttaatggaagcggctatcatgtattgcgtatatatgtgccagtcactccatatgcatagtgccacagaacccacagggaaggcatcatctttctctccacattgcgtatgaggacactaaagttcagagatagaaacttacccaaggtcacgtctcatacgtactaaggagtgtagtgagatcttgaccccaggtttccttgacttcagataacactttgccttgcacttgctgcattgttctggagaggtcttatttccactatgtgctgatggactttggggattttctgtaatttaggaaatatttgtgggaaacaaattactgtaccaaatgaaaatgcagatggagcaagggtttgatgaacaggtaggtagctaatagtatccatggccctttggggttctgatcatagtttttagtattttccctgctacttcgtccctcatctcatctttgagatttggtaaagctaactgtgaggactcacctgagaggacccacatcttatctcaaaggtccttttaaaaaataatatgagaaatattcatccacttctagaactaacggtgaataaccagtagttaaaatctaaaaagcaggcaaaagggttgcatcttttaaataaatataaataactatattaattagatataatcatatataatatatgcaatatattatatataaataatatataataaatatattaatagttaatgacaacaaggctggttaaagcaaaggctgcttcgttttatccttcttgtgccaaacgaatggcattcctatatgattcccatagtttgccagtgtgttctatctacattatttggagtgagtctgcagctttcagtactgtggtctgcattaaagtgggatgattagcataatctatactgcacccttaagaatatgggggcaattaaacactgagcttgacctaccgccctcttttgcagggcagagatgatcctgcacagcagaggtgattataaatatcagttctattcattcttcctctcaactgcttcgtctcccttccttccttcatctctctttctccacgctctacacatgcaatttttaacctccaaaactggtgaaaaactgatggcatcaggctatcttgctggaaattgaaaatgccagtcaaacagggtctccaaatatccaagtatctggatgtttagggtggtgtagacaaattaaccagatgcatccattgtgaatctggctctttttggagacctgtggaaacaacaaatatctatatataaagagaaaaataatactaacaagcaaacaattgctttgaagttccattgcaattgtactgttatatgtctggcagccacatccagtgtctgaaaatcgtggtcgtatttgctataacaaatcattcccactgattcccatgttgaagtctgaaaatttacagatgaaaaaaactatgtcaagatatccaaggcaatttctgcatttttaaataaagaaatagaagtagtgacctgcttggtaaagactaactaaaatgtcaagttgcttctttgtgaaaatcagaaagtttgctttgtgttagtatgagaaaaactaatcagtcaatactaaataaatgtaatttggtaaacaaaacctgttacaactagaaatacttagcagattttttaagaataaaaagagggggctggacttgtgaaaactattgaccaggaagttctttgaccaggctgagtgcagtgtctcacactttgggaggccaaggcaggaggatcgcttaagccagaagttcaagaccagcctgggcaacatgtcaaaaccccatctctacaaaaaatacaaaaattagctgggcatgttggtgcacacctgtggtcctagctactcaggaggctgaggttggaggatcacttgagcctaggagatggaggttgcactgagccaagatcataccactgcactccagcctgggcgatagagtgagaccctgtctcacaaaaagaaaaaagagaaaaaagaaaagaaaagaaagttctatgaccggttcataccaatccagccatgattcactgtacacccaactaagtgccatacagcagtgaggtcaagattgtacttgtagcatatacaatctaggggggaaaataaagttttacacattcgatgaatgttaccaaagtgtattagtctgttctcacactgctaataaagacatacctaagactgagtaatttataaaggaaagaagtttaattgactcacagttcagcatggctgaggaggcctcaggaaacttacaatcatggtggaaggagaagcaaacacgtccttccttcacatggcagcagcgaggagaagtacagagtgaggggtggggagaaagccccttataaaagcatcagatctcatgagaactcactcactatcgcaagaacaggaggggataaactgcccctgtgattcaattatctccacctggtccctcccatgacacgtgaggattatgggaactacaattcaagatgagatttgggtggggacacagccaaatcatatcacaaagggacttagagatatctatctagaatttctgcttctaaccaaacagaatttgaacaggagagtcatttacctatagttagtgattttataggggtcaaaaatgcaacatcctcaaaattatccattttggcaaaccagtttacaaatcctatattgctcacttctttgggttaaggtatttaaggtctcagtaaaagataatgctgtaagacaacgatgtcaagccattatgaaaccttaaaaactcgactctaataaatgtgttggattagcagccagtcacctaggacctccacagaagccctggctcaggaaaaaaaaaaaaaaaaaatcctctgagggtctgaagagaggaatttggagaggaaggaatccccgaaatgcatacttccaggtgagggagccccggtgggaacttgagaagtcttgttcctatctgaagacccataggctgaaagagatattgaaaggaacatcctaacaaggggctgaagcagccacaccagacaattctgatggggaagtctgccttccctagccagtgaactagcctggtagaacacctgctagatctggctgcagaaaagcacaagtctccctactgaatggcagcaaaaatgaagcagagtttctgagatttgcccaaggccatagaagcagtccgcctcacacctgggattgggattcagatctttctgccttccagaaagacaactcctgtcgctcccgatcatgtcctatttttaagttcattagttaacctctgggtacttagccagttccaagagccagtacgtcaaagcgtttttaaatggacgagcctaaagtgatcattgtctggttggcccggctcaccccgtgagctcctgcaaatgttctgtggttcatacagaggctggctgctcatcaacaagtttctctgggaggtgggaagcatctttcttctgatcagaacatgcctgtcacagagcgccggcggctaccaagcagtgcctgctcgaaagagccactgccccagcctgggagtccaaaatctgtcttctggcagaggctttaactgtttggctgctgctttcgaaggtccatgctggtacctcccaggaagagagaacccagctgggaagctgccagttgcaggcaatcttctccttcatttcaacttaacaagtatttaatgtgtacccgctgagggtccagtcctttggggtatgcagccctctggaggtctacaatcatgctggggagtccagacacaagcaggaggcaaccagatgatacatcaaggctctacataattaagagctctgcagtcacggctacaggaattcagggatgttcagggctgttgatgtagcactgcctctgcaaaaggacaactagcagtatttagaaaggacccaaagacattgtttctgccctatcagggttctttgtctcacactaggacacaagtaaaaatatcaggcaaaatgagacctctgcttaaagggagagctcatgaaaatgaatggggctcccctgatgcacaagattcttctccagacagttctatagggcactgagctgatccctatcactctgaggtcaaagggaaggctaacttggcctcagctgtcatggctgtgttgttaatcaacccttccatgctaaactcccagctccaatttgcctcctttttcttgtgctgatacttgttttattttgtccttgcttttcagcatttgctgggcacccacagggttctggcactccagcaaatgcctgggtggcagtggagtcataactcagaagacaggatgctgtgcgtgactgcttgatatctagcaatgcagtagcacggtggaagtttctggctgtgttaaattctaattgtttatataataagagcgtagcattggggggctgttataacatggagtgatgtgttgagcttgagcttacatggtgttagatcagctttctcacacttctgatatcctctcacctcctggaagagtgacttcttgagctaggcaatttgcttttagaagatttattgttaagtctgattaagtaattattagtaaaataatttgttggatgtctgtcccccttgcaaaactgtaattcttatgcaggcactgacacaatgtggattcttcttcattgcagccctagtgtcttaaacagatttgtgatgaaataatcgataaatatttattaaagtgattatattatttttctagggataccataagaaaattccacaagctgagtggctcagacaacagaaatttatttcctgtcagttctggaggctggaagtccaagatcgaggtgtcagcaggtgtggtttttcctgagacctctctccttgacttgtagatggccacctcctcacagcatgctcacatggtctttctgtgtgcaccctcatccctggtgtttctctgtgtgtccaaatttcctcttcttataaggacaccagtcagattagattagggcccacctgaaagtccccgttttaacttaatcacctctttaaatgccctatctccacatatagtcccatactgaggcactgggggttagggctccaacatatgaatgggggacaccattctgtaacagggatgaatgatagaaacagaatgaagtatattgcagaaaactggatcatattaaagtggataaactagagaacaatatacataaatactacattaaaacgagttaaagttattccttgcaataggagccctctccctcatttgttcccttggctagaaaaggacagggtggctttgcagtctgcaggccaggaatggtgttctagccatgggtagggtgtagattagttctgtaatttgggaatagtctatttctatttctgggcttttgttctttattctacaaaataaagggaatcgggctcatgaagtcactcagtgatcctatgaaaagccaaaccagaatggaaatattccttatggcttctctgtttgactaagagtgataatctgcagtaattctctttcctccaaggctcatggagagaaagaagagacccaaagtctactttgtcttttccttagtgggattccagttacctgtaagccagacagtcagggaagcaaaagtctctaccctaggaagcaataagcaactccctaaatgggaaaaaagccagcaaatgctcctggttcccatcttgctggcagggagcaagtctgtgctgccttgtatctgtcttctcctgtcttggtgatgacggactttaggagatacagtgttcaaggaagcagtaaggaccatgaatccacaaaacaggaagtcaaaccctagttcccctgctgacttgctccaaagctcagaataccaaactggtgaaatcccaactaagaccacttttcacactattccactgatgtttcccattcttccccgtttggagtgcagagttgagacattaccttgagcactgaaatgacacaatatacacatggaatttcctccccatccccagtgcagttttccagcaatatgtgataactaattacttgtgaccctcgcttccccttgttatctcctggaaatagttgtttttctgtgtaagaacttgctacagatgctactaaaataaaatccctgggataattagcagatgcgggggtttctgcgatgtttcattagtgagtggtgctggtctaggagactgccagcttgcttactgcactcaaaaagcagggttgtagctgccattgtttggatttgcatatgttcttcccattttcacttaccgcccctttgcccaagaaatcacctctccaaatcgacaatgactttccaaatctatatgtctttgcttttccagttactgccttctcttcatttacccagtcacatcgggttatggaaacacaaatgcagaaacgtgcccaaatcactgtgatctcagaaattcagagccgtttgcatttcagcttaaggcagcagcttctgaactacactgaatagaacttgggaaacctcgtgcacccagaactgatagaatgcttctcttgtgtgtttttggattgtgcagtcaattgacattttgttgacactacttcccttcaatttccctttctatataatttcaattctccttcttctaggatttcccattgctatttccagtggctttatatcatggctcagccgatctttgagaaataatgccaggcctctctctgttcttttgtatcccgcgtgctacctgattcttatcttacctgtgcaaacacaaatggggtacggccaagaataagaataacactttagcctcagttactgggcctagggacccgtgagagggatctgatatagctcaatcagtagttggctgtcttctttattctgcaagactgatgatcaggacaatccttcctcttactgaaacaatatattcctaacctcattttcaaattccctcttggtgatccctaggccctccttgacttcatcagcacccactgcttcctcccgctactgggctccaaccacctcagtcttctgtcaaccctgcagacgtgccaagctcattccaacgtgagaaccttggcatgtcttctgtcaaccctgcagatgtgccgagctcattcccatctgagaaccttggcacttactgtttcctctttgttgtacactctttccctatagctgcgtcttgtccttctcctcaatctgagaagctcattcttatgctcagaagttacctccttgaaaaagccttccctgaagttaagtgattttgcccactccacccagtccctatcttttccactgtgaaattctttcttcttcttaaacttggtactgtcaagagtaagctccacagactttggcactttatgttgtggccactatttttttccagcatccttaactgtgcctgtcccagattagatgctcaacaagtatgtgttgaatggatagatttaggaaaatagggttaagaaaggatgagttagagaggaaaaataagattcatgatcttcaaaaaggaatcagtggagaaatggccttgttggttcaggttttagcacttaaagtgtgttgttctcttggattttccagttgtgggtcatctctgaaaaggggcaatgtctgcagcaagtctgccttggcttcacacacagtcttcagctattacctctacacaaattcctctcagatctacaggtccgggaatggaggcccctaatcacagcatctcccctgattttcagattctgctatcacctcagcttcaacatattgaaaaatcattgttacttctggttcagcgactcagtctaccttctcacttgccttgttaacataccaccatcttccgcctttcttctcaagaagaaaaaaatcagacctcactgacgcttcaccatcttcagcccctcattcccaatgtatctaaaaggagctgtgccactttttagaaaatcaaccctcatgcattcggcacctgttattatttctagaaactgtattaagcctgtggacaaacagggccctggttgtcatggaatttgaagccacccttttctgttttgattggatgcaggaacaatgagtacacaccacacccagagtccatcccttgtcatatcaagtccctctttcttcaaagacaacctcctacctgtatcttgcagattattgccaaaagaaatatcctaagtggcaattaattgctctactttatcttcatgaacctaaactaactctgtcataagcctagagttttcttatgctgagcttttgaaacttttcataatctgatattcactcttaactaattcccacattcccccaataattcccacttttccagccaagatatttggagctcactatccccttaacttttatttttatccccttaacttttgtttttattcctatagtgcttaccccagaatttaaatttgaatggaaccacacatattatttaacccaacctctacatagataaattaaaaaaaaaaaaaccctgaagttcacaggcttaaagtcagaaaactaattctaaaaatagtatttcctgatttttaaggttcttcacccaatatattgtcattttttcttgctgtgtatatgtccatgtggttagtatgttagcagctcctatcagaaaccaatcaacgttctcaaacaaaatggaattaagagagagcttttgttgagtaaactagggaagaggaaaaagggaaggaggcattgggctaaaagaactcatgtttgcagatttgagtatctgtgttccattcattcaaatttgccatctggatcattagaatataagatgcctaagctttggtaggctgaagcagaagtatcacttgaggccaggagtttgagaccagcctgggcaacctacctaccatctctaccaaaaaaaaaaaaagaaagaaagaaagacagaaaattggctgggcatggtagcatgtgcctatagtcccagctactcaggaggctaaggcagaagcacaacttgagcccaggggtttgatgctgcagtgagctatgatcatgccactgcattccagcctgggtgctgggtgacagagtgagaccttgtcttaaaaacaacaacaacaacaacaacaacaacaacaacaacaacaacaaaccacccattctgagccgccatatcgataatccaaatccttgacttcctctcaacaccgaacaaaacaacatacacacctacacatggttgtcttttgtcttttagtataagacctgggactacacttactggagagcagctgaggctagagtgtaaaagtccaatagttgttgactaatagtgcctcagtggtagttccaatatgccagttaatgcataatgtctccccgcatgaaacctgatcaaaaagctttaaagctgcttggcccctactgtttgcagagggaaaacatggggactgagggccttagaaggaggggcaatgtgagcgcattgagtgactgggcaagacatcattagaaagacaaaaagagacatcattctcaaaatgcactgcgttgcaaagaggccacgattcttaaatgatgtttagggtaactattcgaaccgacaaaaaggcttatcaaacaattaaataaataaataagtttttaaaaagcagtcttttctttttcttccctgtgtttgaaaaccttcccattaagagaacacaatatgcaatggcaaacacggctcagcctcatcaggaaaagagaaaattgtttgaaataaacctcaaagagaaagaaaaaagctgtcattttctttaaggacactattatgttcttattgacaagacaaaagagtaataaagttaaattatagcaactataagcttgatagttcgattggagagaaatagagaaacctttgctattaaaaagaaaaagaaagaagaaaaagtagatcttttaatcagcccctactgaagcgatgactactgaccttacccctcactgagagcattcttgaatctgttccaggggcaacattcctacctcattgatacaatccaggaattatgaaactagaagtgagcttgaataatcattatgctggagtctcttattttataattggagaaacccatgtctatagcagttaagtggcttgcctgtgctcacacagcttttgaatttcaaggttaaattctagaaaccagcagaagctaaaacttattttctccagacacagaatctgtttattcagccttattacaaaatcatcatgctaacaacaaattcatggtgattatcctgaaatctatctccaagcatatttggagattctgagtatacttactaagctcttacggattcagggtcccaaattcctcctccctgtctggactaggcatcaggcagttgaagaaaaagcgtcaggagatccccatccttcctcactgctgtatcttgatgacagtcaacatctcttacccacacagtctcttgttggaacaggaacagtgcctctctggcccctgttgtgaaaagaatgaagcaaaaagaccctcctagccatgactgagttatgggactcttcagaactgcagtgagagaggccagacaccttagaagtgacaagttctcccttgtaatatatagtaggagttcagaaaaaggaaaatgcaatgatttttaagtactttgggccattttcctctcttgcttctctcctggagaagtctggacacgtttttatttggaaaggtgcattgtgacattttatatcgttccttccacctattaatagctctggccgccccaggtgctcattttcaagacaccctcagagaagggggacttctggcagccactctgcagctgatagctttggggaaatggcaggttttaattgatgtattgtggacactgttctttctttctgtctgtctctctctaaaacaaaacaaacaaacaaacaaaacaaaacaaaacaaaacaaaaaaaccgtgatgggtttagtatcctcctaggacctaggacctatagattttaatatgtcaattattccccttttatgggaacttgtatgtttgtgactgactcatggtcttccaggtatctttttgtctccatgtgacactgagcaccaagtatcaacatcacctgtctctctttgaataaactttctagacaggcaacaaccaacagcccctatatagatgctcatcagaacagcacgtcatatgaattcttctcaaattggtggattgactgttaatcattacaatgagatggaattggaaagtagggctaaaacgcaggaatgtgaagtaccaaaatttcttatttaaaaatagtccaggtggctacccctgatggaggcaatgttgtccaggcccgcatttctgcggacattggctgctccaaccatcctctataattctggcttgttgcaagtgctgcgaagacagcaatgtatttcccaagagcctcagagaatgttggctctgccatctctgcccaaagaagccagtgtctccatgctggctatggtgtggagctccatcgtaagccttgagacactgttctcaatatgaaatgtagggagatttcttactgctgaagttcccctcggtattctcacacactttttaaaaaatagctttttgaagtataattcacataccataaaatccacacattagaagctatttttagctttccacaattttcagcaaatttatggagttgaacaaccaacaacatcctccacttttagaatattttcatcatccaaaaattccctactggccatttgctgttaatctactctacccccagtcctagccaatactgatctacttttcttgtctctataaaagtgaggtttctgggcattgcttatcaatgggcttatataatgtattacatgatggtttgtaggttcatctatgcatagcatgtatcagtagttcattctttttattgctgaatggtattctgctgatacaggtttaccacgttttctttatccagcagttgatggacatttggattgtttccaatttggggctcttatgatgccatggacattcacatgcatttccttctatggatgtatgctctaataagcttcttaaatgctacttcttacatgcccctgtgcccctaactatgctaatcactttaaacgtattatttccagcctttgcaaaaactgctgagataggaattttaaccaagaaaccaaagcttataaagaagcaactcacttgaaacaatgtttccagagccaaaattcaaccccgtacacttcggactatgccaagcagtctctattactccctaacaaaaaagcaggcatttccacgaagcttgcacacgaaacccaatggctcaccctacagccatactagggagtgttgccaccttaaatggattggaggtttgcaaatccaccctaggacttcatgtacaaatattctcttcgaaattacagcaacctcaatggtcacttcaaacccaattttgacatggatacatagatcgatgcaaatgtatcaattatctgctttatgcctagaaccaagttgggtaaagtgaggaaacaaaaggtgaatgacaaacagccatggccccttgaggtcagcataatgggatgaccagcctcatacacacatgtctgaattacgtggaaccaactgcacatataatgagagcttcaattatttaagaatctgtgccaagacttaagccactcacgacttgtgtgtcatctacctttttcctttttcagttatgtgggcactgtagagctaaattaccaacagagagagagagagagagagagagagagagagagagagagctggactctacacaattagtgagctactcagaagatattcagtggaaacattttggaaatgttattatttaaggcagctggataatctgcagatatgtgtgtgtgtgcgtctatgtgtgtgtgcgtgtgtgtgcatacacacataaaatcttcctggaagcttatagacattttgtttcatttatacatctcacaagtctttattaaacacctagttgcagacatagtgcaacgtgttagcatagtgcaaaatggtgttccctgcccttctgaagcttacagtttcatgtagaagatgtatattaaataaagagattagttattaaaattatgagaagtgctatgaagaaatagagtatgtcaagggaacatttgcatttacacatgtgtcaggagcagaaggtgatgagctgatatttagctttgcattaaaacaaaacgaaaaacccagagccaaacaagaataaagaacctttcaagccaatgtggggaggaagaattcccagtgggcaagtgatatatcctggtgacttagagtaggaggctggcaggagagatgaagagaaatagacatgtttataaatggaaagcccttccttctgggtcttcttaaaatattctgcaaatcttccataaagattggcaatttctctatcaaggctgggtaacctcatatatcaattctccatttccctgcccaagtttgtgataacatatcttccattaacctatgctgaaagagccatttctattctaagaatctatttatgttcccctacaactttctcaaagatatgcctctgggttgtaatacctcacgctgatactcagctcaaatgtgaatacttttgccacatttcggtaacattgatcgagacttttctgagtcatttgatcatggggatgtggggatgtcttctctttgtggggaagaaaatgacatccctttcatttgaagggactaaggactgaatttgctttttctgttacttgccataaatttggtcttcattgtcaacagtatcctatgactatttttccaattatttcatgaattaggacacaacaggtaatcttatttctgacatttatttgaataaataagtgtatcttcctattcttatctctgtttttattaccttaagtaacacactgaatttcatttcaagtccctctctctctattttctcaattctttgcacagtttcttatgaagcttctctggttaatttctgttactttccagttgtcagaaacctttaggtatgtgatcgtttttcctgaaagatctctaggataaaagtctagttttacctttcataatccccacatcctatcaaatctgctttttgaacatgtactttcctgtaccactttctactgaagaattagttaccctttttcctttcaattgcctgtagtcattaacagaaatattttccatctgtcactctcctatttgtctttatttctcttttttggtaagaagagcatatacaattgcttccaccctacattttggtcaaattattttgtggtacggattgaaaagtttttataattgcaccaagtttcattgacccatattaaaggtgtcagtgtgcaaaaaaatttctatctgtataagctactggttttccattaaaataagaatgattttttttagaggacaattttttaagagacaagatcttgttctatcacctaggctggagcgtagtagtgtaatcatagctggctgcagcctctacctccttggctcaaggaatcctctcacctcagcctcttcagtagttggaactacatgggactacaggcacatgccaccactcctggctctttttgtgtgtgtttattaatccattttcacattgctattaagatactacccaagactgggtaatttataaacaaaggaggtttaattgactcatagttccacatggctgggaggtctcaggaaacttacaatcatgacagaaggtggagcaggcatgtcttatatggtggcaggggagagaagtgcaagtaggggaaatgccaaacacttaaaaccatcagatcttgtgagaactcactcactatcatgagaacagcgcggcggaaaccacccccaggattcaatcacctcccaccggatccatccctcaacacatgaagactgtggggattacagttcaagatgagatttgggtggggacacagccaaatcatattggtggagttttgctatattgcctaggctggtctcaaatccttggtctcaagccattctctcccctcagcctcccaaagtgctaggattacaggtgtaagccaccatgtccagcctatttttgtatttgtatcttcatttttttaaaaaatgaaattagacatactggtttcattacatatttcttggaataattatcacttttaccataataatagagaaaccgaggaaaaacaaaaacaacaaaaaagtgttatttgagacaaagactatacaaggcattatactaagaacggatatgaacagagagattaaataagacattattcctgccttttaaagactgacacttcagtaattaagaaaaaaataaaagatgttcatatatccacaataagatgaacataagggaataaaaattcaaggaagctgggaacggtggctcatgcctataatttcagcactttgggaggccgaagcgggcagatcatgaggtcaggagttcaagaccagcctggccaacttgatgaaaccctgcctctactaaaaatacaaaaatcagccgggtgtggtggtgggcacctataatcccagctactcaggaggctgaggcaggagaatcgcttgaaaccggaaggcagaggttgcagtgagccaagatcatgccactgtactccagcctgggtgaaagagctaaaccccatctcaaaaaaaaaaaaaatcaatgggaagagagcaatatttataatgggctgagtagttttgcacattcaagactgattcctgggacccacatctttgagatcagcatgagaagaaggggaggcaaagttaaatcagtcaatgactgtgcactggcatttgaaacctatatttttaaatgagtgtctttgcttttcatcctaaatcttataaaccatgtatagtttatcaataaagagatctgcctttttctgagggagaagaattgaggagaaacttgggatctggaactggctcaatctctggctacattgcctattctgataaaatcctcttcaccatcatcatctccctttgctttgaccaggtgtattagactttgtcaaaagcaatggagatgattttttcaaggttagaaggcataccggggtgaactgcaggaatggttcattatcttcggggaatgttaatggcccacctcgaggattctaaagagggaaagaatgagccaaacgacgctttggattaaacgatgaactgagtgtaaagcccacagtagaggagctggcacacagtaggtgctcaatgaatagaatttccccatcacccttcccttgccctacgctgttacgggttgcagctgctgtccatataggcctgttacagagagagcagcaggtgtttgccaggcgttgacagggtagggagtctgattctcagagtttgcatgtttctccttgactcttgatatcctgagtaattcttgacaaaggcattgtcctcgtcatcctgtagtggtcctcttcttttgacctgcgcattttctggagttgtgagccatgttataaaggggatgagtccagatgggaagcatcagtgatgacctggcattttctgctggggtgattggtataccatagaagcagttaatcaaggacggccaaggggctcctagaacacacgatagtggtacacctacactttgatcctcactctagacctctgggagcctttttgaatattaaactcattaaccaaaggaaccagtctgccactgatgtacacattccagcctggggttttctttttttaataaaaatgatgtgggtagctgattcagcattacagtggtttctcccccaacctccagaagtatgtcaggactgttattttatagcataacatggctgtttagaaggtttctgaaaacctagagcttaacatttttctggtgccattatatcatattccaccagtgtatcaggaaatgtgctttgggaaggtcttgaagaaaatttatagaatagaatgacagcatgtaacatcaggaggacctgacttgcatatgatatcaggaaaggcttccttaaagaagtaaactgattagtagaaggtagccacagggagggagaggagtgtatgtgaactgggaggaaaaatgatgtattccaggagttgaaaggacagggttgccagggtggagagaggaagcaggggagaggagggaaatacatggtaggaactgggcaaggaccagaccttacaaggtttcatggatcaccttaaagaggttcttaaagaggtaagaaccctatggactctgccttaacaaaacaggaagccagtgacagatgtttaagaagggagtgtaatgaccagatttgtttttaaaagatcattttgcctgccatgtgaataaaggattataaagacagtaagagtgatattgagaggaccgataggaggttgtcacactgcaagatggcatgatggcagaggatagcatgataatttatccttgtcttttgggagtttacaatctagtaagggagtggacatgtgtacacagaattattacagtgttgcatgtgatagtgccatgagaattaagcaagataaagtgagaaagagagaggtcactttttgcagagaaaatcagggaaatagcttcttagatgacaaacaggatccaaggaatgtagtggcctgaggtttgttttgttttgttttgggcttgtttgctgttatttagatttttagatacaactgtttccagattaataaattgctttaaaagtagctttcccactgttttggttttttttaagcttcacatacacatacattttctgttccagttcacattatctttgtcaggcaagaagaaagcaggttttatggttatatatgtaattcccttttagactggagtaagtgaattcctctatttctcttccaggtcatctgtcagtccataaagccaggaagagttgagagacaagtctgtcttcttgaggacgcgtagtttctgtgaaaataatacacacacacacacacacacacatgcgcgcacacgattgtgcaaataaatatgggtatgatgctttcatcctaagaaattcagaatgaattgcttttagaaggacttacacaaagttctcatgcagctcttggggccccttctttccttcttttttttccagatggagtctcactctgtcacccaggctggagtacagtggtgcaatctcagctcactgcaacctccacctcctgggttcaagcaattctcctgcctcagcctcctgagtagctgggatttcaggtgcccgccaccatgcccagctaattttttttttttttttttttttttgtattttaagtagagatggggtttcgccatgttggccatgctggtctcaaactcctgacctcaggtgatctacccaccttggccttccaaagtgctgggattacttgtgtaagccaccgtacctggcctattggaacccccttcttgaaacacctgtgtgagcaccctgcttaccatctaccagtgaccacacccacatagggttctatttcagtgagactacagagccaacaaagtgcactagttagctgtgatggaaaacctaccaagctttactgatggatctctgctgaaaagaagtaggctaggttatactgaaaccatgagcaagaaaaatgttcagctggtcatgttgggagtcattgggaatattctagcccatgatttcattcacattggctgaactctcagctccacctatacgtgagcgtggctagtcacctaagctctctgagtttctttggaaaaataaagtggttaggctgactgatcccccagatgttctgcaaactcagtttcagatatagatttccatccaggagagctgtgaactgattttacaggtttagcctagcattgcaaggatttagttatatgggtctatacacaagagagtacttgaatgtgtccttcatactgatgccagaaaagtagagagaactccttaattcctctaagtatctagaaacacattttttagccaaggggatggttggctatttgaacgagaattttgactgtaccccgtggtttctacaattaaagaaatggcatatctggacttagaaagataatggtttcctaggagtttgcattcttagaccacacccagaaaattatgtttcgtttgagattatgcaatttaaggatgttgacaaatctgaatgcatgcaaagaaaaatggtaaggatgaagaaaaacccaggaagactgctatatacggaaaagttgctaaaaacttggaagggttggtctgaaggagatttagggatacattacagctgtctcaaatattgtggagtactgtcagaggaaaagaaatgagactatcctggctctgtatttcctaatagacctggggtaaatcgattgaaattgccaggagcttaatttgggctcagtgtggaggagaaatttctgacaacaatatgtagccaagaataggatgggatctgatttcccttgtgcaaagagtaattaggaagagactggatgttggtaatattgattgtgaaaagcagtgagttgtgtttttacatgtattaatgcaatcttcatgataacctgttgatgttgcttctgttattatttccatattacagatgaagaaactgaggcacagtgtgggtaagtcacttgcctaaaatcacacagttagtaggtgacaaagctgggatttgaactcatgaatgtcctatcgtcaatttgggaggcttaaacatgctgacatgttgccttcaggtggccatcacataggtggatagtatttctgccccgggtttccagaatggtctttgaagagctcactgatcatggtgtattccatggtgcataacagacagattctgtggtagtacctaatgcaggcagaggtgccttcctgcaggtgtgccagagtctttggtaatgagccattatgctccgtcagtcattctgctgtaaccatgcatagtcatcctgtttccttcctcacagtatatggagttgggatgcattgtttcttggtagaatttactttgtctgccatattgataatatccacttcagcagctacactatgacattcccttaaaaaaaagaaaattacaaaaatatccaaaagccctacttttgggatatgcagactgcaactatactttccttccagacatgatggatagttgtttccctataagatactgcaccttgtgtgagtgttggagagagatctctgctttattggccctttgcacgttaggaaacacaataaaagaggtaaagtgctttccagtacaggaaaggaaaaataatccctttcaaacttgatcagatctatctaaaggtaaccgaccaggaaggagaactgaccccatttcacatacaggtgctttaaaataatttcacaacaggtagttaaaatgtaactatgctgtgctgtcaatcacatctcgtccttctggattttaacgcttgttttacttgagggaagatgatatttgaacattctatagcatccgtcaacaggaatgcgcacatggtttcaaataagggttttcagccttctgaaaccaattacttctgcctaagtggaaatgccagagcagagatgtgtcagcaactaagagaataatttaaaaaaaaaaattaagtatacacagtgatgtcagaaaacaacagaaattgtgcattcctgcacacacatgtacacacatgcacatgaacaaacctttttaagagatatttcaaaaaaaaaaaaagtctgtgtcaaacaacgttaacccagaaagatgcagaaatgtcagagacattacatgggcaggacttgcggttggcatttggctggcagcgggggaggcgtcctccccaactaattcctcaggaacctcatgctgaggctgtctacagggaagggagcagaaagggaggagggagagagcagatattgcctattatgcttttccttcccagctggagaaggcctcagctgtgtcagactgggactgctggtgatttttctgtagttagagggaaacacaaaacgaagagcggcccactcccagcttacgccgatggtgagcccacctctcctgatcattagcgttgctggcacaattgaatgcaagccagatcatctcttatggagacccggcagtacctcacctcagtctgtgagttttctccatgggaaggttgtgatggagtctctgggtaaggatgatggatgtgcatgcagatggggttttgcaagcacctgtcctcactgacagggtagttggagtatttactttaacccttcagcggataccaagggagagatgggagacttgacggtgaaactatttgatttcgcaccgcagttgtcttaacagtagttgtgaattcttctcactgagtctaatttctaattcctatcaggttgttgatctgaattttttttttgctaccttcatgatatctgccaggtatttcaccagaaaaaaaaaatatgtgaaaataaatataaatataaaatggaatttattaactgtaaacatctgttaagtcaagcatcctgtgtctattgctgaaatactctttcaagtgactctgtctgcatctgtcacatttttttcaccctccagagacctatttgcggtagctctctgtgtactaatgaaaacgtgggattggctttaccctttattgtagcttggtgttaagacatttttaaaataggcaaaaggaagacaggggaaatgatccattctgttagctgaattttcttcaaaacatggattagtcttgctgcttgtatgtgatatttagcatgctgaacaggtttttgtgaaactcctggtgtcttctgctgcaggtggctgggtttgttgacaaatcttcaggtgtaccatttgccttcaaagagggtgctgctgtctcatcagtataaatggagtggtaataacccctcacttttctagggcaacgtatgttttacaaagtatcttcactgtattattgagttgctctcattttattaggacatcagccctgtgtggcaggtattccagttgttattagctccattttttaaacaaggaaactcaaggcaaaagactcatccagggccacaccgttagaactggacatgttggtatttcaacccacttcaattctcaagctttgttttcttatgtatatgaactgtgggtagtatagacacaaccaaacaaacctaagttgctgtttccatgttgtatgatatatatatatatgtaatcccacttcctttttgcttccttaagccacactaggcacagttatgatgcagaatgagtttaatttcagcatgccccacctctcttttccacaactcaaccccacaacacaagctcatacacagacttctgttgctcccttggtttaggaacgtgggttcctgagatgctgtgggtttctcctcatttaaggagaaaatcatcagtaaatctgatagggtttataatacctctcatgagtccagagaaaacaaagtgatggttccacagtggtgcaatttcatttacctcaatctgagtagaagagatatgaggctccaggaggaaatcccctcatcctttgaaaccccacacttcaattatctcagaagttaggaacaaggacatgtatccccagaagctagggaggacagatgccctcatggagactctgtgtcttctatttcaacaagcatagtgttctctcaagagtctgccaatgagaaaccttgagaactaggagcacctcaccaagcacctaggaacacattgtaggacaacttagataagccccacatgatccagggagacaaagtcacccctcccactcccacccccagctttcttccaaccaaggccgtattgccaaacatctgcattcagtgaccagttgcagttggccactggttctttgagagaacacagggtgggttttaaattgccctgacatagacccccatgaaatcatgtgagacatctctttttgggttttccaaatatgcttggcagtactttctcatataccttttctttcttttttctttttttattatatttttaaattttatattatattttttatttttttattatttttatatttttaaattttactttaagttctggggtgcatgtgcagaatgtgcagttttgttacataggtatatatgtgccatggtggtttgctgcatccatcaactcatcagctacattaggtatttctcctaatgctatccctccccttgcctcccaccccccaacaggccccactatgtggtgttcccctccctgtgtccatatgttctcattgttcaactcccacttatgagtgagaacatgcagtgtttggttttctgttcctgtgttagtttgctgagaatgatggtttccagctacatccatgtccctgcaagggacatgaactcattcttttttatgactgcataatattccatggtgtatatgtgccacattttctttatccagtctatcatcgatgggcatttgggttggttgcaagtctttgctattgtgaatagtgctgcaataaacatacgtgtgcatgtgtctttatagcagaatgatttataatcctttgggtatatgcccagtaatgggattgctgggtcaaatagtatttctggttctagatccttgagaaatcaccacactgtcttccacaatggttgaactaatttacactcccaccaacagtgtaaaagcgttcctgtttctccacatcctttccagcatctggtgtttcctgacattttaatgatcaccattctaagtggcatgagatggtatctcattgtggttttgatttgcatttctctaatctcatataccctttcttttgcttcagaaagagaacaaggggtttcacattagaagaattctttgttggaacaattttaatattctgaagtctttttcttagagcattcaagtatgccttggttaccctgtggcatggacaaatgcccttccacctcagccacagtttgccttcatgcatctgtcaatacataagtgcaaagtgatgtagaatctaccagagtttgcactgtggggttgtcttttatactttcctttttaaagtaatcctgaaaatctcttaggaaattgatggagggtgggttcataaaacctcacagtgtcagagttggaaggcagtctaaattgcatgtggtccctatagtgtcattatgatgaccaagaaatcagttcccagggaggctgagatttgtcccagtttaccatgatggtgactgtgctgcatattttctgtttgtccttcacattctttcattccatcaatatcttgctctctgccttggaagctgaccctatagactggatctgtgggtgctctatcctctagctgattggctcaatgggaagagatcgaagatcagaagatagaaggtggaagagagagaggcaggggcacttcctaccagcttggaagagagagaggcaggagcacttcctaccagcttcctccttgtcattgtgctatagcaggctgtttttctgtatctgagacagacattcccaggtagccctctccatacagtcttctctttctggattcttctaatcacttccacttttttttagctctagatcattgcatgttagcttttataagcacttgctggttgttaggactcacattctgtacatggaaacatttattaggactctggttctgtaagtgaaaaaattcgctgattttctcgagccatgcacactgacataacttctgatttccagaaaccttgaccacaactgtttaaatagtccccttattaaactctctcatattgccaggtttgggtgtcatctgctttcatgctaggaccttgattgatacagaaacagctaaagctaaaactatagcccagctagttctctgtctccttaaccctattctatttgcttttccaccatactgcttttactatggataccttgatactttgaataaataataattgtttcataaacacacaattttgatagtagataacagtagcatgcagtggttaaaaacatagactcaacatcttgggttcaaatcccagttctgacacatactagattacttaactagcaagttgcttagggttcaaatcccagttctgacacatactagattacttgggttcaaatcccagttctgacactagattacttaactagcaagttgcttaacttctctgtgtctcagtatcctctttcataacaataaggctattgtggagattaaatcatatcagttccttcaaagaacttagcacatatgagggtgttaaatgttcataagtgctcagcacatggtaagtgctccataaatgttagcttttatgagtgttggctgtttgttaggactcacattctgtacatggaaacatttatcaggactctgattttgtaagtggaaaaattttcagattttctcaagccttgcacgctgtcataaaatttcatgaggataaagtcatcagttcccaggaacactgaagagttacaggggaagtggggaggtgcaggtaagtgggggtatatatgagtcaccagagggacgtgaggagagatgggaaaggaatgtagacaacatcatgatggacaagcctggatgtgccaggaagctctaatccacctgggagggctgtgaatcagcccccttccagcagggtaggtgtccagtttctggctggttgacctgggaggaggccatggaagctgttgccccatcaatctattgttgagagatacagccatgagcctggatgttcctacaacaataattatgcaagagctagtttacaaaggtgctgacaaaccccacctggagacagtatttctttagctccgaagtgtgaaataaggtgtgattttttaaaaaaacatagattctgtttttcagatattgattctttcttttgcatatttgataaatattcagaaatgtgaaattgattatacttgagcatggtcttacttgagcttactagagcggtggctgtacttaagctctacatctctgggtagtcactgtaggtatttggagagaggagctaaatttctgaactgacttatttaagtggaatgctatgcccagctcttcactggttaaaactccgcatggtacattttatcctcaatggctttgctcctggtcttcctaagggtgcaataaattgtggcttctcttacctagaaccagtttcttctcttctatcattaaatagggcactgtcacatgcctttgaaagaaagagaaattaagtcatcccatcttttgttgttcaggatggtgacactttctgttattactttaggtcaggcaaggaaagaatttaatacactgttggaaggcattggacataggaggaagtgcatggtgctctgtggcctctgtgagttagacttaggccctaacatccaattgcaggcaatcgaggcttctcccacttgttccctttctccttgttttctcttttgcctttattagaatttttattgttggcctgattctgatcattggtaattgtccctagagtggacagccagtttgatttaggtggacttgtaaataggtaagtgtcaacaacaggttccacaagcagctgccttgttattgttgttgttgctgttgttgttttgagacagagtctcactctgccacccaggctagagtgcaatggcatgatctcggctcactgcaacctctgcctcccaagttcaagtgattctcctgcctcagcctcctgaggagcagggattacaggcgcgtgccacgatgcctggctaatttttgtatttttagtagagacgggtcaccatgttagtcaggctggtctcgaactcctgacctcaggtgatccgcccaccttggcctcccaaagtgctgggattacaggggtgagccaccgcacctggccttactgttctgttcatgtcctgctgcaatgtccatgtccttgcccaacaagtgacccactaaatgtctctgtggcggaaatgtccaggtctacgggtgactaagatagtgagtgaatgccttctcctatctaaactttctgcttttcctcttctgtcttttgtaaaaatgaatcctactctgagcaagctgtttaaaaataaagatcatcctctgtctcatccaccatcttcactgtcagtttcctctcccctgcttattttcttacttttacttttgttttttgttttgagtttctaacatgctatgtaattattgattatgtgattgtctgtttgcctctacccattaacatataagctcaaccagggcaggaaacgtgtttgtgttattcactgatctaccccatcaacccagaatgccgtctgatacatggtaggcagaataaacgaggaaacaagtgtcccaaagaggccactccaagaaattcttcaacctctaaaaaagacccaatattatatttctccacatggagaaatatggactgctattagaaaaaaaaaatcatcctaaaatcatgttctatcaaaataccaaatattaaaagggaaaatatcaaaagggaagttttgctttctaactggtcattgttttagttttgaattattaagttgaaagcataaaaagaaaaccatcaagtagcacttacacagacccacaaatggctctgcagaccatggattgaggaccacaggcctaatgagaagtcacagaattcatccccaggccctccaagggaactggaatttctcacttcactccccaagcttctgagcagctgtacagagctcttgtggccttgccattcctccttccatagacacattcagcaattatcatgtatctgctgagccagagatagaagcacagaggtagtgccagaagggccacttccagcaatatcgctgattgaaaaagtttcctcaactttgaatcatcaataagcttcaaccaacgagctaggagtgccattggaaccagcgcctcagctagaaagaattaagtacatgcagaagcgctgcctgacttggggctaggttgagaaacacatagttcttgattctcagatggctctttggaagaaaaatcaaagtgaagtgactaatttttagtctctttctctctcctctctctctctctcatgcatacatgcatataaacacacacgtgcacgtgcatggatacgcagctctaaggttttctacaagtgagctaagaatatccctggctccttaggaggacaaaagatcccctcctgcacatccccaaagacctttgtttcactcttaggtgtgggagaacttatttatgtctaatcttctgcttttcaactgcgtaaagcatcaaagcttctttatcaggtagactaaactacattaaggatcaaaaagaacacataatatttgtgatggccaatcatattctagagagatgcttccctcccttcctctcgttattttcgtctatttctcttgcccatgtgaaaacctgggtgatttaagcaggtgctccagtctgcagtgctctggttgtcagttggcaatggtgaggttaggcatgaaaagccaattttagatattctcctggtattgatctctgcttatcagaaaggcttttgctgtgccagttcacttctgtgcttaggcaaagtcttttacagatttaccaccacaacttactcaatctattataaagtagcatcagcatgcagggtgtttttcccctttctttgacccagttttaaaaacatccagctaaaaatgcttcattaagtttacatagaggttgcaaggcaatcaggattcctcctgcagttgtggctggaagaatttctacaagtcctctacatcttccgctccaaaagctgctgtctttggggctacagaacatctgccatgtgcaggaaatactttaccaaaattcaattgaactgtcagactttttttcccaccctttattccttttccattatcactgattacccagcttataaattcccagttcacactttctctttgacctgacttctccctgtagagcaattccggaaaccgggactgtggccctaatgcacacactattaaatattggcactcaaagtcacaagagtgtattccagctctcttgctgaaggcagctggtgcaaggctcactgcttagagaaaaatgtggtcaaagcaagtgaatgctttaaaagatcttttaagaagtaatatttgggataccttggttcatattccatcctgtctggtgtggtctttttatttcttacctatgtggaccatagagagcacaacttttaccaacaggcttttcccagttcacaagtctaagtcatttcattccttcacattagattctttatgctgagagtttcaaatggcagcctcaagctcccaagcaatcagcaaatgtcaaatgtccccaagcactgcaaccatctgagatactgagccactgcctgccgaatgaagattgtattattagtagtgtaatgtttctggtggggcggggaatagaaaagtcaaagaaaagaaaaaaagatgctgttcacagacacaagctcaattgtcttcaattgcccagcattgtctaagaaccaaagtcattctaacatcaaatctggggagagtttgctaacttcattaccacttatgtcttgaataaatgataaatggcagtgcgcgcttctaacttttcatgaatttgttttaatacctagaatttttcttctaggtaggctgaacttccctcactttaaattgtctgtttactttaattaagctttcctccggctctccaacttgttgagcttgacaagcattaatttacagtgagcattttttttttcctttttctttctttgattttttcaactttagccctctcatccttgcctggcaaagaacccaatgagtaactgacaagcaacttattactaatcccatctttcttcgtgggaaggtgtctcaatcaatacaagtcagaatttccaagccactcctgctgatagtgtgcattgcgtgtctctgtgttggcttcttagcgtaggcatctcagataggatctggcagacagggagatgctgaaaaattctcaacttaacattccagctgtgacaaagagaaaaaaaaatatattgttagggataaatttgggagactgctgagtcttccctccactgcttataccccaattttaagctacatgctgctatccattctttatgtcctagtccaatttgacttctgaaaaattttcagtgaccctccctttccccctaccacccacagttaagtaaggttcctcatccctgctctgagaacaccatctgttttttccatcatagtgcttcttatatcctatttaaattaacttagcaatttaatttaaattgactggattgtcagctctccaaggagcgagaaagcctgtcttattgtcatatctcacctggcaaatcatagcttctcaagaaggagacctctattgaatatgatttgtaagctctgtgatctggaagctagagagagttcccactcttgcctttgtgtttcagacagtgcattgagttacatgtggcaaatttttacctgcctctttagatctaaatagagcgcattcttaggtggaacaggggcacttggagacggtgggccggtgaggattgactctttactgtcccagtctatcacccgtatgcagagaagatcagggccaagttgcatatttatgatctctgaatgaatgtgccttccctacttgcccacggggagctctcccctgagtctcccctctgccagacacactcctgtgctttgatggatggagctgactgggcaaattgctatgctgatgaactgctcagctacctgagcaaatgttccagagagatctccagggatataccacattttagagaaggattcatcccagcctggggtgagccttttagcccttagcaagctgagtatggtggagtaaggaagatgaaaggactacagtctcagttctcacttttctgcaacccgagtgcctgtccttgggctggcgagaggccttattgcatttttcactcctcccagaaagttattcaaattgagacctacaggtctgggtgtcactatgctcactgaaagagcaaaatcaagaagctgaacagaaagcacttaaagggaggatgcattaccttaaaatatgcagatggaaaactgacattattgtcaatgtcagaagtcacctttctgagtaaacatttacctctgggcaaatgcagggatgtgtttctttccgtttacaaatgactgggtatgcaaatgcagggggttagagttgtgccccagaaggtgcagttgtcttctttcatctatccataacgaggaacatgcaggaatctgtcaaaaaaggcatcatgggcttgatttgtaccttctgaataaaggggatgtcagtgttaaatctgccagctggttttgtgcctaagtgttacatcagtctcttgtatgatcttgcatcctgtgtaaaatgcaatattttggcctaatgggcaggattagcacgagctgggaagccataaatgaaagtttcttgtttctagagagcaagttagagcttttatattatctgccgcggagctcggtgaatttaaatgtatctcttgggctttggtaatattcgtgttaatgtcaaaattgatcccattgttattgagatgtgtggttttttcaggccgaagatgcacagagcctgttgccagggctgatgaatatatgcaccggacacattctttctaaccgtttctcagaaccgagtgatgttgtcatgttatcatggtgcctgctaccatatactcttcacaggtctacatttttctgtaaatcgcttgtaaacttaattgatatgtattgaagacctactgtgtgcctggcattttgtttgactttggggatcaagcaaacactgttgcaacagtgggcaagatctgggctcttttgccataggatttatccctagaaacacagagagagagacaataaaataaatgaacaagcagaaatattataactgaatatttatgttagtgttatgtggacaaattgcaggaagagagaagaaatcacgaggaggggagccactggatcagctgatgaccaggtggtatttaagctcagagagggtgaggcaaagatcaccttgaaaatagagagggaaagagctttcatggcaaaggaattaatatgtgcgagtattctaagctggggaaaaattttacatatttagagcattaaatggagctaagcatatctagcacaaaacaaggggacacagtgggatgatacagaattaaagagattcccgcagttaacagatcacacagggcattgtagccatggcagagtttattattttatcaaaagtgcaattagaagccatcgaaggatgtttcttagttcaatttatgtctttacaaagtatatttttacatccattcaaatggctattacatccattcaaatggctattatcaaaagaatttaaaaataggaaataagtgtttacaaggatatggagaaagtagaacgcttggccaggcatgatggctcatgcctgtaatcccagcactttgggaggctgaggcgggcagatcacctgaggtcaggagttcgagaccagcctggccaacatggtgaaaccccatctctactaaaaatacaaaaaaattaactgggtgttgtgatgcattcctgtaattccagctactcgggaggctgaggcaggagaatcggttgaacctgggaggcgaaggttgcagtgagccaagatcgtgccactacactccagcctgggagacagagtgagactccatctcaaaaaaacaaaaacaaaaacaaaaacaaaaaacaaaaaacaaaaaaactagaaccctcaagcatagctggtgggaatataaaatgatatcattgctgtggaaaaaagtgtagtggttcctcaaaacattaaacgtacaattaccatatgatccaaatccacttttgtatgtatacttgtcaaaatgaaagagcaaagactcagacagatatttgtacacccatgttcatagcagctttattcacaatagccaaaagatggaagcaacccaagtgttggtcaacagatgacagaatacacaaatgtggcatacacataccacaaaatattattcaatcttaaaaaggaagggaattctgacacatactacaacatggatgaaccttgacgatattatgccaattgaaaaaaccagacatgaaatggcaaatattgtatgattctacttaaatgagacatcttagagtagtcagattcattgacatagaagatacaatggtggttaccaagtactagagaaatgatggactgcagggttattgtttaatgggtatggagttttggtttgaaaagacaaaagacctccggagatggatggtgatgatggctgcccaacagtgtgaatgtacttaatgccattgaattgtacacctaaatatgattagaaatataaatcttacatatacttcaacacaataaaagagaaccactatattttatgctagatagaaaggaagcaaaagaataatagggaaaagagaagaggctactgctgtagtttattattaagactatgatcacttagtggcaatagagaggcagagaatctcaggatttaaaacattttaaaggaagaggctgcaggacttacttgtggataacattccagttctttgtattttgaactctgatatacttgaagtctgtagaccacacttgtgggggtaaaagactggcaaaatccctttgactggcagatgtgtttaagcttgatgtcttggtgcatgacaaggagagctttatttttaaactcttcagtagtcttggatggagtatgggagctattgctgttgacatgtgaatatttgcctgaactgtcatacagcagtcatatgctcagtgtgaacgtggcttgtcttgagatttgcagtgataactagcatgtggctagagttgttcattctctcccttattagtaatgcgcgtcttccattagcatatgcaactaactactcccgttcccctgtgctgtgttgacattcattgtaatgatttattatccaagctaaataaccctcaatatgaaacaacaaacatgcctatgtttgtgttttccattggttttgttttccctttctggcttccacataagtagatagttctttatgtgatgattacatgctatagaaacaagcaatgggaaagcccactagaaaggttaagaatgttggtaaggtttatttttaaactattgaaaatccaccaaacttagtgacatcccccattagtgccttggaatttaaaaaaataatgtagattattaggaaaacgtttgttatgtgcaaacactccatataagacttaacgatctacgaaagggccacatttgggcttcctatggagcctccaaagcccttagaagctttattttatttatttgggatgtttccacgattatctcaaccatcaggagctcataatggttatgaagtggtagagagtggtggtggggatcccaagctctaaagttagactgcctgaatttatataccaacaaagccactgactgtgtgacctgggattatttacttaagttccctgagcctcagtgtccctcttctataaaatgggaacattagccatgcctttctcatgagattcttgtgatgattaagtaagataataaatgtaaagctcttgcaacaatgcctatcttagagtaagttctcaataaatgttagctgttattagaagttctcagcctctgttccctgtaacttgggagacgggatgtataggtaagaaggaggaagattctagagggtgcggctcatggtcactttcttccccacatctcctaaacagcagctctgtttttggtatcaaaaatctgaaatagtgttactttacagttaaatcaacagaaagttgttcagttgatgttgaaaactatggaatctcctttttaaaaaggtaactttcatgatccacctcttaatgctctcagtttttatactctgtttagtttttattgacatctctgtcatggggcagctcatctagacaagtttattgaaggcaaatgatagtgatgactatggtgctttgcacacagattgtcaataacaatctggttgtttggggagcacttagaaatgtggttcatgcatgtgtgaacctcgtcagtgtaagttttgtgccatttaactgataacatttcatcctcactcactctggtcattttattttttattgaatgtatgtagttacattttggtcaccatgataacatttaacatcattttggacactggggccttttcattggctaatgataatttctgtatgttaacatcacagaaaaccaattgcattagattttatccagttaaactaccttacctggcttactatggcagttttgttttcttgtttttctgtccagttgccacttaaaaactaaactggttattcttgccgcaggcttttccccagtagaaaattgttattggtgttttgtaagtatcgtattccattcaaaggtaaaaggctccttcaacttcccatttttcctgtgattttttttctatactatgtctgcaaatcaacactcctgggctcaattaaaatatgtatttagtcactggacttgcagagaaatgatcaaacttgaatagtaatacccaggctattgcctatgaatacaaggattgtgtccattgagggatggctttcaagacaatggccagtgaacccaggatgcctgtgggattattagagcttggtgtgggtctaaacctgaagtttgctagtttttttttccccagtaaagacagagtttgttgttcactaaattcacaattgtatggctagaatgttcacatgggaaattcaaagctactttctgtcttcccagtgtctagtgatcccatctgccagaagtttattttcccaacatgtgctccaaggacctaacacattgcatcaggatagcactaatatttgttgagttcttactatgtgtcaagctctccagtcctggctgtggaaagaatgatgaacaaaggtaggcacagcccctacctcatggagaatccattcaaaggattggaagagggagtgatgtagtcgtgggaatcaattgggcagaacagcaaaggcttagtgattaagaatgagtattccagacaaggaaagcaggatatacatgactctatggcaagttagacaggtggcaagttagacaagtggggaacaaggagaagttacggatggctgcagccaaggaaagcaaggtccaaagtgattctggagaagcgataagaaccagtccacctaagcaatgttaggagctttgtcttgactttttataccaaccttagtgcaataataggtactactgatattcgttttccaatgtttaagcaaaagtggtaaactaacttcattccttacttaggaagtggcagatgtgggatttgaaccagaacttgctcttgtaaccaccacgttgcacttcgtctgtaagatgcatgcctaaaatttttatggagttttgactcacagcattattatccagtgtcaatgtggtcttcctgtagggtctgttacgtaagtctgccattggtttgcttttcattaaaaagaaatctaacttctggaagagtaaacgggatacaacacagtaaacttctgaacagctttggttatctgtacactgaatcctgggtctctaagactcagaggggggcttaaaatgagggtttgagggctgttggtcccactggggaggaccatggctgagagaggatagtacagctttcttggcaggttccaagttgtaaagcccaaaattagaatttaaaggaggcaaaaattgtgtatcagaaaatgtttcaatgcactcaaggaataaaaataacctgagatttaatatgaagagaagaaagaagagaataaaagaagaaaggagaggggagagagaagagagaaaaagagagcaacatcactacattataaggctacttcaatcggtcactctctctctctctctctcaacttttagtctgaagctaaacacttgatagattagcccagcactaaagaaaatgccctcttttatgtgtaaaagcttggtaattgctgcagaaagatacttagtggatcctaatattcatataatcagattagttttgaatcctacctcagcagaggatgttggaataatccagttcatgcctgtttaccttgtctgtgtgttcactttttttctagtcattttatcttttccgttggactcagtaggtgctagcaacaaagctaccccagtatcttagagaacaagtcaagtaccaattcaaaaaggaaggaaaaatagtagatttaaatgtttgaagaagagtagggttttgtttgttattttgtttttgcttgtttgctcctttgcattcttggtaacaattgaaacaattctatggctctcatcctacgctactaaaattttgttgggcagttaacatctcaattcataggcaacagtctcatgaccaatcctctctgagctttgaacatatggctgcatctgatggcttcgctaatttcaccagggagagttttagaagatctctatttgagggggcagccattacacagatgagtgatacactgctggaattaattattgcttgccaagtttaaggattgattcattctaaactcagagccaaaaactcatcttaaagctgaaatgtttttgattcgctggttccagctccccttcacagaccctctaacctagcgccatgtgtgttttgctgttgagggtgaactacgtatctgaatgccctagtttgaaatgcgctttctaattatataaatatggtggccatacagtacctgggacttataattaaggatgatcttaccttgcaactccaggcttccttttcttctgtgaaagcttcctttcttcctgaaatgaaagtggcatttcagccatctgttgtgggctgctgtcaataaaagaatccaatcacattttacccacatgattctgcatgaatagtaaacttggtctttataaattaatatgtgttccctggaatttaggagtggtcttcagtatttctgaactttcctaagatgaataccacttgagaaaataatatatcaaaaatattataataattgctggaatttaatggagaaaagtggcagagattatgggtgaaagctacaggtcagttttggaaatctacctaaaagcatgtcagttgggtgagcttttttctctgaccaatgtatcactgtcaggacatcacacttatggcttgattagcttttttaggcagcatggctctctattcattgtggaagttatcccagtgggcattctcctaggtttccctggggaaagggtacaggccaacttctctcattttatgttaggactttgaagtctgacgttttcaattacataccaggcccgacattttctttgaataaaacacttaccaagtatcagacccacttttttttttttgcagtttataatacaaaaagcaccctattaatagtttgcttcatatagattgtcaccatgccaagtttaagcacctataatagccaggcttgcatgttaaatagaatcagtattctgttaaccagaagaacaaataaaaccattctcagttttccatatgtttaacctccttgaaactactgacaggtcttttattttggaagtatattttacacggaaggagacttcctaaatatgatttaattcttttctttcctccagagaaataggatttaaaactttgtacttgtaccctccagaaatggctcaaccaaacagagtcaaaatatcagagcagtgaaaaaagatgctatattgtttcagactcaagatctgtctcttgtgataaagagatttaaattctcactgctcaccaagcaagagccaatctgagccatggaatatattgaaatgatagaatgctttcaagtttagcatttgtgtgtgtgtgtgctccatggttgaaaattctgtttgagaaatatggttagactattttgacaatttttaacctgcttaaattggattttttaaagtgcacaaattgatgttctgcctacttggagaatgttttaaagatatcaagacttcaaagaaaaacagtgagagtaaatcagatgcaaacatccctgtatccatcctagcaaaattagtttagtatttcctagggcgatgctaaattagaatgatgctcaggcattagggcaagtaccactggtaatcatcgtttttgttatggggtgggaggtggctgagaaaagaaaatatattttcctatcttgtaggaatcaccaaatgacatcaacttcatagatattttctgaggttacaattgagaattcttagtgtccctgccactgtcatggataattgtgtcattttcaagtctcttggaatttggggtgttgggtggcctttcttacccttgttgttctttcctgtcctgctatttggtcatcagatatcattctctctcttattgcagggtaaattaggtcctgaaaatggcaaggagtattagacaagatttcggctccagaagctgaaagcattttttttttaaatgaagccagagagatggagtgatctgcttgataataaagcttagctttaatgccagctccatgctgttacagcatattactaaacagcaagaactgtggcacagatgttgtggcggccatattttacaccatgcaaaaggtcatgtcgcttgttattacattcagaatcaatattaagtgagcgttccaaatttcagctgtcagttgaatttattgctgcaaaccaaagctgaagggttctcgactgtgattcaagcaagctaacaaattaactaatataagggcatgcctagaagatgcaggtgacccacatgccaacagcaaaagcttggttcttacattgctgcaagaaagagctgctccagctgccaaccagaaacaattgtcatctcaataataaaagggagggagggagggagggaggaaggaaggaaggaaagaagggagggagggaaggaggaagggagggagggaggaaggaaggaaggaaggaaggaaggaaggaaggaaggaaaattaattctcaggtggagttaattcaggtggatgaaatatcctgaaggcagcttcttgagataaaatatgatgtatgcctatctatctgacaatgctcaagatcacagttaacaccccttagagtttacttgcattgccaaattagtccaaggatctggccacctacccttactccatggtcttctttagacctagacgtggatgcattgacccaggtgctaatcggactatccttttcatctcaccatgtatcatctcaacagctacattagggagagtctttcttatagtcagctctagaaaaggtacacaaatatctaatagatgaacatccatttaattcatacatggatacccctgggttgcctaagatggtttattaaatggaatttgagaattccaagttaatgagaagaaactataggtaatatccaatcactaggtcaagaggggatgacaaaagtctcagaaatgccataccagtggattctgtgcataatggtggatgagtaggaatttcgaggactgtcagcagcaagcctgagtccccatgcccatgggtttctctgaaataattctcaaaacatatccttaaaactgtctatgtccatgatagtttccccccagtgcatctgttaagacagtgagtgttgcccaatttgcaagttgtccaaggtatgcactggggcttatttgggtgtgagatttttttttatttttattgtttttgagatggagtttcactcttgttgcccaggctggagtgcaatggcgcaatctcggctcaccgcaacctccacctcccgagttcaagcagttctcctgactcagcctctcaagttgctggattacaggcgtgcaccaccacacccagctaattttgtatttttagtagagacggggtttctccatgttggccaggctggtctggaactcccaacctcaggtgatctgcccgcctcggcctcccaaagtgctgggattacaggcatgagccactgtgcctggccagggtgtgaggtcttacaagaccaccttgaaaccagtaagcaggaggaaaccaggttgtgtggcccttgtcggatggaatttctctcttaagaatttcccatcacagttggaaaaaaatatcatgagattttgtacagataaataagtctccaaactgctggtaatgcagaactaggtttaactggggccctcagcttcctgacaaaagcaggactcacttttgggtgttgactcttattctgccttctgtgacaaacaccagttataatttttaattgactttactagaagtgtttaggaaaaaaatctgtaattctagtaaataagtacttcagtcaaggactgttcattattcaagattcaataaacattttctgagtacctactctgggcacattctgtgttcagtgttctcggattaaaaaaaaaataaacaagacatggtccctattctcagagactgggagagaaacaggcatatacaagtgaatacaatgcagtgtagtcagatgtagtttaaaattctgttaccttagacccagcaggtttatttctaggaatttatccagagaaacagtgtgcaaaattatgtttaaatgaatgttaattgtatcatggtgactggcagctacataggtgctcagtgactgtttattgagtaaataaatattattttgaaccattttcaagagcagagatgggaaattctaaatgtaaaacaaagagggttggttaaatatgacatctacaattaaaataatttggaggaataaatatttgtgaagaatatttaatggcattaaaaagaattcctaaatatattgttaagtgaaagaagcttacaaaataatatatgaattatgattgtggtcctgtgaaaggaaaaaaaaatccacacacacacacacacacacacacacacagaagagaagcattcttatcctatatgactaaatcaagtgatggttggactaaaaaagtaaagcaaggagtcataaaattcagactatatatatcaaatgttttaacttaaatatagaaaaataggccaggcatggtggctcatgcctgtaatcccagcgctttgggaggccaaggcaggtggattgcttgagtccaggagttcgagaccagcctgggcagcaaggcgagaccccatctctacaaaaatacaaaaattagctgagcgtggtggcgtatgcctgtagtcccagctacttggggtctgaagtgggaagattgcttgggcctgggaggtcaaggctgcagttagccatggtcgcaccactgcactccagcttgggcagcagatgagaccctgtctgaaaaaaaaaaaaaaaaaaaaaaaaaaaaaaaaaccatatatatgtatctatatatatatatatatatatatttttcattaaccttatgctacactgatcttaaggggcagggccaacctttctctttgagtgtgggattgtttctttcttgcataaaccactcccattaggcagcatctatgattttctatttcggttctttaaaatagagcaagaaattaaaaggcttacaaagaagtctgaatcctgactccttctagatgtttacatgttccccatcatttttttccagttgtatccatacctaatttgacagcattgtttgtagcaatttgcatgcattgaatgtttttcaaaagactgaacttaagaaaacactttgtttttacactattttatgagttcatgctatatttaactgaattgtgaaattagattaaaacaaaactggcataaataagtttgagaataaacacaatttacaggagtagaagggggagggttattaaagactggcctacaagctgcatgctatgcatatgtttatatgttttacagaggagacagagagtgtgagctaatctaagtcaaccaaatgaaagtccactgaggcagctttgggtgtgtatattagcaaaggagagagaagacagtgatggaaagaatggaatctcaatgttgatagtgcttatctctggaaggggaaattatgatggatttgtattctttttctcttttcctatattatttaaattcatacaatgaataagtatactttcaaaagcaaattattcatttaattaatttattttttaataaataagtattagaaataaaagatgtaatgtgcctagcactgtgctatttgatccaatcagtgtttgggaggtggtacgacatatttgttagcaatgctctctttgtatttgggttccctggccttgaatctcagccctggcacgttttacatgtgtgattttgagaaagttcccttgaaattctctatagtgtccccgtttgtataactgcaaaatagagataacagtaacagtgcctaacagccagggttgttgtgaagatcaaataaagcacataaaaatcttagaagagcatgtgatatgttaagtgcttatatgttagctaggtcttgtttagtattatttttcttatgtcagaaaaggggcttaatttctaaacagtgagccaaagcttagctcttcatgtcattcacagaaaaaaaaatgcaagtaagtaaattattaagtaacagcatgtgtgtgcttgtccgaattctgtgggataggggttggaaaattatagtccatgagccatctaaccaccagttgcctgtttttgtaaataatgttttcttggaacatagccctgccattcatttcttggctggtcctggctgcttccttgctgccacagtggacagagttgagtagttgcaccacatggactgcaaagggtaaaatatttgctatctagccttttatagaaaaaatgtgctggcccctgctgcaagggatccatcaaggtagtctccttgtaggctacagtaaaaagagaaagcttggtgagctaaagaagatttgaagaggtgggaggaaagaaaaccctgagatatgaatccacatcatggatgcatggattctgctgaaaccaacaagagccatttatgtggaggagaagtgttctgaaagaagaaaaagtttggccaagtagggtaggaactaatatgaagacctttcttgacagcaacaaaagtattttaggtctagtgtgttgggcactgagccattacagagtgttgaacaggacaaatacagagcatggcttaaaggagattatctgacagtggtatgcacagggattgtaaacctgtaactggagagtaactcggtacctgctagagtcatatggttgtgagaaaatagggtttcagcaagagtgttagtgggaggggatagaaaattgaatttcatatagtcctttaatccttataagaatgatttcccacagtctcacgaagaaaacacttgggtttttttccctaggaataagcacaatagtatatagtcaacagcaaaatttatcattgttagcagtatagcacaatttttcctacaaaaggaattaaaatgataactacaaaatgggatacttaatctgggtgaaaatgtagaataggcttatgatgcctttctttgaaagtcatgtgtgtgtgtgtgactgcacaagatttagtttggggaagcaatctgaaaactatcttacttcatcaggatgccttctataatggtaagatcttaccttgccagttgtcaacgtctgatctgacttgctctctacttagcccttggctaatggtgtaagcagcattaacgcatatcaggctgtcacccagagttcagagtttctttagagtcctttattgtggtacagaacatcatgatggcaatgaggtggaaggaagaaacttttcattctaaacataaagtgaaaagaaaagtattctcagcacacaacctctaaaacaccaagcgggccagcagtggtgagcggtagctctgcctccttcctggagggtgttttgtgctgcatgttgtaagtagggactaatgtgaagacctttcccaacagccacaaaggtattttaggcctagtgtgttgggcaacagggacccatcacaggctgttcattactccagcctccattgacaaaaagtctttagcgactgcaaccaagaagcaaccaaacaacagagatagtattagaagatatatttattgtcctaccaaccaagaacctctctagatttcaatggggttaggtgagaggagtggtggaggatcctcagtcaccttgaccattcattgtgagatcccaaaatgcacttctatggtgtctaaaatttcacaaaattacgtggggtgagaaatgagaacatgttacttcatattgtcctatacacatgactttattagggtctgtccttcgtttgtagtcttggcactcactaacttagaatcacattatctaaggcaaaactacttaaataactgagttttaggatatgtatcagtcagtggctcccctcttcgtgtttgaatcaagtaacataccagaacaaacaagtctcagagagaaaggctttctgtaacattttagataagccctggcattgcaatcatctcctatggatactgctgacaaattctgtcctgttcccagcacaactttagagaaggctacaaccagctggagctgggtagtggggagggaggaaggaaacacagccactgttacatttggccacgaacagtgttgagccatttttcaatgtaccaaatgttctaataaggccacgatcaagttccagttgcctcatggcaaatcttaaatatcccaaatttgtagagagaagggagaagttcccaaagcatggaataaacaacactggtgacactccgggtgactctaggtggtttacacacttggcattaagaagcactgaatcacacagcacaaatgtttttcactgattacactctatcagctcttcttactttgtcaaggagaaagcctctatttgatcctagcatgtcttacttcataacagtcgatccttgtgattcttggatcccctacttgctaatttgccaactcacttaaatttatttgtaacctgaaatcaaaacccgcagtgctctcacagtcatttgcaggcatgcacagagcggtaaaaatcttgagttgcccaacgtgcacagtcccagctggagccaaacaaggcaacactctgccttattgtgtcagctctcatatcgtaaacaagtgtcctttcacggcctatttagtgccatttttcccacatttgtgtactttttgttggtgattttgctgtttaaaatggcccctgagcatattgcttgagtgctgtctggtgatcctaagcacaagaaagccatgatgtgccttacagaggaaatacatgtgttggatgagtttcgttcaggcctgagttgcagtgctgctggccatgagttcactgttaatgaatcagcattgcatattaaatatggtgtctttaaacagaagctcacatacaacaaagctatgtaataattaattgataaaaatgttgtgcccagagactcacaggcacctaactctgtgtttcctctaggagcaatgattcagtattctctaattcagtgttcacccttgctgacattgtaaaacataattactgcaaatactgagacccaactacacttacataacacactggcaatagtatttttgtaagaatttgtcaacacttttgtttccacttatttatttgtttttttgacatttttattatttgttcttgctgttaccttctatttatatcacaaatagcacttaaaatgtccctatgttacaggcctgctgcggtggctcacgcttgtaatccaagcactttggggggctgaggtgggaggatcatttaagctcaggagttcaagaccagtctgggcaacatggtgaaccaccatctttacaaaaaatgcacatgttagctgggtgtggtggcatgcacctgtagttacagctacttgggaggctgaggtaaaaggatggcttaagcctgggtggtcaaatttgcaggaagctatgattgcaacactgcactccagcctaggccctaagacatagagacaaggtcttgtaaattccatgttacaaaatagtgatgcaaaatttccaaatacctttattggagcaaaatgtgttaatacaaagaaaaaatattaagtaaataataataaaggtactacagtattaaagccaaaataatatgtgaaggaagtaggcaagaaataagcttatgatccctgggattggagagagcattcattcttctcctttcttacttactgcctccttagagtctagccctatagctgagagcgagtttaacagaggtaatgtgacttcgtttgctgagaaaagaaagaataaatgaaagtgatcaggtgagtatgtggccattctaaactcaggctataggcctcgtagagtttagaatttatgaaaatcacagaaaagattaggagtttcctgcattggccctaagtttccttagaattaaaagttgggctggtcgtggtggctcacacctataatcccagcactttgggaggccagatggcttgagtccaggagttcaagaccagtctggacaacatgacaaaaccctgtccctaccaaacatacaaaacttagctgggtgtgaaggggcacacctagctacttgggaggctgaggcaggtgaatcaattgagcatgggaggtcaaggtgcatgagccatgattgcatcgttgcactccagtctgggtgacagaatgagaccctgtgtccaaaataaataaaaaaataaaaataggctgggcacagtggctcacacctgtaatcccagcactttgggaggataaggcgggtgaatcacctgaggttgggagttcgagaccagcctgaccaacatggagaaacccagtctctacttaaaatataaaattagctgggcatggtagcgcatgcctgtaatcccagctactcgggaggctgaggcaggagaatcccttgaacccaggaggtagaggttgcggtgagccaagatcgtgccactgcactccagcctgggcaacaagagcaaaactctgtctcaaaaaaaaaaaaaaaaaaaaaaaaaattaaaaagaaaataaaagttggcttctgagttactgttaataatagagctcattgttcatcaaacttggcctctaaagcaaatcctgctttagatggcccaagcaagctggctccctcttgttttataaagatgccccatgtgcagccctgggaaggtgagatgggaagatgctctcaccatccctcagtcaagtcattgagatcatttccaagttcagctctttgcgtcacactgtccttcaaccggctttattgtaaatgcaagagaagggaggtttttggcacttggagcaaaagatgtaaaaacaaaaaaattacaagggagcagtcaaacagaaaagagagcaattaaagagacaaaaagtccccttagctgccttttgggtacttttttgatcttttcaccaaggaattagtagcttttaattttccccacctcagcttaaaagagtgctggcaggaaagaaatgaacattatgggaaggctgctttggattaaaaagcaaatgtaggtgagactatcaggcagctgtcagactccatgaacacaggcctgctcgcccagctcagcagccaggttattgctggacaacaaaagtccccaatctagaagcagtggctttcctcagccttatttctaataatcaggtgcatgcctccacttggcttgatattttctacaatcgtctggcaacttgctgcttctgccacttaaaagtggggaaggggttgcttaatttttaaagcacagtgcatctgaatttgagtgaaagctcaggtccttgttctcactgtggaagatgaaacattgattggcttcaactagaaacaggttttttttttttttctgtcttttgtttttgtttgtgtcttttttcctccttcccccaggagggttgtgttcagcagcacacaccgggttcagcccacctagcaagtccaaggagaaggggtcatgttcatctgggagatggtaagggccaggcctgggcagtgaggggcaggagtgagccgtgtttgtggatgatcactggatgctgcagggcagacccacatggcactggcggcagagctcaccattgggaaccagagtacaatatttcagaaggaagggtttctgaaccccagtttaacaagccctctacagcaccagttgcaatccccaggaaactcgttaatgcagttagatgccacggcagtgtgcacttaagacagggaagaagtacagctgctcttcagctccgcggatgccaaagcagctcctctgttcattagcccagcctcttcctctatactgaccttatggagatgctgctggccttctgagaactagtagaggcaagcttccaaatcattgtgttgtttttagcattacgaaaccatcagccagtatctgaagggttctttgcctaccagcaaatcgcttggtcctgctgaggaatcacacagatggtgtgggagccctgggctccctcccagggtgcgtgtctctccccaggggagcaccccaaggtggcaagaagtcccccggggggacttgaccagggccttggtcaagcttagaggtgcagtgtaccccaaatactaatctggaatatatggagtatcagtcaatgtttgtgactaaataagagggagattgagggatgcttggaagtcactgagccaagcaggaggcaaagctaaatggtccatctattgataaccttgtgaaattttttgcaatgaaattaggtttaatttaattgagaaaaatggacagggacccagcagtgtcatcgttgcagcaacagttgtaagcatgggtgctagagtcactgtctaattcaacttctgactttgtcattaatgagtttttagactttggaaaaattgcttaatctctgcagcttcagttttcacttttgtaaaatggggaaacaaatagtgatgccctgaaggggttttgttgttttggggggtaaagaaataaacagaacaatgtgtgtgaatatgattaacacagagcctagtccatagaatgtatgtagtgaaagctcaatgcttgctgctgcttctcctcttcctcctcttctgtgattaaattatttaaagcaggaataatggtttttatagaaatcatccccctttcattttaggctaagtagcatactacagtcatatgaaccttaattgtgatcacacatacaggcgtaagcggaaagataatatagttcctgccttctgggtgtttacattcctagtagtctctgctcacctgcttttaaccttctccaggataatgagttatgtgacttttgggtgccaggtatataaaaccatgttttcctgtcagccagccagtgactataagaattcacacatttgcatttgtcattgtaattcttttgttccaaaaagaggtgaaaaaaaggttaaaaggaatgtcatccattggaaagatatatcaaaatgtgtacccgtatctcatcagaacctcacacagaattaagagtttgtgttatttgggtttcaatttaaggtagagaatcaaaaataccagtgacaaatgatttgtgactcctacttaatttattcaactccaaatgatttcaataaatctgggaattcatctatatcctgttgaattaaggtttttttttttgaattattctctctaaatatgcttaatcttcattaatgcagccctgcatggcattctgagccaaagtgaactaagaggaaaattttttacatttctaattcttaaaatagacagaatttctttttttcctactacacagtctgccaaggcatgtatgtatagagatttgatgtacttgtagagtttttctctctcattcgcctatcctgttttatcctagcacactctcatttctggatatcacgtgatgtgatttaatgtggtcactgtattttctttatttcttccctttttcctcagtgccacaggaagatgaatcaatgatctattaatatgcatttcatttggggaagctgttttaaggaagtttctttcttcccttttttttcctccttgctcatgtagctaatgaaacaatatgcatttcaattccaaggctccctggattcagacctagagagtagctaacacacaattgatttctagtcctgcaggaaaaggggaagcagtagagaaatcagatggattgatcgctgagaaacaggacccatgggatgcttcactatcatccatgtcttgaatgtatgcacaatcccttcatcaatagagtaatccccaggataggaacttcatagggtccagatggtagttcaagtaggcaggtgtgttagcctgtagtttgtccctcttcaggtctgctctgccataataaactgccaaaataaatttacaaattcagactttagaaactggcaaatcagaggtagaatgttgagcagtggtgctgacatttcctaagagagcattagacaagggacagcaagctcaaatgtccacaagtaccatgtaggttggtgtgagacagtaagtgttaaataatttctgtccatccctcaggatagcacctgcctacttactttgtgttataaagcatgagtggggtgggggaaaaatagccaaatgaaacatatttatgggtcatctttatcctaaaacctgctatttgtggtccctgaattaatactactcatcattttacagaagaaactcaaaacatgagaaattaaacctccttacccaatgtgtcacactcagaatttcccaatcttttcacatttttttttctgtctctgacgccatgaccaaatgccatgcttagagttcaacttctagttttggaaaaccagcctctaatgcctcaggtaccaagcctctgcagaatgctattgtttacactattagacaggattctctctctcacaaatggcagaggctgaactccagctggctttggcaaaaattaaaggtgaattcattacctcatgactgagaagaataagacaattctagctaacagagtgactggacctatgttcatctcttagctcagttttctctctcggccttgttcttaagaagaccctccattgtaatgacaagataagttccagtatgcctagacttacatatgtacctgtttaaaaacccaaccaaattgtcctagagcttctctttcttaatggatacaaacaacacactcctaagattgaatctcattgaataacttaggtcatgtgccctttcctaaaccactggctgtggccaggagaaaggaataaactgaccaggctgtggaaactccccactgaacctcctggcctggaaataaggagaaaagattgagaccttggtccaaaaaaggggatgggaatcaggcagccaaaagcaataattaccagtcatgcttccacttcacactctgtttgttcagagcctgtctttaccacccaggagctttaacttagcacataggggtttggactttgttgggccacatctcagagctccccaaacctatcagaagacacacactgggaattaatacaactttctatgactcaaatgcaaaaagttaacccgttatagaattctaggtttctccacttttcttcactcttctttaacatatgttactaagcacttagtaaaatactagtcactttgctaggtattaagcacttaaataccagacacttgacaacatgctttattttattcatacaacaatcttgcaaagcagagatgattatccccagggggcaaataaggagcatctgctgctgttcaaggttctaaactgtgttccaaggagccatgagattccacactcaggagatggggggactgggagaatccaaagtgtagatcatgaggccaaggcctgatctccatcagagcacttcttttgttggtcttacatttttaagttttccatactaatttttctaaaggcattgatacttacattctttttgtgaaaatcacttagcaagtaatgaagttattttactgctcagtacttgtacaattgcaaatgaaagaattctgacttaacctcaaaaaaatgatagaaaggtccaggcctggctgaatccagagcttcatgaccggggcttccttctactcaaggaagtttacattctttgactccatgtagaaacaggatggatatctatcatgctttcccttctcactttgttcagggcctgcatttcccacctggaagctcctggcatccatcctatgttctatcaatctcagcagagaaaaggctttccttttccagtgattccaacaaacaccctgtcactgagtcttattagatctttttgacctagcctacatatcatggctgtccctgtcctctgtggccagagaagtaccatgctttgtttggccatggtggaatcaggtgttcacctgtgcaggtgggaatggagacaaccctcgggaaccacatgggttgggagtgtgagtgagttgccccgctaaaggaaaactagaggattgttggtgaaggtagaaggtggtagatgagagttcacttgcccaccaccgctgtggtagagctgagatcatagcatagatctttaatttcaaatgaatgctgtttctaatgcttcatgttacttctcttttgtccttgatatgcctttaaaaataacagctattaagtttttgcttaattctttttattttaccatggcaattagtggtggatgggtggcccaaggaattttctgttttccaagtgggtaggactgtttttatttactacactatttgagaagacacatgcatagctgttagaggccctacttttgacatcagaaaatgggttcagatcctgattgttattgaatgactttgtatgactttgggccaattgccttactccagtcccctccttcataggatttttttgaggattaattgaaagcatatgatacagaaaatggtctcagcacagttgctagctcctagtattgcttttctcttccttaacttgatttactcgcaaggattatttaaattacaaaattccttaaaacatgggatgcatagattaattgacagtaaaggaatctgtgaaaacatttcttcaattaaatctattgcataaagaaaaaaccacctgatttacaactcattattgtgatgaaagtgtcattagtaattgttggcagcatatacaagccacagtgaaatgccaaagaagatctcagaaataaggaaaatatttcagtcctctgagagtcaaagaggtaaaactcatcacataacgggtcttcaacaacacttttcttatagatcatgtattaattaaggcaatgcaagctgtggtaacagaaaaacttagatttccagtgacatagtgtctctcacgctcactatggtccaatggccaaaggtccagtcttctttcttattatttagggctcttccttagatcatcagcttcctctccattcagccatggcaaagtcacccttgtttctcgattactgagccaagaagtgacttacgtcactcctttccattaatggtcaagtagcccttcctagatgcaggtactaggaaagtgagtcctaatagcaactcttcaaaatgacaggtaggaattacaaaatctttgtgggtcaagctgatcatacctgctgcagctctaccccactagatctactacacgtcctgtgatctacgaatctacgggcatcttgagaagaaccactgtgtcttacttagcattgcctccaatgcacagcatagtacctggttcataaatgttttctaattgaacaaaggtatcaataaaaaaactaacagataatcaggctaggcctcgaaaataatttctagacaaaaatttgcaaccacttgaaatccatatttttcttttcctggtctctgtccaacttgtctgatatggaagtaaaagtagggtaatgtaaccctaatagcccctgaccagagaactcccaagtaagagctacccattgtgggaagccagaactagtcgtaggtcagtggctgcttcaccctcatcccaattgctggcctatttacaaagttaaactcacttcattcctcgacttgaatggatgaggagccagaggtaatcctggacaggtggaaggagtggattccaacatttcttctctggatcgcccagccaagtttggctgctcctggtccatgggtctgtcctcttccaggttggttggacactttgaatgtcctgtgcttaatgattattatagcatccacataaagtcatttgggttggttttctttgctgctgctttgatcgtgttgtttagattccagcccgctttctctcataaaccatcttagtatgtgctttcatttgtttattttcagagccaacaatattctttggtactaaaggtagtttagagaagtagttaagaatatgctgtctgcagtcagactgccttaattcaaatcctggctcagcttaccagcagaatgaaatgggactttaataagagctccttctctagcaggttattatttaaaaatagtactcagcacagtgctggagacataatatgtacttaataaatgttaaccagcatcgtttttattgtcattatacaattttcatactttaccattttaaacaggactagatcccattagagtttacagataaagaaatgacatcaagacagttgagtttcccattgcctggtttcttgatttaacctctatctcagttctttgagtgtactttttgttattaacagacaaaataaaaagcagacttttttttttaaagatatgatggagccatgccccggctttgattcctgcacagagcttccgttcgtgtcagtgcgatttctctgcatggattgatggcagaatacggtctgtttctaagactgtttaaagcagggcacaaaagaaatcacactggctgagtccacagctggcaaaatgggagagactaagctggtgaaagaagctgttaatacagaccagaaaatttttaagctaaaaaaaggaacatgcccactgaaagtctgaaagcaaaagttttatttgggtaaagcgatgttcgactctgcatgattcctacttagaaaatgcacacgcttgccttctccaactgccagaacatcattttttaacacagaggaacgaaaatagagagaggaataatgggctttcagatagtccatgccgaaaagcaaacctagaaacataaacgttgcagtgcctggacccttcagattataaaacagggaactgttctcgtcacccctcagtcccagaggtgcctccgccatcttgcaccatttctgtgggaaccaatattattagcaacatagattccaacagagacatgacgttgtggaaagaggaggcgctcagtttccaagtcactttttggcactcctttctctaaccttctccgcataggatccctgcaaagacctttgccctaagcccccaggtggcaatattcctatggggcaaacattctctgaaaacaaggcttctccatcaaatgctttctacattgaatacaaaatgtttctctatcactggcagagtaggcattcagtgaccacattgatttttccttatttgtaatccagtgaaaaatatttttgcctttcatttttcaccccaacccccagaatatgattcaaaaatctcatggccatgcatgtctctgccagaggtttctatttctctgtatctcaatagctgcccacaagaatgtatttggcttggattgtaaaccccaagtgtgtgagcctagagtcttggtaatattcttagaatttatctagcaaagcactatgccttcaataaaagatcttgagtgatattttagctattatatttcagttttttgtatacttttgatttctctcatacattgtaaactcctagaaacagaaactattttttatatgtatgcaggtgtgtatttttataatctgtgtatcttatgtataatgtaatacgggtacacattacatattgaaatatgtaaatattccacaggatggatagcaaagtgctttacatatagtaaattctcatagatatgaaatatataatatattatatatttatatataatatattatatagattatatatttataatttattatatatataatgtatatttttatatattataatatataaatatatataatgtatatttttatatattataatatataaatatatatatagaaatgaatgaggataatggttgtgtaatacacaggaaaaacaattggaaccctaagtatgatgatcccaaattcttcaattaagaatcaggaagagagatctagtcttgatttcagccctctctgatcatttaatgaatcaaacctgtcttgtatgaccgacatagtgcttaagaaagtttggaatgagtgagctagaattaaaaacaaaacacatctagatttccaattgctcttgaaacatcagacagcctgaccgctgggccacatccccatgtgtctcagagtcatgtggagtgcaaaggcagttgactcttcagatggaacatacattttccagggagccatcatccccactctccatactccatccactctctcatcatccctactcacctccagcagtgaggaagagtgtcacttaccatttacaagatcaaggttgaagtattgtttttcctgtggtaaagaggagagtaaactatttgttattcctatgcttctatcaaaagtggacaagtgaaaagcaggtcaagacagctgcaatttcacaaagctggccttgctcgtttatgggatcttcctaagccctctaggcaaataaatctgcaaaccatgccttaagtaaatcataacagccctgagccttcattacagcctcttcccagctcacaattttcctttgaggaaaaatatggttatggccatgatgttgtcattacaacctacacaggatcagccattgcctttggcttacaggtcattctgtgcagcctgggacagcctgaggatgaaggcagagactggtggcacattttgggaggagattctttctgctcagggcccatttccccattattgtttgtagcacaggtgcggaaagatatttggaacatatcccaaccagaagcgtgcatcaggagatgtgatcgtcacgtgtggctccagagggttgctcgagacttgaagacaacgtgttctgtccacctcactgactataatagctcctcgggagccacaaagagcagttgtgtacatccttaagtttaaggacttcctccagagctagtgtttcacacagtagaacataatggctccctgggaacggttaccagaggtcagataaatctgcatgggggtcttactgccttttttgaaaaatggaaaaaaaaaaaaaaaggtgactcatttttaccccaggaggtactgttctgttaacaggcatttacatgataatagcggtgtcagcatgtgcaatgttatgaaaagagttttgctctaggtccagtaacattttcacggtttctgcaggagcctgcccctctgaggtttcggtccctgactgagctttccaatttgtctcgttcttccttctgcccatcctgccacacacgaagtatgccagggaaggaaatcttttctttttgtacaaacacttcctggattccccaggaccattagtaaattatgagttccaactggcttttagaaataggctgggtgaaagagcctgtccttgctagtaaagccttgagagagctttgcccttcatagttaaattaaattctgatgaatattctcaccttcacttctgaggtagttagtgcaagctgggctttgagatcaagagaaaaccaagttcaaatctgaactccactacttcctactgtatgatcttgagcaaatgacttaacatctctgagcttctattttctcatctgtaaaaatgggttataataataatagcttcatgggatggaagaagagagtttttgaggtttaaaggagaaaataatgacaattattatatagccatacctagtagattatgctaaatacttaataaatatatagtaatattattatttttcaacttacctctttagccattctttcatctttttctccctttctttttgctaaaaccacatgtaaataatgtattatctctcgaaccatagtttatccttaagagacatcaagaggccaggtgcagtggctcatgcctgtaaccctagcattttgggaggccaaggtgggaggatcacttgagcccaggagttcgagaccagcctgggcaacatggtgaaaccccgtctccaccaaaaaatgcaaaaattagccaatcatggtggcacaggcctgtagtcccagctactcagaaggctgaggcaggaggatcacttgatcccaagaggtcaaggctgcagtgagccatggttgtgccactgcactccagcctgggtgcaaaaccctgtctaaaaaaaaaaaagaaaaaaaaagaagcactaagaagtaagcaagcatgaccaactagagtacaaagcattgtattgcagcatagcaaactttctattagtcttcactttcacttctgtatgcacctttctgcttgcttggagagaaatatcagaaaaatgttaataagccccaaatttgagaagtaagaatagaaaaatgatagacagtgaggaatatcgcttagggctcctttccccaacaattattattcctgaatatttaaattctatttctatccacctattcaattgaagaatatattacagtagctatgtcgcccaccagtccactcagaacccagataaaatccaaagctgcctctacaaacacacattacacaaatgctacaggtggtacacgtttgccaaataaaacacttgtttgagaaaaaataaacatttactttgggcatgacaaattacacgtgtttacttcaaagttgtggcttctgctggtgaacctgaaagggaaataaattgttttggtcctggcagcttaggcagaaaggtgataacagggtcacgtcatcagtagcaattcctctactaggaaaatgttagggaaaaattacatttgtgatggctcctttacaatatgcatttgctatcaacatgattggcaatgattcagtaggtgtttgctgattccttctgtgttccggttgctgaagttaatgtgggtgtatatgacaagggtcaaattcatgcaataaagagtaagatctggaagagtttgaaggaaggagaaagaagtaggcaactgtcttggggacatgtttcacatgaaaggtgagtaggagtcagattcttggcacaaagttagaaacactgtggaaaagaaaaagctgcaaggtccccttgaaagataattggtgcagggaagggacatttaggcaaagcaatgctaatgggaacttaaagcacgttactaatgcaatatggtttcctggattgcatcctgggacagaaaaacctgatgaaacctacaggttagttactagtaatgtgctgatattaatttctttcttttcacagatgtactgtggttaggtaagaggttaacattggggagactgggtgaaggtttctagtgaactcactggattatttttataacttttctatactctaacattattccaaaataaaattttattttacaaacaaaatcaggaatgagtgatactaagtagagcaattcattaagcttacctgaaatttgggtagatgagtgaaaattacagctgagattgagggaaggattggtgtcagatgagagagtgacctgaatgccagactggagaatcctcacccttagggaggtgtttttgttttgtttttaagcaaagtagtaatctcactgaagtatggttgtagaaagattaatgtggtcaaaatgtgcaggaaacacaggtaagaaatagagattggtacaggtggacaaatgaggaagctcttttgcaggaaagtgttttggggaaagataatatttatgcttgcttttccccctaacatcctgagaattcagtaatggtgatatgtaaaatcagatctattctatcatcccagtgatttgaggcttctaaatgggttttggaaaagatgttaagggagaaatccacattaaattaagttagattttgcaagggaatgaccagagaagacccatctaaggacctctctatggtagaaatctagagtgaggattgcaaaggggagaaaaaagtcttgaaggcaatggagaatgcaaggtggagaagccacaagaagcaccaggaaggtacattgctcccaaaagtaaaagaaagaaagaatttccaaaaaaaaatgatgtgaacaatattgttaaatgcaggaaaatagtatacattaaggcaaacagtagccacacatatataatcagggaggtaactaatgactgtcaagagaactgtgtcactgaagtgaggaagacaagccagattttcaaaacgttgagaagacttcgaggcaatgtgcataagaaattacttctttagaaataaggagagaaataagatgtcaaatggtggagatacctctatgagtaagaatgcattttgttcttcttcttgttactttattactatttttaaagacagagtaggtggttttggtgaaagcaaagggaaaagaagtaggagactatggatgctagagaaagtaatggaaaggaaacagtgacctccagaaactagagagatagaaacaagggcacttacaaaggggttggttttgtctccactgacaccaccatcttgtctcctcctctggcaccatggtggcctcctatctaatctagtcatatctactcttgatcctcttgatatattcttcacagttcaattagaatcttatcatgtgttatcctgcctctgacccaaaacaccttttatgcaattgttctttggatcaagaccaaaatcctacaaggggctgcatgatctactctgcagctttaactcaatcttctctccatgctctctggttccagatgcactgacttgctctctgtttctgcaaatcgctgtgggtctttgcacatattgcttactcttccttgctcttccttctgtaccttcatgtactcaactcgcagcaatgaactcagttaatattaatacctgagtgatgcctttcatgatatccttaagtcaattctcccatttatacactcttagcatcttttttactttcaaagcatttatcacagttcatttggggtgcgtgtgtgtgtgtgtgtgtgtgcgtgtgcagaattgtttgattaatgtttgtctctcctgtagagttgggagtggctcatggctgcagggatgccatatcttcttcgtaggagattgccttaacattcttcgtaggctggtaatagcaactagaatatgaaagtcgcacatcctttgggagttgctgttaacatgggctgtccatgttcaagtgtttttgtagcctctctggaattctctctagctggctttcaaagtcctgatgcagcgtgagtcaggcatgtcctccttgaggatagattttttttttttcttattctttcctccctcatactgtcaatatggcattgtcaatatcggagtcatagctctatgctctacaggagccaaacatggatccactctccagtttgttacaatcccctcttgaataccatccagataagttattaatggtaatacggaagtggaatctctgcttgttagtaatcttagcctaacattgacagtcatttgaccattttgctgaggtgaggacttagcaattgttgacatgcagaaatatgcactcaatgttgtcagatctgctgatttttgagccagatccatcccaaggcccttcagtctgacacctcagtgtgtgggaggtttcacatggtccttggagtcctgacctcctttttcttttggcatcccacttaaagcttccttgcattaactaggacccattctaaatggcatcccctttaatgagcggaaatatttgtcccctttaactgaacagctcttagaagcaattagcatttagggaacttcttgtttagaaataatgtcttcatcaaactacccattatggactaatttgaaactggaagatagatgctcattttcctatggtagcacctgcaagcgtttgtggcagtggggctaatagcagcactattgtaagtcattgtatttctttcgcaatgtgtgtggtgggtaaatagaaaccccttcaacatgtaagcatttctgaggacaaaaaaatatgttcctttcaaattgtactatttacctgtcattacagatctgaaggttgagaatgattctcatgttataattaattctctcattgcctttgagatcactgccttttggccactgtctaggaaatgaagagggatgctatgtgtgagaaatgagtactctgtcagaaaaggaaaggaaagaaaacttgttgctgactgacagctgcaggaaaaaaaaatcttttgaagtagtttaaggggaaaacatggatctaacacaatgtgtttatgactccaacagagttgcatgtgcttgaattaattcatcctgaccaatgggtggttctggcaccattttggtaatatggataataacaagaaattttagtaagtgattattaaattccagaaactatgcaaagtgcatttcataatctttttcaatgactcatcctgatagtcctctttaccgatgaaagaatgatgcttaagtttccatttattcaagtttactcagctagaaagtggaagagctgggattcacgtccaggcgcaagctaactgcaggccagagtcttgacacccctaccacacagatgtcagctttaccagcactgaaagtgaaggcctcctgctcccctgccccatcaccatcagctttctataatttaaagattctaagtgggtcactgctttggaaaagcccttgttaaacaacaaagaagctactgccagccccctattcaccactccaatcagcccacagcagagagcaagttcctggtgaattaggacaagaggaagaagacgagaacctccaactatgtagaggtaggcacagtatcaggcatttcacactgctctttagggaagaaggctggtggggccagggtagactgaagaggggctgtgcagttcgaggaaagccccttctgtgggtggcattgactgacgtagggctgaagcactcaaaggagtaagacagagcgggcgtagtattccaacagatcgcagactccgcacttttgcctagggccggccctgcttcaaagtgaaacttccacaggaaaactaaataaaggaaagaaaagccaaacagaacaaattcccatttagtcagcttttactgtcctcagaggctctgtgtttatgctagatcttaattatgctgcttgtcaaagacacactaaactccactgtggttgagggagctattttatctttttatctttacagtcagaaaaggacttagtatgctgaaccctacccttgatgagcttcaaacctggaataaaagaacagttctctctcttctgcccaattgtccccacctctgcactgccgtccatgaacacctaatcaggaggctttgatggggttaggaatagtcagcgcccaggtggcctgggacaaaactgtaacatccaaggggactgcatgggcttcccatgttcaagcccctatagtggccctcctgctccaggacccatgcatctggtctccaaccctccctctgcagggcttatgacccgatattctggagaggcactcagctgtatctcccagcagggtaaatggcagagccttcctctgggtatgtaaatgcaggggagggggtgtacttgagattttaaatgaacaataatgtgcattaaacaacttcaaatcgcatggtgaagaagttattccatttccaactctctttagtccttcagatgaaatcagggagaacatctctggttgagtgtttttgtaatcttgctttcttttcactgtatttattttggcctttgctttctatttatggcagatacttttacttttctggtgatgacataaatgtcttttaaaataagtgcatctacttaggggaaaatcaaatttgcttaaagaaaaactattacataaataataaaggtacatgataaaatgaaaactgtaagaaatacaaggactaacttttagaaaaagctctaattaagatgctttgtgttaaggttcactctgactaaacctgtgaactgatagatgttcatgcagctctccttgcagacatgcctgtgtttagagggtcttgaaactgtggcagatccttaagagtggtaagttaggtctaaaaaccatttcaggtccctaaaggcaagatcaaaagaaggatacttggtgttgggcatgtctatccccagtctaaatacattatctatgatgatcacagtttgatcatcagttatcagactcatgggagatgttggctttgtaccaaaattcagatacctggggcccatccccagaagttctgtttcagtaggcctggggtaggccctaggcatgtgtgttttgctaactatcccgtgtcatagctcagcatccccaactgacaatcactgatgggctttggtcagtgttaccacccagtgttgtatgtagatccacatgaggaaaggtatatgattacaccttgaaaatatgaggataacaaatctggctggacaatccactggaggtcctttttatctgcacaatgtgcatgcatttgtttctatgcacaaagtaatccctgaaaaactggctcttacagaatgccacagatgtcatctaggaattttcctggttcctgttagaggcaagtcttgagttgggttttatttaacagatgagaggaacatcttggatccctctagtagtagctccatagtccttctctttgacaagcttcatgatgtcgtttacttcaggtctctgagaaaacgaatggaagtctgtcgtggaacacccaagaccagatgtgataggattcatttctaatcacgcattatccaggtgacttgctcaagcctagcttacacagagttccctttcagcatagacgtttcctaactagcattaccctgccataccaaaagccttgtgaaaatattttcagcagttaacaagcagagcctgcagttataatatgctcattaggccgcatgttagttttcaagtcttgcagcatgcataatctgatgcttgatttccactgaatttcagttctgttgggcatcagcagacaagtgctggcagccccgtgggctttgccaagggctgctgtctttatgtgtgttttccacaaggccatgctgactgtaaaataacacacctaccctatttgaatctccagtttctctttgtctggatgtcccttcaattatcccagaacctttcttgattccctggcagagaaaccccttcaggaaccacactaattttagaagacaatgcaaaagatatagccagtagtcccagtagatgaataggctgatttctggaatttattagatcttcctttgttctagacttcacttctatgtttcaaaaccactgccttaaaaaaaagaacaacgctctcattccaaattatcagttttcgaataaaggtctttgaccataggagtacagtactttttccctatactttgaatgtatttgaaaagaaaaaaaaaaaaaaatatatatatatatatatatatatatatatatatatatatatatgtatatattccccagggtcaaagtgttccaatgctgtgcgagctgagaatattttggcaatttcatattagtaaacaaatgtttctggctgctgaaggtataatttatttttattacattttgaaaatttcttggtggctggttatgaggggcagcgtttatttattccttggtcaataagttggtgccagcatatgcctggcagagtgttaggccttgaaagtacagagatatatcatacctgttccatatcctaatggaactaacagtcagtggagaatgccaaccctctaaacagataaatacaatggacaagatgagtggtattattggagctatgaacagaaggctacaggatggagagaatggagctagtacaaagaattcacagataaacaaagtcccatgttggagaagacgcaagaagagttggaattgaattgaattcaatttggggacaggaaaccagagatccaaggaagcaagagtgaaggaaggcaggttagaaccaaacattggcaggggcaggggatatgcctcctgagagatggccaggaatgcagaatgcaggctcatatttgatttgtatgtatggactggtagagatatgacacttgggtacatcagcctggcttagagaactgggtggggccaataggcagagaatgggtaattcagttgtaagaccagagagatcacaggaagcgtcttagtccatttgtgttgctgtaacaaaacatgcacacacacagacacacacacacacacacacacacagggtaatttataagaacagaaatttattttctgagacttctggagactgaaagtccaagattagcgtgctggcaggtttagtatctgatgaaggctcattccccgtagatggcaccatatcaggtgtcctcacgtggtggaagacctgaagtgcaaaaggaacaaacagctctcttatatctcttttatgaagtcattaatccattcatgagggcagagccttcatggcctaatcacctcttaaaggccccacctctcaatactgtagcattgggaaataagtttcaacatgaattggggtggagacacaaacattcaaaatatagcagtaagtgagggacgcttcattgtttaaaacctttgaaccctcaatgtggagtgtggataaaaactaatcatattttcttcccacttaacacatttcttctatgtgttaagtgggaccctcccatgactcagccgtaatagtacatttccctattaccagttactagaagtgttaaatgagctgatgatgtacaataaccctgctaagagcctagaatgtgaaagaatttattttggtcacatttctaaataatgtggaatcattctaattccttaaaatgtgtgatcctcttagatgggaatgaatcgagcttgaaacctgaaaggaacatcttcctcctttaggcatgtcagaatattttgttgaggggtacccaaggtgttcctcacagcttgaggaaattaaaccagttacacactgggcagtgtacatatttctttgcagcttctactagtaggcttctttattgcatcttctgatggtttaaatgaattcttcctgattcttgtcatggtgataaagcactcatgttggcttgagtaagtgtaggtgcattgtagtgcaactaatgatgtctgaacaaggttcacacctgtcaaccttcattctttcactatgagactagcaggtatttcctaagatgccaaatcttaacttgtgtgagtcctagaaatgatggcatgttgaccctgtatattcaaagaaaatcaaatgagtatttgcaaagacggttgctgacttcaggtagataccagcagagacttgagtgcagaaaaacctaaatgcttgatgtaggaggcattaggaagagcctcaggcacacagagaaatgtagcaaatcaataattggccaatcacttctctgagtttatcaaattctttacctcttacacagtgaacaccaaatctgcctgcctgggccagatttctcttatatggccatttacacgggaggaaacagaggggtaaagaatgcccccactgcattcctaaaattccaccagtcaaggtttctccaagggagactgacattctaagcctatcagctctgtctatctctgctcctttgaacagatagaaatttgagagtaggttttggtaagtgggagatttcagagagggttagggcaccctggagaactgagccagggagaagagaggtcttcaatggagacaaaaatgaaccagtgacagctttcctagtctccatttttctttatttccgggagtgggtctgctttctgtgttgatgttggacagggagtcgggaagcaccaaacctgtagggctcctgtggagctccgtattttccattaccaggacacagatctgatacttcagggtttgtgggagtaatattactatgcagaacagaggcataaatactttgattcagaggatagacctcatgctcctttccctcctttctttcctccttccttcctctctttctttgtttattaacttttttatatatatagttgccagatctctttatggtggtctatttgcataccaaaatttcacttatggtaagtgtacagtttagtgatttttaatgcatgtatatagttgtgcaataatcccctaaattatgtttcaaagtgcttgccctagctcctgcccaatttatttctaattaacatacaaaaccccatttaaaattggctgatattggttgagcatcctgaatctgaaattttcaatttcaaaatacttcaaaatcctaaactttttgagcgccagcatgatgttcaaagaaaatgctccttgaagcattttggattttgggttttagaattggggatgtttaatgggtgtaatgcaaatactccaaattttaaaaatatgaaattcgaagcatttctagtcccaagcattttggataagagatacctaatccatagataacattcttctgcttgaacaccaagaaagcatgttttacagtctcttaggctaataatgtatttaaatttattttttctagtttctatgataataaaattgctatggcatgaaaagaaacagagaaatggaaaaaaagataaccctttcttgccgtaagccctgtttgcaagagctgatcctctttcccatactttgacattctatgctgagatctgagggcgtagagcatgttgtgggtggtagagaaggaggaatctgcttcttgggttacatatgtcctaaactagttattaagcctttagttgccagcaaattggaacaataatagtaataatctctgctctttgttgactatatattctgttttatttcctttacgtgcattatctcatttaagcctcaccatgggctatctccctttatatagattagaaaactgaggctcagatagatcgaataaagttttcaaagtcactccacagtagatgtcaaggccagggatcaaaccaagacctgtctcacagctcagcctctactttcaagagcacactttataacatctctaaacaaatgaatcacggcatggcgatcaagggacagcttaattgtcagaggtctgctcctattactaggaagaaaagttgaaaatacatggccctaggagaaaaaaaagtaagctaacatcatatttaacagctaccccaaaatggcaggaataaaaagcaatttaaggcaagaatgcttatggctttggaagttttgagacattttttaaccacaccagtatttgaggctgaatgagaggatgagacagtgcatggacacgctacagcttgtttcacctttggtgactctgcacctgggaatgaagttcaccaggcatctgtggtagaggctggggagacatcctgacttggctgcttgaataaacttggaataggtcatgattatgtagcaattgggagggcgtaagaggggcattgtctgaagtggtctctccctcagctaactccttggtgtagcactcgtgtcactgaacagataaacactgccttccattcaattgtttcatgtctatctgttttattagctgtccctatggttctcaaagttggtgaagtacaacaatcatgggggatacttattaaaagaataggtattggctctcctgagaaattttttatacaatcgtcctgagaaaaggttcagacgcctgtgtttttatgaagctttcctgtgattcttggaatgaaccaaatgtgggatttgttgctctttaaaactataagtccatgagggcactttgtttcctagcagctcacagagtgcttcacagggagagaaattcagtagatacttgttgactgaaggagggaataaatggctattgtagcttccctgaggtcaaccatgatgaaacttacctcccacagtggcagtaaatagtgatcaataactgtttactgatttattagttttaaacctatgttttattttttcttttcgcttagctctgagcaaatggctatgaattcccttgaagttttgtgttctaaaagacctgatgcctatttaatgaggtgaggtggtgggcatagcatccaggaactggttttgagtagtttcaggagtttatttatccaaagtctgagaagaaaaccagttcccatattttgcaagttcattttgctctagtacagtgaataattgtcctggggggactagatggcataggagaatattaatcttagattttcatttcctataaaataatttcccacttattacattcagtgagaatactttgggtttcaggaaatacgcatattttatcacagacagtccaaagtgtgctcccaaatgtatctgaaactcaggagttaagagggacaggtgcagaaatttaggtaagccaccggatgccacggtaggctgtgagaggactgaaggtagaggcaggacagagtcacctagtgtctccacaccttgcacagtgttgtcaaattttaggcttgagctttaaaagaaatttgtaaaaggaaaatattaaaaattaaatgacaacaataataattaatgacaagcatttttcaatctcctcactatgtataaggcaatatactaagccctttcacatatcatgtcatataactgattttttggagagcccaatgaggtagtatagtgtattatagatgagagcatctcaactaaggtcacatttaagaaaaaaaaagatttttactcttggaacagcagagaagtccagaatagcttcagacatgttagatttcagggactcaagtaatatcacagtacccttctctcccgtgttaccttctcttccctattgcctttcactacgtggtaatgaagatggcccccagcaactccaatttaatgttctctgaagatcaagtccaatggaaaagaagattcttttcctacagagtcagggaaatccacaatatcatgcttacttgtgacatcaactgcgaagttttggggtccctaagatcactctcattttttataattcaccaaaatggctcgcagatctcactgaaagcttacacttgcagttatggtttcttagggtgaaagaatacatattaaaatgagtcaatagaagatactcatggaacagagttcaggaaagttcccaaaacaaagttcccagttgtcctctcccagtgtaatcatggacagggctaacttttctgagtaacagtgtgtgacagtacacacagagcactgccaaccgtggtatctttcctgagtcttcaagtccagaattttaactgggggctcagtcacaaagacataattgactacccttgtggctgaccattagtctctagtccctctagaggtcaagctaatactgcatggtccaaagcccccatcataaatcatattattcgactgcacagtttggcccaaagcccctaggttaaaaaaaaaaaaaaaaaaaaaaaaaaaaaaaagaagaagaagaagtttttgtcagtcgggatattccaagggttttgctgtcacctcccagtagctgagggcaaaagacttttttggggggtaaggttaattctttactacacacttccccagtgttctaataaaagcctggcctccattgtgttcatggacccatccctaaagcaattgctctgacacagagatgaacatgctaataggctaagcctaaggatggggccattcaccttgcccactacatagcacgagatcaagtaggggtgattctccaagaaaactggacattgaccaagatatttcaggagtaaataaaatgagaagacactagtctatgttaactcatgggaaggctatgtagcaaaactaaaatactaaattccctttattttgatttgatgtgctatcattagcaagtccacaggaaaatgaactaaaagtgacttaataaatgcattttttttaaaaaaaaaaaaaaagagacagaacctcttaaaatatgacatgtgtgacttagggaagaggcagaataatagcaagttgatgaagaggctctatatgtgatcacttatgcaaatttcccaccaagaatgaatttgtctttttccgcagggcaacatgaaaactccctagagcagtggtttctaaatttgtagtgcattagaaatacctggggaacttttaaaatcctgatgcccaggtcacacccgtaccagtgaaatcagaatgtgtaggaatgggatccaggcaactgtgttttttaaagattcccagaagatttggaaactactgtagtagatactgaaacaacagcaaacactactaatctgaatgctaatttccaatatgaccaaccttacctaattaaatggacaccattcaatcactggcagaagaactcctcttgagtctcagcaggatgtagtatagaatctgagttggagaaatatgtgttcaaaccacggcttttaccatttactttttcattacacttacgttactagttgggcctcgaggaagcaacttaatcactttaaggttcagtttcctcatctgtgaaacaactgataatttatatgacatggaacttcttttttgtttgtctgtttgtttgtttgaggtagagtctcactctgtcacccaggctggagtgcagtggcacagtcttggcccactgaactctctgcctcctggattcaagcgattttcctgcctcagcctttcaagtagctgggattacaggcatgcaccaccacctccggctaatttttatatttttagtagagacggggttttgccatgttggccaggctggtctcaaactcctgacctcaggtgatcagcctacctcagtctcccaaaatgctagaattacaggcgtaagccaccttgccatgcctggaacttctgaaagaaaatacacagaaagtacctggcatagcaaatgtcaacttcattacttatactattacctttattgtaagagagatagaaaccccttgtctttttttcctgtctttcagcctttgttattttgggttgttttgttttgtttttaatatatccatgtaggattttaaaaagtgtatctttgtcaataatgcaaaacttataacttgtctttgtcattaaatacatttgttcccttaaatattgagaacttcaggaggaggtgtcctattcattcagtcatttatccacacaatatttgtaaagtgtctatgacaatatttcgtcaatactaaaatgcactcatttgcaagatgtatcattgttttatgtatgaataagagagggaaaaactcagccaattaaactgtgccgcaccctcagttacaaaagggattcttatttcagaagtcttaagttgaacaaagaaatgtataagataacatcagtgaaatgcagtcagtgtggaattaatcctccaggatgctaggcataagacacaaagttacacaagacgctgtctcagtgatgggggacagaaaagaaccaagatccacagttggcttcaaccctcttgctcccgagaagagagtcaactccagtttcatccagagaaaattctttttcatgccccttttacatcattaaatgtcatacactgatcactgtttcacctttgagaaatacagtgacctgtttaaatggtcccatttttgaatcacttttcttcaaacagggccagttttaaatggctgtatgtcatcccacccatggatgagagtgaaaatggctctcattatttcagcagatcacataagccatgctgcaggagagcaggaggtgagaaggtagagggaattcaatttgatgatcacatgatctttcttcccctgaacctccccattcaactgaagattttgtgttgtgatcccaaatgggtcaaaatacaagcttggaaaagttttctgaatagtctttctctattctatatatacttaatacagatatgccccatttctctttccttacattgaagcctgcttggccagaaatgtgcttgtgttggctaattttttttaagtagttggcaaaatatgtccttgagtggaggcaaagtgttaggggaagattttggggacaggtgtaccatcaatgattctgaatcagcccattgaaatgcgatctttatatgtagtttggggaattaaattttggtgatagaaaaacagaattccaaaaagagaaagagaaactaaaaataataggctcttcaaatccaaatgagaattctactaacagcatcttggtgcgccatgccaggtccttgctccagtcaatagagattttcttttgaaggtaagcaatttagagaatgaatttgctctgccgtctggttggaggatgggtgccaaggttagatctttaaggaaataatcttattagtccctcttattaaggaagcctctgcagtgagtagactttgaacctgcctgataaaaagtaggtcttgtcaaacagctcacagctcctagtgaaaaggttgaactttgttggtttagatcatccaatccaaatgcaaacatgtttctaagcttctgtttgcatactctgggagaaaaagaagacttcctttttttccttgactctgacactaatagtattctgaggcgatggcagctcccatggaaattactaaatcacggtgttagtggcgcatacagaaaggcagaagtttccagtgtaacttgaaatgtaaagcttccaattgtcactgtttgggtccttttatttctttaaatcttcattttttccccttaacggaacttggtctccccatttcgccaccattacatgtccatactaaccccatctggaagctgtaaggctgaaattttgacagctttgtcattttcatagctgtgaaggttgatgttgagcttacaggattattgctctccaggaatacttcactacataatcaagcggaaggtcaagagaggtggagagagaggaaaaaaaaaaagaaaactctaattaaatcaggaagggctgacttgtgccctaagaaatgtgtgcaacttcagggagagccatgcttgtatccaagtgcaacaattggccccagtcagaggccacacttgtcacaatggacaacaaagaaattgccattaaagcaagcagctccttgaagaactggcttcactctttgctttcaccctgctattaaggcccttctcaaatcagattaaggaaaggcactgtaacacatagtttcattagagtaatggaaagaggagagcaagctcttttcttacgtcttctcctttggttcctgagatttgtggcttctggatatcaccctggtacataatgcaaccagacaatagtggccacacagaatgaaagacacgtctgagacttatgctactgagaacagaattgagaagaatcttactccaaatttttgcatgatatatcgctgcaaggaggaagtagacactgtgtagaatccccagagtgtagaattctcaggtaggatttgcacaaactgtgcattttagttcagcaaatcctacctgaaacctactgatacagtttggatatgtgtcccctctaaatctcatgttaaattgcaatcttcattgttggaggtggggtcagatgggaggtgtttggtttatggggatggatccctcatggcttggtgctgtccttgcaatagtgagttctcatgagatctggttgtttaagtgtgtggcatgcacactccctccactctctctcttgctcctgaccccaccatgtgaggtgcaagcttctgcttcaccttctgccataagtaaaagctccctgaggcctccccagaagccaagcagaggcaggtgccacgcttcttgtacagcctgcagaacgatctgccacttaaacctctttttttaataaattacccagtctcaggaatttctttatggaaatgcaagaatgacctaatacacctactgtgtgccaaatatttgtcaagatgttaatggttcaaataagtcatggatagagttctgtgtttaacccatttatgctggaggttgcagtttttttgtgtgaaaaatcagacctcagcgatgaccttgagcagcaggatatgaatagctcccaccagcttggcgttccagtaatggaatactaggcatatatgggttaataggggtttaagagagatgagcaaatactacatatataaggtaggataatcacaactgtaaaaattattgagcagctactatgtgcagctcactggtttaagtgctttgcagagaacaaattatttaatataaaggtcagactattatgcctagagcacatacacaaggacgtcatttcagctggggaaggtagaggacatggaaagttccctgcaaaagggatttaaatgcatcttgaaggatggataagaattatacccaatgtttaaaaaataagggagtggaagataaaacctttctaaatttagtaaacttcataaataaagacttaaagtgctacataagatgagatcatccaataaaatgtagtattcctgcagcacaaagtaaaaggcaggtgatagagaaggggctgaagatgatggaatgtaatgaaggctttgtctggagccgagggagaatttttaagtagggctgaggttcagatttccattttggaaagatcatcctagggcattgcttctgtccctgctgaagtgataattgtgcaagtttgcctcgtagacctggcttgaagacaatccactctctgagtgcaggcactgcccttggagggggcatctgtgtagaaccctcaggatcaggcatcccagcattttatttgttgacttaaatgggaagaatgaagctttttatttctttaatttattggtgaatgctgctcgtggacatttaatgcttctgtatcaaatcaaatgtaccaggatttcttagagttgcattctttaagcgccagcctgagtgtgtatcctgctgatatccttttatgtctatggaaaagaccctccctggacagttggctgcagcagacagtaactccttcttctccaggcttgcgcctgaggatatttgtgtcttatactcacaagccaaggagaaccatctttctgagcaatgcctatctttgatggccaggtgatatgaccaagggacaaagcaaatgagaaaggcagtgagagtggagagggacagaagagaagcaataatatgttgtgaaccacagtcagggacccgatgccacacagactggtgaccgcatccctggtattcattccactgagacttagcactgcaaaaaaggcaggctacagggcataagaaatatgaaataatttatcaggccagaaagttatactcatttcctttctaactattttgctgcaggttaaacattccttcgtgcttctgtagggcagctgctggaaatacaaaggtttgtatccagcactggaaagtacccgactttcctggccacctttgctgggggtggaagctctgtttcttcatgagcagtggctgggcctctgcattctgagggagatgtgtgcatcccagttagtagagatgggatgaggttgtaagattgtatgagtctccaaaatgtttccagcagtgaaataaagaagtgaagccaatccagatgaatgatttgggaggctttcagaggaaggggaaatattacgtgtctgcccagggttctggaaaagggtccttttgctgaagagcttacaagttctgcacacacacacacacacacacacacacacacagtggaactaaggtcagcactggaaaccactgagctatggcagaaagagtgttgcagtgttggaggagcagggagatgcatgtctgttgaaaacttggggtttgcttctgggcttgcaactgtggcagcattttttttcctctctctattccgcataccatgccatgatacaaagcaaacattgcattgacagtatgttgacaaattgaagccttcaaccactggcccagtcagcagcctgagcaatcacagttccaacctccccctccctctcactgcatcccctactccccagatttcttgggaacaggctatgcccccagttgatcatttcagttgtgtagccttcgtaagtcctaaccacaaatcagctttctaaattgagaaggtgatgaatttttaaatccttgaacctgtgctataatcatctttccaccatcctacatattacaatgcaggaaggcaacagatgtgttttcttatggctctggtaacatgaaatattgatagggacgggagcatgggcatcgtgttgaggttcatctacaatgaaggtagcagttctcatcccagcttctcatcgtccacctttcttttctgacacttaggacgtgaagaaagccccatacctgtgatgctcaaggctagttcaatgaaagctcttaaaaagccgtgcaatgaaatctgtctaaaaaggtctttgtcagtctccaggggccaattgctaatgcagctaatacacgtttgatctatacagatgatttttcctttgtcctcaagggaatctctacaaacactttgggtttacatggtgccaagcccaagtcgtctgtcggaaaataaatagcattttaacacattcaagcatcagtccccaggatgaaaagtagcacgtaggctcttctctgagttttctagctgggctataggacataatgaaaacctcatttttagaacatttcttttcctggtgacgtttcactcagaggcactgcattctgaagggggaaaggcacaaagtagacactccgattcaaaaaaaaaaaaaaaagaaaaagaaaagaaaaagaaagaaaagcaataagcaaaaaaggataaaattttatctaggacagtatttccaaatgcatatatgggtgccatgtaccaatctgtgtggtgtaagtatgcaagatatccttaagaggcacatggttgaagtattttatttaaaaaaaaaagttttaatatttatttattgtaatatattttaggaaatatatattacatacatatatatagatatctatataaatgtagttatgtacagctagcacatccaagctgtgattttatggatattattaactaagatgaaacgaaagtcagaaacaataagtcaagttgcagaaaaaaagtaaaggaaagaattgaagactagatgaaactgcagctccagcagctccaatcaggaagggttggctagaacaaatacccagaatgtgtgaggaaacggctaatgtgggaaatgccgatggagagaaattcctcatgtgttaatagaggaggcagagccagctctgccttggtcagtggggatgagtgtgaatctacttttcctggaatgtctgtctccctacagagacgtcaaccacagcagaattcctgtggctctgacacacagttctctgttgtgtgaagttttgttttctttgtggttttaagcagaaaatcacacatgttcatgctgcctcaatctgacatgtcgtattaacccttttcatgtgactttcataaggcaggatattgcaggccattcaggagatgtgcctttcagagaaggattcacctcaaaagagtggacgctgcactggacttaagtgaaaggggagagtttgtaacgatcccataatatatctgagcccatgggagaaagatgatagcagctcctagctaccaagtcttcagtatcttccaggcatgacatattaaatctaacccccagatgagctaagtgaaccaagcaccattattctcatcattgtatcgttgtatttatggggaggctaaaatgggagacttacacagctaggaagagattcaaatacaattgtgtctgaccaagaggttggatttcttcacaagttacaataagaggccatgctttggctgtgaacacttctggggaatggcttctcctatagttttggttctatccacaacagaacctatgtaaatcctacaaagccttccttagaataatgcccacagtgactgtcctccctagcaataggacatcacagaacaagaaaacattgactgtgatcttttttcttggaaaagggtgggagagtcagggggatggttcatgtgggagaatgagagggaaaataaaataatggatccatatagatgagagggatgctaatgtatacactgggattctcttcccaggtccatagtgagcccctacatgacactgagaagatctcttctttcccctgacctttttttgttccctccatagtatgaggggtttgacctaaaggatcacttaagtcccattatgatcctttgtgtgtgtgtgtgtgtgtgtgtgtgtgtgtgtgtgtgtttctcctctgatgtagaataactcagaaagagagagttgccctggagagtggttgctaaaacaacagggaaacaatagagaaaccttaccttcactggtgactcagtcaagaaaaaacaatagagccacattatcaatcatgaaggatcccaagaagtatgcagaagacacctgtttccggaacagaagggaggggaaggtgtggggaacatggagccacattctactcccttcctgtattccctttgatctctctacctgcttctttcttggccaaccacaacttagaatcaaccaagtttttgaattagcttgtatagacaagaaacatgctatgagccctccttctaaagaccttacctttaacttcaggaaacaagatgactgctttctcttgcttcatttacaaaagttattcagatgaggattatacagtttctgaatcttctctgccactttaattttctaagccaccaatttaaagatagccttaaacaactgttctgcccctgtggaaacaggaagtggatgcctcaggcagttcctcgggttgctgtgttggaaggagtgatagtttctcaattctgccgccagtgagacacaacttcacctcagcagtgtgtatttagagacattcatcattagaaattgagtgagaacttccatatggaaaaaaaaatcctagaatttaaagaccaccacaagtgcctacgtattatttagagacaaagaaagacctgtgttttataacaagcattcttaaccccacacattgtaaaagtacaaatggcccagcaaagtcagaatgacccgggtgaagtacaccttgtaaggcaagaaatgttcaacttattgctggctctaccattagtatgtaccatggaagtacatactaaataagggaaaaataagagaaatgctaacttaatgaagcacaatcatgactcgtattagaaagtgattagctgagatctgtgcagtgaataaaacagggccttgttacaacttgatttggttgatgtgtttcagaaggactcgtaattcatgttccaactggagaaatagcttcagcgaatgatgcaacatatcatatttttgttcaggtgttttgacaggaagcaaacgatagagttgtttggaactctaattgagaaaaggatcttaatgatgttcactcagtccagcatcaggatatagtgtgctgatatttcttagaggagaaaatgttgtagaatctgcttcttctgaagacttataattttgataagcctttgtttatgtaagcaagaagtgtgattagtacttcaaataactgcatgttcaagatatcttttatttgtttatacagaaaagggtgcaattatctatttaactatatcattagagaaaaatatatggaaaaaacttctgtattcttcaaagatattaataacttatatgtgtgatgccatcttatgaaaagacagcctttataaaatatgaagagtttgaagtattgcttttcttactcaaaagatttagaagtggccatcaaaaccattagatagttagatggcttaacaaactgtgaaaagtagaaccttttctctacaaagtaggaccttaaaatcaaaatttaaagcaatcactatctgaaaaaaaaatatgttcagtaaaaagttaaatatgggtcatgtaagctcagtattaacgtagagaggctggattgaactgaaaccaatttgtcggatagtgagatgaaacgctggctatgagttccactggttttaccttcagccttgtgggggaatggtggggacatttgataggaagtcagtcttgtgtgttccagcccagctctgctgggggcatgaatttgagcaaagtcccttcatttgtcctgtcacctttgccctccttcaggaaatgccagttttgcattagattggaagttctcagcctctcttccctgtaacttgggagacgggatgtatagataagaaggatgaagattctagagggtgcggctcatggtcactttcttccccccatctcctaaacagcagccctgttttgggtatcaaaaatctgaaatagtgttactttacagttaaatcaacagaaaggtgttcagttgatgttgaaaactatggaatctcctttttaaaaaggtaactttcatgatcctcctcttaatgttctcagtttttatactcttgtttagtttttattgacatctctgtcatggggcagctcatctagacaagtttattgaaggcaaatgacagtgatgactacggtgctttgcacacagattgtcaataacaatctggttgtttggggagcacttagagatgtggttcatgcatgtgtgaacctcgtcagtgtaagttttgtgccatttaactgataacattttgaaaatttataatagctgagggttgttataagctcataagatgctaagcacagagctaactaagtactttacatttcttactgaatcctcgaaaataatatgatctcattacccatagtttccagatgaggaaactgagtctcaaggaggatgaacaactttcccaaggccacggggtcagcatatgactggcagacccttaggccttcccacatcacagcactcagggcagtgagggtgtcccaagggatctttgctgagacttttagcctgaggtcagcttctgagttgattatgacttagttattggaaaaagatataattttcttcaataatctgcatcccaaggaacagtctctgttctcatcgctccagttagttgcttttaaaccctattcaaaaaattacaacgcgggttgaattccttagtggggaggatgagaggaaccgcttcaagctgagagcacagttgtttccagatgtggccagggcctccttaaaggttagtgggctggataacccagcattctgggcctagggaaccaacacactcacgtgacatcatcccacagggcaatctgtatcctttactttttgccattcatccagtttttgggtagctgggttgtatcattgtgtggtgtgtgactgtgtgtgtgtgtgtgtgtgtgtgtgcgtgcgcgttctctaatgctactcttcattcatttattgctgagggaagtcctgcttcttcctgcactgaagcccaattcccattgcttttctaatgtgtgcactggagagtgggacttcccctgtccgggctcttttctactgacctgcactgtgttctctatccattgcttccatctcagacagcgcttttcctcccaagatatctaagttgggttggacaaagtcattggaagtgacagtcacttaaaaaagaaaaagaaaggaaactggcaaaacacagggatgcatgttcaggagaagctgttgagagaagcaggtggctcttgcctccttgtgttcttggatgagacaattgactttccccaagctgacttcttgcttagatgaactgacttaactgtgaggtcctgccaaaggttgtttcactaagcggtgcctggggctttcacaaagtgaagtcacctctgcctgccaagcagggactctctagctagacactgggggaatttcatagccttctgattactcctccaaaagaggaagttcctgtcatcatcttacctttaccgtgccagggtgcagttcattctgcctgtggctaacatgcccagctcataatgtgctgttgagctatagagaagggaaatggcggactgcaacttggagaactgttcattttgctgaagaggagacttgaggacagaatcattgctctacttggctaaatctgtggtcttcctgtctagggctgtggcttcaatggggcaccaaggagcatttgtggagtgagcgtgattgctctccatccagctaggaaggttagtcatgtcaccaaatattccttacttcccttaacagcccattctaaatcaatcttccatgaattcatcaaaatgttttttgtattgcctcaactttgctgcttccatgtcaatttcctaaacccagggaggtcacgtgaagggcatttcccaaactgttatctgaaccttcctccctggagtgtcttctgctcactccagggaaagagtccttttccctgggctcatttgctgtggtggccatattttaattccctcttggcttctaatagatgagttgggacacgcctcaaagtgtttttgttccctctgaaagaggttgaatcagggaagagagggggagaaatatatgtgggaacagtttaattgtatccatgaggattcttagtaatcaggatgccagtgtgtgttttccagagcctagagctgacataaataatgtagcgtacctcgctttgtgcaggcttgctgaggaatgctgatggagaaaaagccaaactgggatctgaagctcccggctcccggcacagcctttgaaatccttttattgagtggtacttttgaaactgcagccaggaccttggcaggttggatgtgccagggagaagccaacagaggaggaactccagaggaaggtgcctcacttggcttttggagaatgagaatctggtgtggcctggatggctccggctaagattggttaatttcattttgcgttcctaatcccacaaggaataggatatctccgtcaaggccctgagagccgggtaagtgtatgcagctgttgctaacaagatatgactggcccctcaaacatagtgaaaagcatcttgctagccttttagagcctcttgccttaatgggaagagccaaatgagctttgcgggacaactaaccccaaatgaagtcctgcagcttaagctcatttaaaggcaaagtgtgcattgggagagggagagggaccacaaacgccacagttcttttgcaggaaggaaacaatgtgtcttcacgtgggattttcacaggaggtctgccaagccaaatatccaactgaaacatcttccagattttgatttacagtgcaacttaagcctagtcttggccataaatgatagaagtgaaggaaaaggtggggagtggggtaaggaataattctctattgtagaggatcttcagggacaggctctgggcatttagtgaaagggacagcgattcctttgcctatactctggtggtttagaaaaggacctcagggaacatttgttttgttttgttttgttttccttttgattaaggcatttggggtctagaaaagaagattcaagcaggatccatttaatttatttagtttgcctcacagacatgaagcttcagaatggtaagtgtcaattacattcctaccgatttgggtaaactagctgggagagggttctcgcagagcaaggatctgttcaaatctgggctgttttacagtttttggccagtgataggagctgctgtgtaaacacagaaaaagcatagatgacaagtttgattgggaaggaaggctttgtgtgacttgtccttttgggggatggttctctgttgttgttggtttgacaattatgggatgtcctttagaaaccatctatatagcacactaaaatttacttgacaaatgtaaacatgatccgatagttccatcgtgggaaaagagtatatattttcctcttatttggctacagatttgttgttttcttctttctccatttaaaatatggagtgttttataacatagtttttggaaattttttttgttatgtgatgtattgctataaatgtattattactaagaactctacaagtcccttttgatgatttcattgaactggtaaggaaaggagtacgttcttgtctgagtttcattccatcctctctcattagggtctgtgctttgcttatctactgctttaagtggtttcaccagaactttcattcagtagtctcaaaagccccgcgtacttctctctgcttggacaaatgccttcccaaattagtgctgtggttttgtcttgtgaaggaaaagttttatcttcatggataaaggcgaaacagggtttttgtttgtttgttttttcattttgttttgttttgttttgttttgttttattggggcaggcaagatttagtctttagtctgaggaatctgtttggacacttttccagcaaaccttccactctttgggaaagagcatgcccatctgtgaaatgggcttgggatttgattaaaaatgtaacacccacgccctctcggtcacattgtgaatgtttgaaaggaaaaaaaaatgattatagagggttagctgaggggttgtcaataagctggtctccgtaggactgagtttaaacctgttttaaacatgcaaaaactgggtcgcttgttagtttctatttataagtgcgttagaagaaagtacatcttaagtgcagggaaatgcaatacttctattaaacaaaacttagtttttataacctaagaagtgacctgaaggaatgtgaggaattgttagaagcctgtggttcttgggcgcagagtcacagcttcatgtttaatttaacaaaacattaaacatttcatgtttaatttaatgaaacattagagcactaggatttgtcaccttcatgacagaatgtcagaactgtgggatagtttcagaatatatgttctttctacagaattcacatgtcacactggagatgtttcacatgcaaaggcctttacttttttccaggggtcttttttttcctctctaataaaagaaggagaagcaaagaagcaagtagaacaacaaaaacaacaacacattaggcatgcactactagtctagctaattgtaggggggctattagcaggcatttaggcaaatcgattaacatttagcatcagtaccaatgcaattgcatttctactttttgtgcttctgacaaaataagcacacagatcttcaggacaagaaaagaacggacgttggaaccatttgttaggtgataaacgttttattaaacccatttggattttttaatgaactatttgagaaagtggggtgagatctttggaaaaaaataggtaaatgtatccgtttgataaaggttgttaccagtgtgagagaggcaaccctttgtactgcatcgcttgccagatttttttcttagtctggaaaatgtggtcggagattgatagtgctagtttgcctttggcctgtgatgggaaatttcccttttttttgtatttcaaagtgctgaaatagagatatgccctacctctctgtccatattttgcagattggtggagctctattttcatcagatgcttagaatgcttagctcttttccatgaaaaacaaaaattgatgtttgggcagtgaaggtaattaccgatccataaagcatgcatgtgtgtgtgcatatatgtaattatacatgtgtacccacccacacactcacacacacgcacacacagacacacacaatgtacaagtctacaaacccttcccctcacccccctgccaccaaattctccttctattcatttgaattgcctcctgcaccatttctggaatgctgtataaaacacaatggagatttatgcaagggcagtattttcttttgtgatgacaggagtgcgaatggctctcctgttattatatactcagcctgaatgtgctgcttccttgggtaccttgaagtggctgagaccagatgcttcagagagaaatgtcatattcatgcaattcagaggagcatatggcaagagaaaaatcgttgtgacagttgctgacctgtggagcaagtcacttttttaacccttaaaaaatagttttaaccctatcctaaatagccacagatacattatttagttgaagaattttctaattctcctgtatgttgcattctggaaaaagcctgcaatgggggctggggaagtagagaagctgccctggccatggtaggttggacggcctctcctactcacaccctactctcagggctacatccacacttctctcagcctctgggtccaaaggctgaaattcagaacggtgtgacccaccttacctaattcaggtttgtgatggctcccctgccttctccccggggaactgaggaggacccagcaaagctcagccctgcgtactgtcctggaggccagaggcatcgcctgctgcctttgtcgtccttcatgaccaccatcctaacccacagatagcacagaggtagcagaagttgccaaggaggtcccttcacttcataaggcctcttttaatccctgcctatgtgcctgacactctgacagaccccgggaaggaaagcaagtgtgatatgcctcaccctgccaccaccaccaaggatctcctagtgtcatgtagaagatctgtgaacaaaaatggaacaaagcattgtcttcagtgccatgagggctgagagaggaaagccttgtatggccacaggtattatgtgggtgcaggggagagagctggcaaccctcagagctcagagaggtcagaacaagcttcatagatgcagtttttttaagagaactggcctggcagattctcctggaagccaaggggcaggggtctccacacccagaacatggcagatgcttagcaaatcaaggaacttcaagtactgagttcagtaaagctggcacccaaggcatgaggaaggcaaaagattgtactagaaagataagcagagccctgtggtgaatggctttccatatcatcaagtctaagtcttctctaatctgccacatcctcataaatctgagacagacagccagctcatagccgtaaggaaagtgagggttgagcatatcaaaacaacagtatggtttatgtgaacacacctaagttttacaatgtccacaactaattcaacgtttcaaaaaatgctggctacccctgtgtgagccaaactaacgccatgtgcatgtttcagatggagtctgggggctaccagtttgcaacctctgcaaatagtcaacaggcgcctgcaaagggaactcaccctaccactaacttgcttcttatctgaaaagattttggagaagagctttgacaaatacagaaagagtgtgtttggagacaaattttcaagcgtccccacttggaaatctggttgggagggaggcaaatatatatgttcatattcctatctggatttatatttttacatatttgtgtaatggtgggtgtgttctgcttccttcgtatagtcaaagcttctggaggtggaatccaaaaggaaggtcaaaattctgactctgtagatagacacataatccagcagatcacagctaatgagtacctctttgcatagtgcgtgtagtacatgggtttctgcaggggggtggggttcttggtggggtttttttatgttttaatttcctcatcagccatttaactttatgccatatggtgatggcagagctgtccccacttctgtgagaagaccctagtggttccatgaacatcttttgagaaagcagacccactgagcgtttgcttagaagagcagaagggaggctggggaggatgcagtagccatctccttttcatcttcatctcctagaccttaactcatctgctaccatttgactggcattgtcatctagctcctctggcgtgcacacacacatgcataggcagtgtcagtctgttggcagcacctcccaggacagacttgcgatcccacgggctctgcagtcccaaattgctagggctctcttttgagttaagtgtcaggctggccatggaaacctgggattgggccctggctgccttagtggctttgagtaagagggccgggcatttaatatttgttgaagtgactgagctctcagtgcgctcatttatctgtctgaatagtggatagtaatacttctcagctccatggagataatggtaatgataattaaaaaaaaaaaaaaacaactgtgacccaggtatcagctcaaacccatctccacagaccattcccacattctgggtgttccctgagctcctgtgctcaagctcatgtttgttcatttttcagcacttactccttcccgcagcccaacacgtcgtgtacctgtacctttctctccaccccaagctgctccagttgtagaatttggcctcttacccctagcatgtgcaaaaaaacaaacaaactagcaaacaaaatctcaggcagacaaaatcatccacccaaaaccttgtgtggaacagactttactgaaagtttggagaaaatgaagaattgagagtttcatatgccagcaataaaaagaagtttaaatagaatattcaacacctctcttcttcaagagtgcttgggtcagttctgactaactggggctccagctccctgccaggttccctgctgcatttctatttcttccgattggccagaaattcaaatggatttcactatatttttgcagagcagctcagcactctccacctgcacccaaaaagccagcactttcttccttcttcatagaccccttgatagactctgcaaaaggaaaactatagcatagagatttatttccccaaagatgttaatagcaccatttcctgtcactaaccttcaagccaagaaaggaaaagttgttacatttttgttttcaaaaacactttttctgacacataatactttactatgtatttccttacatttttaatatccttcccacctgattgattaattaattgattgattaagggatcaattaaaaaggcagtgtggccaaaggttaagagcacagactcaggagctctgctgcttactagtgactctgagcaagttacttaagttctctgagctttggtaaaggcggatagtcaaggtacctccctgatatcccagccatgtggttaaatgagatcatgcacattgaggtgctgatttcagaacctggcacgtgcaatggttatttcctttgtctacagtcaatggcagcatttcattttcatccaaattttataatagaatgttttctctatttccaaaatgatttcaggttaaatgggtagtgtgctgggattctggcacaagccagattgcaccttgccccaccaagtagaaactgactgtatccatcctccatcctcaagacagaagccagatggcctcctgtcctcccctaagtagtcttcagtttcatgtatgtttctctgtagtggccttcccactgctgctgttttaaccagataacgaaaaaatccaaggtggttcggaataaccggcattggctgaacttttttccaaccaatgttactagaaacataattgctcagaattaacactctcatcttcagtggaacagaatgcaattgtttgctcttggtttgagtcctcagagtggggctggtagggggcaaggaacaattattgcaactaaattttaatcaacagtttcagtaacaatattgaattaaaaaggtactagctactagttagagcatggcttaacttgtacacaggcaaatcagtcattctgtggtgattaacatctattcagaacagagaatgtattctgggtactaaattaccataggaattaatgcagtatttttaaagggcttaaaatatgttaataaatacagtattgtagcacctgcagctgaaggaaccaaagtcattaaagatggatataattatatttattatggcaaggagctaggtgggcgggggggggggaacagtttaatgagcgtgaatgaaatagaggttctttatttaaaacttcttacctgaggaaactgttccctttgaggagttgagttattgcctgaaatcactgaatgaaagaactatacaaaaagttaatcagggataattttccaacctctggacaatgaacttcagaggtctactggggtcatagcaaaactctccacctttttccctttgaacttaccatggaatccctcttcccctgctgtgccctgtaggatccctgtgatgtctgccactttaccaacttcagtttccactgccttcccacacctgccccacccaaatgccacacccaccttgcagttgctcaaacaatcccttatccaacctcagggcctcagcacatacttttgcctctacatgacatttattttgcaaccacttcaatagcacttggccaggctttgtcctagacaaatgttaaatactatctaatttaatcctcaggaaagccttacagattagatcccattatcatcaccgttttacagatgaggaaaagaagtcagtgaagggctaaggggcttgccataggtcctgctgacttgaagttctcttcaccaccaaagttctgctgcatctttgtaggaccggctactctcatccctcagatctcagctccgatgctgtccctgacccctttatctaaactctcctttcccccaaccccatccccagttgctctgtttcaggatccagtttgttctttgcagcacctgtcacaccattttaagcgatagtctgcatgtgtatttttagttataattttccttctcttgcactaggatcatgcccataaaggcagcaactgtttttgtttgatgctgcgtcctcagccctgttgaagtaactgacacttaatatatcctgaataaatatttgtttaatgagtccttgaactcatgtgttcactatttgctgtctgtagccaataataaatgatattcttaatctatttacctacatagacagatagacgaaaaaatatatttatttttcaaattatctgatgactaaaatataattttattaggaagggtaatcctctttaggaattaaaaattttcttagctgattgatataaaaatggcagtctaaaataaccatttctataagaaatctgggcccttttacatagaaggttgggaattgatgattaaagataacttctatttgacaaataagaaataggagaacatgagaggaagaaccacaggctcaaggtgtggagctggttaagacagggttctctggctcttggtttcacattgtttctgcccatctgccttgcctcttgtcgcctatgttgatagcatctggagaagcccatcagaaacagaggagctttttccggactggctcttgctgctactgagagtgttgtgcttggcaggtcaggagcagtggattgaagctctcttattttcttaaatcttgggggtgttcaaggtgaaaattaactgtctgcctatcctcgtggtgaaatgcatttgaaatgctatttcctcttatgaagaagaagaaaagtaaacaaacacacatcgtgtggaattaaaaatggaggtcccagagctgcatatcacacctacagtgagacaccagccttaaagaaactgcctcatgttcctggcttgccagcttgttgaggatacagtctggctactaaaacccctagcaccacaatcctttacaatataggagacatgaaccacacactgagcatctgattaaagttgggggttctatgcccagagaaaaacaacatgtgtaaacatgaagcaatttgcacattgtttcagggaacccacagacattcttttgtcaatttcgtggatctctagaggcccatgaattccagtttaagaagccctggtagcatagaacacctagtaatgttaattataataggtaatatttattaggcaattataatgtggcagatatctgacatatatataataattatacatttttttcatttagctttcagatgtaacatttgtttccattatgcagatgagaaaactgaggcacagaaaagctaaataagccagaaagtgttggagcctggattagaatccagttggtctgatactagaacctctgacaaaggcaggcacagaaagtttacctaaagcagactttcattagctggcatgtgacaccatgaggaatcccatggtgggaaagagaggctatgcagaacaccttcagagcgtcagtgaaggccacaaagggctgatgaatccatattgcaggtccttcagctcctcatggagaggcaatcaagatggtcccaggatacctcctcttgccaagaattgccttctatcctcctacatattgggggactggaaaaatgcatttccatgtgacttcacatccttaatccactaggctggagctaagagttcttggcattttattgagccaagtattcagaatactttcaatttaagaatgtctatcatcagatgggcagatgggtgctatctgactgtgaaactctctcaggaatatttagaatggactggattgtcagcctattttatgagaggctattagagtgagatgtgtttaattatttctttcatttcttaagagtatacatagtatcctttagaagttgcttgataatgtttttttatcattttttctgctttcttttttaaagagagcaggctcatttttacttaggaatgggtataatctaacaagttagaactaataactaatgaagttaaatacctctctggatgtttcttttctattgattgagctatatttagtatcttgtaattaatatcctaagcacctgcttggttctaggcccctggcataatgaagtgaatcagagacagcctgtggcctcaaggagtttacagtctagtaggagagcaggacgtggaaacaaatcaatgttgtgtactatagtgtgtggcagaggaggcaaacgaaagagagagtggtcagctcaggctcaaaagtttatgactggctgcaaagacagtcctagagaagcagttaagaaaactatgatctctagaacaggagttctcaaacttgagagcacgtctgagtgcctcagagggcttattaaaacacacattgatgggccccaacctcagtttctcactcactgtatccagagtgggtctctgaatttgcatttctaacaagctctcagaggatgatgctgctgcttgtccaaggaaaacactttgagaaccactgttctagcttctcagaggaaagaatatagaaaatgcttgtgttgtttccagctttttatctcctaaattttgaaatatctcatttcacctctgtctgtcttgctctgtgttgtgagtttccttgtcaatatgtgtacttctgttctctctatgggaagtacagctccgtgttcttctgcaggctgtcttcctctttttcttcttcttctccttctctcttccttctcctccttcttcttcttgtacctaactatgacctctgattagtaggaatggcttatataaattttgaattgtatacattcttgtggatgcaggtctgtgagtatgagtttattctgaaaccagcactgtggtcagcattattcctcacaattgatcatgtctcacaaaacactttggactctgggtagacaattaaataaagtagccaaatggaagacccactcatgcatatcttcaggtcctctgaggtcttatagggcccatgttatattcctagtggttgcagagcatgccaggaaagaagacgaccaccaagcaagcctaaatcagctgcaaaagagttcagcactttttttttttttttttttttaagaatactgcagcctttcataaacagagtcacgttttggccccaatgcaataaaaagtataaactcatgtcagaaaacaataccaagttcccacattaatgaatctttctcctttcttttattcttttggtccattttgcacaggaaataagaaccttgcggacagaaagatcatcatttgtcaatccttttgcagcaattttcccaacagttctttcaggtctaaatgcttttaagcatctgtcagtgtcatataatagccttaatgggaggaaacaacaacaacaacaacaatttgctgcataaggatgaaatgagtgagtggctctcttcttcctggactgcagtgaaaatgatggtcctgtccatatgtagatttccacatgcagccgtgcagttattgtttgcactcagaccttaagttgtctgtaatttttatgtgtgtaggaatgatgccaattgagagagaatggacgaaaaaaaaaaaaaatatttagcatccctgagatgatataagtcaataaacagcttgattactaattcattcaggaacaaaaataatggctttctaaactgaaacgaccaaatccaataactaactgtttgtcagggcagtaataatggtatttgtatctcttttaattggctttaacctttcccttcatgtgtgcagtattaaaaaattaaagaggaaagtatttagaggcaaagatttacggcactgcgtggattacatgcttttaatgaggtcaggacaataaaccatctgagcagaagctgctgcccaatgatgaattattcccttttacaatagatagactacagcaagcgtgtgtgcacacacgcatgctcacaggcccacacgcttgtctgtgtagaccatgtgaaagacccccagctttgctgttgagctaccacaaggtgtttccagttacaaggagtgttcagaaagtatcaaaatacagagctgcaatacattatgtaaaaaacagaaagttgcagagcaaactgcacgatgtttatgtaagatgttaattcattatgtctgtgcatgttagcatatatgtgcaagtgtggatggatggatggaggcagggatggatggatagagggatggaagaatgtcagtaaggatggggagaggaaaacaggaaagaagaagaaaagtaaaagaggaaataaaaggagagagagggaaaggagggatggaggaaggaagaagaaagaaatatatgtagagagaaatattgataatttggaagcatacacacaggagtgcactggagccagcttgtactagcttgtaaaggcccattgtgcaatacgtcttctcaattctgtcatattcttaacttacaattgtagatagtgacagtatttgctgcacagaaatcagcaaatgctacagatcagggcttttttttcctgcagagccaatttctaagcctttatcagcacatcactggacacccacaaaatcattcagagtggttctatctagaaagagggtttagtacagaactaaaaagggtacatggtaccgtttttagaactagaaggatacccttttagtagaaaggtatgtgaagccattatgttgggaatgggaaacaagacatttttcctctttattttatacatttatttattatttgtaatttttattaagcatttattattattaagcatccatcaattttataatgaaatattttattttattaaaatgtatccacaaacgttattaaaacttgtttagtaataatagaattaatcactttactttaggagtcagttacaaatccttcatacaaggaaacaaatttcagacaaacaataggatcaaatgaccaaaggacttcagactcaaccagaagtgtgtcctttgatggtgaaaatatcctcaatcttccagagcaaaaggaacattcaaaaagtgttaacatagattggtccagaagagtagagtgttcaaagtcagatcccatctgatgacaaattctagtgaagaaagtcacatggctcctccaaagcttatctcctcatgctcattggttgacccgaaccttatcgcagtctttgcgtaatcagcggcctagatttagcagtgtgaaacatctctaacaaagagaaaggcaccacattccagacactagagctgcagtcccattggaaacgcaccatccttgtgggccagccagtctgtcactaactgaaaaaaatgttgacgcttcctttttgccactttgacatggtgtgatctctaatcagcctcagtaagcaacagagtaaagaaggttctctgtttccccttccttcccaaatctttcccaattccagatgatattctacttatgacctcattgctctcatttcctacagactcctgtaaatgaaagtccctgactagaagcccatacctgaactgttaaggaaaatagatgcctcattttacaaacacaaactcattcattcaacaaatggttctagatgcctggctgtgggttagatatggggatacagtggcaaacttgtcaggcaaggaccttgcttttatggagctgacattctagaaggtgagacaaacataaacaggtaaaccaatgaaaaatatcagagaatgagtaatatttgaaaaacgagaaatagggggatgtgatagagagtaacaggtactttacctcctctgctttagagtggctagaaggagtcacatttctgaggaggtaaattttgaactgagatgtcagtggcaggaagaagccagccatgtatagatcttactacaaaaagtaggtcctggctccttttatggggatttttcctacactcactgaggccttttaagacacaagtccaatgaatggtagactgtagatgccttctttatttcctggtgactatttcaaagcaagcttaggaagtcttcactgctgtaagtacctttgaaaaatgtgcaaaattgggatccattgtgtatttgaagctgatttcatgtgcttaaatatcttgaaggttgtttactggttagtgctgtgagtagcattgtttccatgaaagaaagaaagacaaggcaatcataagttcaactgccataaactgggccatctcacagttgtgtctgtacaatttctttttttttttttttttttttctttttgagacggagtctcgctctgtagcccaggctggaatgcagtggcgcgatctcggctcactgcaagctccgcctcccaggttcatgccattctcctgcctcagcctcccgagtagcttgggctacaggcgcccgccaccacgcccagctaatttttttgtatttttagtagagactgggtttcaccgtgttagccaggatggtctcgatctcctgacctcgtgatccgcccgcctcggcctcccaaagtgctgggattacaggcatgagccactgcgcccggcctttgtgtctgtacaatttcaactaagggacaaagtgttggagagaaagatgttataggctttgaatcaagaaatatctgggttcaaatcctcgcactgcccctgagcatggtattgaccctctctgagcatgtagtactctcaactttaaggtgaggttataaaaatgcccacatcatagggtcatggtgaaaatgaaataaggttatgtttatataaagtgcctggctctgagtagcctgaagcatctacttagagaaggttctagaaatgttgctgaacggtgtgattcaccagagtgagactatcatcccatggggacagggagaattcatttatctttgcttcagtctttctgttgaatgcagagctgcaatttgggacttgatgttgcagcaaagatttcctgattgggcaagaaaattgagaaggcagctgtcattcttttagtatgatccataacaaaagaaaaaagagattgggtactcagccagagataaacccattcctttaatcctttacttattcaagagttgccctctgcccctcctctgcctgaatcttttcccctcttcttttagtcctttttagttcttcctggagaaccagaaataaagcttagaaccaactggacagagtccttgaattacatcacatgagcagtgcaatttatgcagcaaacttcattgcctgagagtagaattgtaaggacatgcatgaatgctgactatattcctaggggtaatggaagctgcatatgaatatagtaactaaaaaaaaaaatcaaaaaccttggaagacaaataaacatggcagaagcagcaagacaatgtttttatgttttcacttttaattgactaaaaatatcaatacaacatattccttggacagtcaccccaacacccctcccctttttaatggaaactaggaggtggttgggaggaagaacactcaattgataaaacaacagttacccctgggaagtgcaagtagaggactggaaaggactgtatttttttaaaatacacatccacattgtttgatttttgttttgaaccagcctgcactacattttaaaattaagaatataccttttttaaaactggtgggggagaaggaagaaagagttactttctacacaagatagcaacgttgtttttaagtaagttttattaacaagtgacaattacttttttatgatacatttaagatagtgaattatgaatgactgaaaatcccctccagcctaactgagaaccattatgtctggtaattgccactgatttctgcaaacagtcatttttctctggcctgttaacataatttaaatttttaattgcccttcataattgtctattggagttaacaaacagtcccattcacctaagggtttccgaccaggccctacctccaggaactcacactggaaacatctaagaccacttgagaatgccattaggagtttgtggatggtccaattgaggtggcagcctctgtgacaaattgtgacatctttttaaggacccatccaactatggaataatatatttttggatttctgtatcaagtttgctcacttttgctttgtagctacctgacaaaaaaataataaatagagaaaaaatgtcacacttgtaaccatgttcaccaggactttcatcacattgccttatctgttgcactgggataagtgtgaacattctgggagaaggacaggtgccaagtgttcatgtactataggactcacaggttaattaaatcagtgacatcagagaggggggcagaattaacagtaaagatacatatttatctcaatatatgtgtgtatatacccaactcagaaaaaaatgatcataaagtgctttagtagttttgtagttacataaactacaaaccggctatctcagccggttctttgactactttgcatactttgatcatgctcggttttctgagaggaggcactggaaaatctgcttttttcatatagttatataaactactagtagtatataaactactgtcattttcctgagttgggtaaattcaaaaaagtagaaagaaaaatgcaaagaaaatttcctataattccatttatagtatatatgtatgcctaagtacacacacacacacacacacacacacacacagagatatatctggatagtgttttataatatatttctcacatgatttactattcttgtaaaattttatttgtaaggactacatgtgattcaatatgtagtttcgccattggttatttaagcattccacccctgttggatattaaatttcttggtttctaccattacaaaaagctgaaagagtgagccaccctgcatattttgtatacatcactgataattacctcaagaaaacatcctacaaggtgagtgattcaggagtatgaacctactgctgaatcaccctccaaaaaggttgtagatcaaaatacgctctctcatcagtatatgagagggatgacttcccatatttttcccagcactagatgttaacatttattaaaatgttggtttcattactagtctaaaacatagcattcattcatttctaaaggttacattaatttgaccaaaagatgctgacaaacatttttatgtattaaggagagcataggtatacattgtgaatggcatgttcaccccacctcatccactttctattaagatatccatattcttatttgcacagttaaaactttaaattctctgtgctttttaaaaatctcttaagattgctctgactcaagactaccaagtaggtgttcagtgccaaagaacaatagactccaaccacacaactagttcccatgctacctgaaaaagggcttggttttttttttttctgccaccttcacgctcttacgcatttgcagtaggtgcatcttagtgcatctacttagcgcagcatatgaaaccacaaacaaaactgtcccagggaccttgaagtctgtcttccacttcccagggccccttcatcctccttttggttcccctcagaatgtccaagtgaatccctttgtgcatccccacctggtttagtattgaggcaaatgggaaatgcccagaagaaataccgacttgaaccactagtgtgaaatactaactcacagcaattcactccacacaagttggcaacttctgacataaagcaatggctgataagtataatgacgaggaatctgatgcttggtgatacaacagtagccacagaaatggtcggcagtgaatatctgattacctggctcaaatctatttccaatgttgggatctccagggtccatttaagtatcttcaaacaaatgttccagccgagatatttatgggattctctacaggcagctgactggctgctgtgggaggaagtccaaagctgagatatttgtcctagcttgaaaactgtcagtactatttgtatgaatgcgttcaaagtggccatgtttcttcataactttttggactagttcaacagggacatgaaagaaggacactaaactgattcctacatggaagcttccattgcttactgtctgcttggaactctgagggtgacatttattataaaaatagcaacagttagttataattgctgacacattccatgctttcaaattgaaactaataatctcattactcttatttccctcacctcctcctaaaaactcatatgatagcacatttttctgtgattcctatctcagccgattctttgcctactttgcatactttgatcaagctcggttttctgagaggaggcactggaaaatctgcttttttcatcacctatacaggaaaaaagaggattctataagtctaaagcaaaattatagatcggggtttcaaccgtgaacttgggtttgttctttttaaagcttaaataatgaatgaggacttctttgaggaagtgtggctttctttggggaaatttataagcacctgatggctgagaccgcagggcgtggagtcagaaattggttcaaattctgggcttgctgctttctagtttagggtgttattttgagtgaaataggaatagggaaatgggttgttgtgagaatcaaatgaaatgacacaggtacacaaagcacactcaatgagtgttgataagtattgtcattgttatgattaaaacttgacaaaaatcctttcgtttaacactcaggacatctgtgagtcgggtgtttactggttcctctgcttctcaatgacacccacattcccagttgattcttacaggcccagtcctgcttttcatgagaatagaaaggaaaaaatatgggatgacttaagagatgccagatgaatctttgccccgaaggcaactgtttattcagctcattcaacgaacaaataatttcactgatgatttattgttttcctcagtgaaattttccttcatacatccataattaaaaagggtgcagaacagtaaatcggtgaacctgtcatatgacatttgttagcatcgaaaaccaaggcatcatagcttttagaaaagaaaaaacgaagaggttagataggccctgatgtatggatttttttaactggctgtcatttcagaaatgaaaaagtgtgaggtgtctgtgtgtgtgtgtgtgtgtgtatgtatgtatgtgtttaaagaatggagaccaaaatgtaaagtgaatgtaatgccctgtcttccaatataatgacctaatttctattgatattgaaaatataccccttattagcaatgagcacatgcagtgtttgcagtttctctaaggaaggaataccagtttttgcttatttgttttattttttagtgacagaaaattttccaatgttaggaaaaaaattaaattacctatctaattcacaagctttcctctcttttttgagatggaattttgctttttttgtacaggctggagtgcagtggcacggtcttggctcactgcaacctccgcctcccgggttcaagcaattctcctgcttcagcctcccaagtagctgggattacaggcatgcgccaccacgccctgctaaatttttttgtatttttagtagagacggagtttcaccgtgttagccaggctggtctcaaacttctgacttcaggtgatccacccgcctcggcctcccaaagtgctgggattacaggcgtgagccaccacacccaacccaaactttccttattcaaggccaacccagcaaatgctttgcccataaggaagggctaaaagtggcagcaagtaatcatttgatctgagggtctgattatagagaaataaaattttaactttgacagagacttcagagccaaaaaagcagagcttggcccctgactttaatgctaagcaaacaaatggctttgggatccaactctacagtgtgacacatggatctaataatgatacttgtaaaaaatatcatgagagagaaatgatgggagaaattcaaggaacacatgtatttctcccatacagatcctgttataactgaatgtcactctttggcaaattctgcagacataaaaatgaacccgatgcaaactgaattcgctaagttcatcctggagcacctaaccgcgtctcccctccttcctcccccagccccccacaatgttaactgagaacctgataaatcagcaaaccgtctagaagcctcattaaacctccaagcagtgcctagtctcacaagagagtagcattttgaaggagacagggagcaacaacagacataatcatgaggaagaaaaacaccagaataaaagaaacatcaataaaatataccatgcaccattaaggaccacctcgagataagatactcagcgtggcagtaaagatcacaaatgaattaatgtcaaaaaaacaatgtgtggtctataataatatgtcagactgggttgaaaatcacagctgcctagggaactgtgcagcactcccagccctccgtttgtggggtaattgtgccagtgactcttaatgctgctgacagagaccttgcaacatcactttttttcacacaacacacccaatttgtcggagcaaccacatgccatctaggcaggctgtccattcattggaagaataggtcatttttatgtaaaaattgtcatcctcattttttttttttgagatgggagtctcgctctgtcaacccggatggagtacagtggcatgatctcagctcactgcaacctccatctcccaggttcaagtgattctcctgcctcaatctcccaagtagctgggattacaggcgcccaccaccatgcccagctaattttttgtatttttagtagtgatggggtttcaccatgttggagcaggctgatctcgaacctgacctcaggtgatctgcccgccttggcttcccaaagtattgggattacaggcatgagctaccacaccctgccgtcattctcatttttgtaactttaacattttgatataatttcaaaattacataaatggtggaaaaaacacccttatgccttttacccagatttaccccttgtgtatatatatgtgccactttgccatttgcagtatcattctctcccagcttccccacacaagcgtgtatattattttttaactaattaagggtgagatccccatgcacatcgtgcctctttacctccagacaactcagtgtgtctttcctaagaagaaggacattctgttacataacccagtaaaattaccaaaaccaagaaatttagcgctgatatcctatattgtctagtccttggtctatattcaacttttatcagttgccccaatagtagccttcatagacctttttttctagtccagggttcatttcaggatcacatattgcatttagttatcttttccctttcgtcccctttatctgaaacagttcctttacctgcacttctgtttttgcctttgtcttttttgattgttacatttttaaaactttttattaatatgttttatatatgtatattcatatatgtatatatgtatgtatatttatatgtttttgtctctctctatatatacacacacatacatgcagttaacttgtattttacacattgtatagccaaaagaaccgtgaattctttttgaccaaattcaaccctgtgatcctagcacatctcataaccatagccctaaggctcactgctcttactgcccagacatcttgctgccatctcagaccaagaagctggcgtcattgccatctgtagtactctaaaagaagcattcggcctcatggacactagatagtgggatgatattgtttgtctcctcagagcagagctttacaagctgcctgtgattaaaaacaaaaacaaaaacaaaaaaacaaaacaaaacaaaaaaaactttaggccaggtgcagtggctcatgcctgtaatcccagcactttgggaggctgaggcggttggatcacctgaggtcaggagttcaagaccagcctggccaacttggtgaaagactatctctactaaaaatacaaaaattagctaggcatggtggcacatgcttgtgatcccagctacttgggaagctgaggcaggagaattgcttgagcctggaaggtggaggatgcagtcagccgagatcatgccattgaactgggaaatggaccagactccatgtcaaaaaaaaaaaaaaaaaaaaaaaaaaaaagaacccttttatcccccagttcctcagagaccatttatatatggctcttctgcacaaacccaggtagagtttgcaccccatgtgactccccattcaaggttgccattataccactcaaggagctgagtctactgagcaagtgctttgcttccttgtggcagtgtcaagctactatagaagtgtctaacccttagctctaatctcctttatttatctcatcaaacgctgattggatgaggccagtggcgcacacttagccgtgctgggctaacacagttggctcctatcagttagaattcaactgaaggcttgcatccccatggagcatttctcattcaccagcctgttttaggacacgatgaaatgcctcctacatagcacttacctcaattcgcaacaacactttgatttttgagatgattgtattggtatctagtaccatgacccaactctagggtccgtgaaactcccacaattttgcctgccattgtgtcctcaatgcccagtgcacagtagacactcaatacataactgtttaatggaagagtgactgcatcagtagtgacttctgacaaatgatgaaacacaataagaccatgggctaactcgaaatacgtttaagcccaataaaattacatttggcataagaagatagggatcatgcttgctctgagaatttgaggacgtttttgtttgcttgtgtgtttgttttagatttaaatgagggaaatcgcacttttgaaagcaccaaactgtgtcttacatatacatagtagacacttgaaaagcatccatttcgaattaatcattttgagagcttagcacaaccttagcagttaaactgtctgttactattttcaagaaagtctatacttgtccaactgtatttgtttatttgagagtcacatttaaccaggacttatttcactctgtattcttaatatttgtagggttggtgggggagggggtacaaaataatattttcctaaacaaatagagcctgatttattcaggaaaatagagattatagatggtttgcaggaaaaagaaggtttgaaaacaaaacctgtgagcagattgttttcaagtactttaataggctcagctgcttcctctcctccacttttcttttccatgaatataataataatgatgataaaggtttatgctggacccattataacaatagggactatcaccaaagtattctaaaactctctttcaactataggagatgatcttcagagaaaacacttgaaattgctactttgtgttatcaagctctgatgatttggggtatattgtttcttctgtgtggccctacttcaaattaaggctggataatggtaggcaaaacagtcagaagcatgctttcactggtgaggcatctcttttggctgagttaatctttatagtgaagatatacattgaaagtatatgtttccttactgcctgtacagcttagtttgctcagtgtccaggtggctttagttatgacttatgactcaaggatagcattttaggagaaccagtgggaaaaaaaagtagtataaatgtaaatgtaaaagatacagctcattctgtctttgaaatcgttgatgtgaaaagagctcaacagtgttttatttaaacaaggtcggcttcgaccttgattgacttgcagtaaattgcctggtacaagaggcaaaaggaaatggagagaaaaatggcaatcagcaccaaatgtttcacatattgattgacaagcaccagagatgtgctagagtaagacaaattggccaacagggcccatcttgacagctcttgagatgggaaaattgttcttgttaatttgctgcaggaaccttgtcatttatggaatgtgcacgtgagtgtctcctaattgtgcaaacaaagttcagtttcctacacagccttgttgtgttattgggtttggtaattctttggtctgaatcaccaggatgcatttgtaaatggcttttaaattgggggacaaaaggggaagtggtgcacctgctataagatggcattttcaactgaaatatagcaaattacttggtggacattttccgtttaacaatagatttcagacaaactcatgtgcataagctctccttccatctgtctgccatgattctcttctgccgtactggatctaattgcctttatctcaatgcaggtttgagtttgggggttttcaggtatgtaaattttattttaggagtttggtagtggccaaaaaaaaaaaaaaaatccttcgtagacttttctatcttcgccccttcagtatttctatctttctcttttagtcttctcctaacacttctctaatatcctcctccctctctccctctatgctgaattagtgaatgtctgttatcacccaggtacctctttacacctctctctgtaagatgcactgtattatggaccagactgccaaggagacccatccagaagccaacgttcagtcttgtttgtcattttttccaaattaggtaaaaatgcattttcatttagggtataatttaaattaaagcattgtcacagacgtttttgttttaatgttttacaagtagaagccctcaccatcattattaccccttcccccgagtccccccctcccgcgccacacacacacacacacacacacacacacacacacacacacaacacggccccactctctctctctgaatttttcaggccattactgcagtcttgcttgggcaggaatggaaaggtctttattttcatttaaatgggctgtatgaaaaataaatcttaacttccaagacctgttcttaatcaccttcattaatgtcgcagctcagaacaatgcatcactttcctactgtctaagaggaagatccagactcaaaaatattcatgatttccatattactttgtacagacccctttaacattaacttgttccagtgttgggcaggtcacatagatgcttaaaacagctggcatatggaataaaatatgggaatagtggggggaatatgtaccccactgaaggcattcagtgtcataactacagacagacaaatagacagaatattgtggaagctttagagctgtagggtttgtgatccctagcctagacttaccattcttaacctgttttcaaaaacactcttcgctgattatctcattttgtcttcaaaatagccctggaaagtaggtgcatgagactccattttccccatttcacattgaaaacagaagcatcagaaagtcaactaaacttgttagatggaggcagggaaaggaacctggacagctggcccgactgctcctacagtgacctttccacttagcattctctcatccatttgatgtcactcaacagctgcttccagcctcatccttcaccccatcttcttcgcaatgcccaactctaaaatcaccttctctctccagttgtcattgacctcaccttccccaggcagagttcactgcaccctcttctgggttgcaatgtccctgaaagcaggtccctttcatagtagctaccaggttgacaatgcagccacctatttacatgtctatctccctcactgaagtgtggattcctcaaggacacagactgtgtctggttccatgtcactttccttgtgtctggcactgcttctgccacgtagtcagcccccagtgaatattggttgaatgaatttgaagtgttagtaaacacacactacaacacaacttagaaaagtgctcagtccagagttcccatcctaaatttcttctccatctgcatgaattcactgtgcctgaatggcaagtcatttcatttcggaattatcctgaatcagaaaagagaaggcaagagaagctctggccatcagcagcatgcggattgctagaaaatgtttatccccaggaagcctagaagtgctggggagtcttttttagaatgctcaggtgttgtttctgtgatgccaagaatcttccaaaagattgagatgaagccacagagaaaaatgcttcaatgtttcaataacattaaaaatttaaatgctagaatattttaggtttctttgatttacaaattaatacccccaaatatgtatataaacattcccaaggctgaggttcaccaaggaccaatttattgaacaagaaagcctctttggattctccttaagtggcaccttttggttcacataaataaacttgtcttcccctcttctacctcctctgaaagaaggttgtgtgaattgaaactgcagaatcatattccaaagatcgttgtgcgttatcctgaggacaggaagggcacagcatcagagaatcttccttttggattggaccacagaagtcatttcaattgattgattgattgattgattggaaatgggatctcattctgtcacacaggctggagtgtagtggtgtgatcaaggctcactgcagtctcaacctcctgggctcaagccatcctcccacctcagcttcccaagtggctacgagtatgcaccaccatgcctggctactttttaaagatgttttgtagagatagagtctcactatgttgcccaagttgatcttgaactcctgggcttaagcgatcctcttgccttagactcccaaagtgctgggattacaggcatgagccgccatgcccagcctcaccctatctttatcccacataaatgtcttttctaacatcctctctaagggccatctaacatctgcttaaatgcctccacccacagtgaactcacttccacacaagaaagcccatttcatttgtgtactgatcaaatcactagaaaatctactattctattaacccaaactcattttttctatcacttctattccttggtctctgttatgccctctgcaaataaacaaatcaaatgccaacctccttgcacaggactggactgcatagcctgagttgaaccttcccctgtacacacaagaccctgtctgtccaagtctccagttctcctgagaatcctagattccttcataccttcacctcactgaaagttagcgcatctccaccatttgcccatttacttctgaacaccttcaatacagatgttcattttgaaatgtttctgtatctatgagtatgttctgactaaatctcagagcaaaactggaagaagtacagcttcttttcattagaactttgacttctattcgtggtttatttgggccaaacatattaatctgtgtctcatgcagagattatactgatataaaactccaaagcctttttttatatttgcttccgttcagtcatattttcccatctactactaacagttttatttttcttttaacctaagtgcaacactttacacttaccctttagatttcagtttgggtaatttggacatatttggatctttattattttccagaatatatgttcattcttctagctttatgttccctacagataagatgaccgtttctctccttatgtgtttctcaacatacctgctgagcatgcccaataacagagccctgtggtacatcattaggaacatgtagagaaatagacttcagtggactacaatgaatggctgagtaggtcatgagagctgagtggatcgtgagaactgaataggtcatgagagttcttcaaagtgttaaatagtgaatgcataatagagttgccatagatcttacccttcaattgaaaacccaagtgtccataatgatcagctaggcaatatgaatgaatgaaataagagggcatggtggggtttgtggtaaagtggagagtgcatatgtaaatcaaagccactaaaattcaattaaaagaaaaaaacactgttttactgctttggcaaatatatatatataaaacatattatatattttgtatgtatatatcttcatatatacacacacatatatctatatgccaaatgaggccagtgggctgccacagggccaactctgctccagagagcagcattagaaccaaggaatagacttgtatgtttctactatgtagagccatcctcttaatgatttctcggacagtcattgctaaaaagctactgctctaagcactttttctccttgggtagttgttgagacattggttcactctctggtgacttttttccagagctgacagtatcaatgttatttccatttatggttgatttaaaaactgtcagagaggttggtttccttgatgaaaaatttgggaggctaaacgtcttccccacttctacccctttcccaaccccctgctacgggtgatcctgacactagattagatggaccacttaaagcaggctagttttttgtttgctttttgttttttgggtttttttggccacattgtatattgtgttagtttcctattgctggtgtaacagattaccacagacttggtggtttaagacaatgaaaatggatgatctatcttacagttctctaagtgagaagtctaaaagcagtctcaatggaataaaatcaaggtgtcaacatgacagcatttcttctggggacaccatgggagaatctacttccttgccttttccagcttttataagctgcctgcattctttggttcatagccccttcctcacatcagtccaacatctgcttctgtggtcatatctcctagaccgctaaccctcctgccccctcttatctccttatctcaagatctttaacttattacagctgcaaattcctttttaccatgtgcaccaactaccagagacaggaaaaaaaattgtttttccccactctcacacttctgacactttattctgatgaaaaaataaaatccaatcattttttctctctccactcacactcaacacacagaacacttcacttctggttaccatcatgttcaagggtttctgcccaccagcaaccaatcagttctccagtggacaccagctgggtgtccactacttcaattcaattctgacactatctacctggaggtagcatcagatcccacaggttaagggcccagtccctcaagactgctcccacttcagatgttaatcacaagtcccatgttgtgacttgtgcttctaaatgacctggtataaatcagaggacccatgaccccttccttgggttctattaatttgctagagggattcacagaactcaaggaaatattttacctacatttttacctacatttatccatttattataaagaattttacaaaggacacagatgaacagccagatagaagagatgcatacggcaagtaagattgaaggggtgtggagcttccatgcctctccaagtatgccaccctccaggaacttccacagattgagctatccagaagctccccaaatcctattcgttttgttttttatggaggcctcagtgcaaaggcaggattgattgcatcattgtccgtgggtgatcaactcaaccttcaactcctctctcctcgctggaggatgggctgaaagtcccaacactctaatcatgccttggtcttctggtgaccagcccccacatcccaaagctatcaagatgaccccagccaccagtcgtctcatgagaagacaaaagactttagaagacaaaagacattcatatctccagagataccaaggattttaggaattgtatgccaggaaccaggatatttcacaatatcacagtaacatgttcacagggtccaggaattagaacctggatgatttggggaccattactgtgcacaccacatactttctgagctaccacaaggccaggttgagagaggaagctctccactctgtaaccttcattctaacaggccctgtgaggctgtggcagagtggagttaggggattcattaaggaaggggattccactaggacttaggtgtactagaacagactcgggactgtactagaatataaggcagagagagaagacattgttcaaaatttaaatcctcccgagttcaaaatttaaaatgagaaatttttaaatgagaaaattcctttctttctcccacatttaccccagagatgatgtagcccagcttctgagagtaagcaaagcaataaatatgaaacaggaaacgctggtaaataacttcctggggactactctggaggatgggggctgcaaagctaatactttcttgatattttaagggaagctcctctccaaaccacctgggctgtgacaagaaggaaagaaacctggaccctcaaccagtatccaagggctggcttcattttttccccaattagcttgcaacgagttaatagtagctctgtagtgctggattcagggatttgtgtgacatagataaggtttggcattaaaaatgctaaatcattacaactctgaattttctcatgttcattcacgaagctgtaatctttcccacctagtactatcactcttagggtgcatgaatcactaattattgccctaatcccaggagataaatttctccaaggaacccagcagcaaagagcaaagccttgaaacctacttatgaagaaatgtgtcagccgtcttggagatttttacttcccaacttggaaattatgttgattggagtaagtggaagcttaactggggggttgttgatgtgtgttatcatctgggggtggtggcagaggggataaactgtgagagagagccaattttatctcagtttgtcctctgactcatgaattctgagtcctgcaatggagttttttgccttgcaagaaaagctagattaatgcttgtgtgcatagtcattgactttataaaaaatcagattacaaggaataattttagtgtatatttatatatccaaatttatcataatcaccaaggattttaagcaagatttttcacggtttcatgcactattgaaatatttggtaaggggagaaagagctgttatccatatcctttctagatgttattcatcttcttgttttaaggtataaaaattttccctgaaagcctctggtttgggccttggatgtagcaataccagagcccgagggtagacttttgactataaagaataaaaaagttccagggcttaagctttgattgaggacattcctgtctttgtgggaaacagcaacagaaaaaagaagtcctgtagccaagacttgcttgggtttttctgctgaggaccgccagagattcccgcagctctcttgtttgggaggaagatggggaggaagaaaaggaaataggaatgctgtgttccttcgtcttcccttcatttctcccatgtaaaaaataaagtagccaaggaattattgtctcttttaggaatgcctcagactgttagagttatatcaattgatactgtcttaatttatcctataatttttttaaaggaagaaagataatatcagctctttattgcctatgtctgtactatagatgaaatgtgtcacactccttaattctctcccacattatcatatctttgataaactcaatagagaaccagtagcagaggatgcttgaaatggtttttaaattatttcagaaaggcttccaattaagctattgggaaatatgtgtgtatatatatttgttaaaattgtaggcagttgacttgcttttcaacgtttgtaaggttttccaagcttgaaccacttaagtcaaaagtagaactaataaaagcacaattgaacttaatatattatgtcaagatttacagtaatcgattattgtttttcagctatgaagatatcattaagcatatgccaagcaatcagcgcatgactgtaataggttcatgaaggaaaggctttttctaatcgttttcagtggtgtttttcccaagacagcaacagcttttataaaatgatggttatatctcctcattatggaatctaatctccccaaaagacattcagcagctgcaaaacggtagcatcttttagctgtaaattgttttttattatttatccctatttaactaaagaagaaacggccatcagatgatttaacaagacaagaatttagtagttttaacatttgacagcacccaattgttagcccatgcattgatctctttagatcttggcttaatggtaattggtgtatttttgctttcgtgtctctatgtactgtataagctgagtatgagtcttctaggaaccaaatctgcatgatcggctcttttatatttctctttaacatgggatttgaagttgtgtgtactcgtagaattcaagaaattgcagaattagacaaaaaggaatacagccatcctaatgtgagtccaattttaatagtgggtgtcattatgagctgaatttgttacccacaaagtgatagaagaaagtcggaagatggaaacctctgtttattggtattatgatttactggtgtgcatcccatcacaaaggaggctcttcagtgggacacaattttttgttcttaagaaagtgatcgggctctgccaggcgcggtggctcactcctgtaatcccagcactttgggaggccgaggcgggcgcatcaggaggacaggagatcgagaccatcctggctaacacggtgaaaccccgtctctactaaaaaaatacaaaaaaaattagccgggcgtggtggcgggcgcctgtagttccagctactcaggaggctgaggcaggagaatggcgtgaacccgggaggtggagcttgcagtgagccgagatcgccccactgcactccagcctgggagacagagcgagactccgtctcaaaaaaaaaaaaaaaaaaaaaaagaaagtgatcgggctctatttgagaatgttctgtggaatttaaaaataacatggcactaatgagttttcaaatcgctccatgggtagaactctcgtgagacaaccagctaatttaaataaataaggttctgtgaccccgtgggagcttacaggggtgagacatccattttaatcgaggctcagtttgagaagaggaaatttcactcataacatactttcaagtggattggctgcaatgtgattttctggcgatgtttcctttgttgctattttaaggcaaatgtttatgtttctttacaagacttggcatattttactggaaaggttgaagtaatttctccacccttaatatggcatgcctttctagaatggtcactcggaaccaattaagcaacaatttcattccatagactattgcaatttgcttttcacttattctgtgcagactgaagttgtatattcatggacatttcccatgtaagttttagattttccactttgtagatgcaaatacttcttccagttttgtgataaaataactcaacaacagcaaaattcaaataagaccacaaaaaaagtcttattaagctttacataaatagctgcttccctatcatgaaaacaactgggaacattgtactgttgtgaatctacatttctacttattcagtaattgtacccctagtgctgtttaccatttcatttgtattatttatatatcaaccaaagggtatgaacaccaaaaaataatttcacatcacctatcttccatttctttttattttaaaagccctgaagatatagttctcctataaataatgataaaaagatgctgtattaatatttcagcaaagatctccatctactcacatactcacaaataacatattctgtaatatatacacttacccctccctaaattaactgtgcctggggcttgcaagaaaatcaggtcaagctaaaggagaaatcagagaacaagaccaaaattaatttactactctgtaccacatgtgaatatgagtttgtagggggaaaaaaaggcttattttttggaccatctctatccctgtatatgttgagcacttttaactctgaaatatgtgctgcgtcttcttgcctggatgaaggtgaaagttcaaccctctctgcttagatttttattaaatctcattaagtcagctaaaaggagctgcctaccttgtcagttctgttccaaaacatctaaaagccctttttgtacctctttattgctggaggtaaaattgtgaacacaaccataatttgcctatctgtctgagaagagttttctaagcaacaattggcatcattttcaaatatttggaatggttttcaacccagttatgtcgtatatcttatgctatgtgttaaagcaagcacattgcatatatatgtaaatgcggtaggaaggatgcccctttaaatatgtatattcatgaaccattttgggttcctttctctcaaacccacattaacccatcagtcaaacatattgccattaccttcaaaatgcatccagattctgatctttgtcacttttgtcactatcaccctcatccaagactcacccccactcatccctgacctggatggattattcttatgggtctccctgcttctgcatcccttgggtttgttcttaacacaataacaaaagtggctttgctaaaccatatgtagtatcttgtcactcctccctcagaaccttctatcagctttccgtctcacccagagtaaaagtcaaagaccttgcagtggcttctgaggcctccctcttctccatctctcattccactccaggtgcactcacctgcttgctgttcctagaatataccaaatgtgcagccagctcagagcctgtgttggtgctatttcttgtgcttcccctagacatcagcatggctccctctctcacttccaccaggtcccgttcaaatgttatcttaactgggaggtcttccctgatgaccttatattaaatggcacccacctcttgacctctactctgccattccctactctccttacctttctctacttttcccttgaaaacacacacacatatgttgtgtttacatatgcttatatgcatacatatatatatgttcgtatacatgtgtctgtaaatatatttatttatgtttaatttgctgttgtttttgccgttatttatgtgttgattgccccttctctaccctccagaatataagctcccagaaggaaaggactgtttgctttttacttcataaccccagtttatataatagagcctgatatgtactagacactcgaagaatatgtgtcaaaaatatggaaggaggaaggaagaaagagaggaaggaaggaaggaaggagggagggtgggagggaagggaaggagaaaggaaagaagggagggagggagggaagaaggaaagaaggaaggaagggagggagggaatgagggaaggaggaaggaagggaggaaaggagggagggaagaaggaaggaagggagggagagagggagggagggaaggaatgagggagggaggaaggaagggaggaaggaagggaaggagggagggagggagggaatgagggagggaggaaggaagggaggaaagaaagaagggatggaggaaggagggaagggagggaagaagggagggattgttcaagaatctcttttcatggctggtctaggaactctgatggaaattccctgttagtccttttatcttccacacagtcacttatttcgacttcacttaggctgggtacaaactattttagtttggtacacatatgccacctctttgcttaaacaaacaatgtgacccgttttctgggatcataggagaaataagtgggaacacagaggccaccattcccgtctctgcttggacattgaccagtcacccctcctgcccccactttgccaaatgagctgaggaaatgcatccttacctcccaagcaaacattaattactgtttgcaccacgctttgagatccacagatgaaagcagttgtaaaagcaaaatgggttattatgttgggaatggttatagactcatttagctctggaaacccatcaagcaggaatgttgaatcatgaaactagggttggccaaatattacacttgttataattaatttgagcttaagcttcaacacagtgacatgtttcctttaaataaagttaagtcctctaaggatgcatgaatctatatggatctcgattttcagctgggaactgaaatttttcagatatgcagaatgcagaaaagcaaatgtgtctctgacttctggtggggcagggtgaatatctgggcagactgcttatttttgagacataaataatcttctgtctccttttccccacggggctgtgagagcagtgttcacaaaattatggggatttaggactggaactgaatttaaagggcctacaatcctacttcccactgaatgccaaaacattgtctacagccttgctgacaagagccgctcaggactgctgaaataatttctgggatgaggagcttgttactttgcaagggtgctgattctgatgttgttcaacaactgttgttagaaagctctttacatgtttatccatttttgtcaacaaatatttattaatcactttctgtgcacatgtactttgttaggagctttgggatatggaaagattaaaacagtgcagattccgcaaccacctagagcaatgccctggcctaggagagaacctgaaaggtggtagttattcaatacatatgtgttcattgaatgaactacagagtggattacattctagcaagaatgatacagcacatgccaaagaagccatgataccaagtggaacatgtataaaggagaggtatagatacatgcaagatttatcaagctgaatgtggctctttttcgtagccaaattcagcttgaatttcgctctttttccaaaccagcttataaatgtccattctgtttttcataggacatggctaaattatttgagaattgctacaacgtcctttacctctcttccagggttaagaactgcagggcctcgagtgtattaaattatttctagtacacacatcaatctgaatttcttcccctaggcagctcagtgcctcaactaggctcttaagaggtcagcctagaatggaatacaccaaccaattcagacgtgttcatacaggcctacagtacattgggtctctctttcctatgatctggacatgcttcccataccatctcatactgcatatactatttgttcatggaacccttgtttcctgggacatgttttatcttgagaaaacccaatatttcaaagaccatagtttggaagataagagtctaatgtcatatgtgggttggttttattaggggggaggggagcagagtaattattttacacatactgcattaaaattatagatttatagtccatttatatcattttctatgaaggcagattttcttcatccttatttgaattttgggttttctgctcatccccaaacttaagtactggagaggagtgttatctaataaatagagccttagactcaggtcactaacttactgtgtggtccagaaaaagctgcattctctttctgaattacatttttttcatcagcaaagtgaagtggttgatcagggatattatctaaggttccctctaaagctaacattcaatggactttctccgtagctttctttgacttcatctagatcattctatgacttttgctaatctcagggacagagctatcaactagaaagcagttctaaacagaagcatagcaaaagcaagacacagcaggtcaacctgagccccatcttctaaggcttatttagcatgtcagaactgcagagactgggaagaaaatgtgagctaagagccacaacagcctttgttctgcatctgtaccatgtcttcataagacgaggaagtctgcaagtcttcataagaagaggaagaagctgggcatttttgcatgtgcaaaccaatgctgacatttctgtcacatcacttctaccatgatgggttttacaagttgcccacatgaacatgtttgttcatgtctgaaatggcacatcattgtatcacctcacatgcaaactcctcactcactttaagtctttcagcatttctaccctggttggtagtggcttctttcctggcaactatgattatttgaaaacaacgtcaagagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggcaccagctgcagatatgaagcagagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcagctgcctgccttggcctcccaaagtgccgagattgcagcctctgcccggctgccaccccgtctgggaagtgaggagtgtctctgcctggccgcccatcgtctgggatgtgaggagcccctctgcctggctgcccagtctggaaagtgaggagcgtctccgcccggccgccatcacatctaggaagtgaggagcgtctctgcccggccgcccatcgtctgagatgtggggagcgcctctgccccgccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccggcagccaccccatctgggaagtgaggagcgtctccgcccggcagccaccccgtccgggagggaggtggggggggtcagccccccgcccggccagccgccccgtccgggaggtgaggggcgcctctgcccggccgcccctactgggaagtgaggagcccctcagcctggccagccaccccgtccgggagggagatgggggggtcagcccccccacccggccagccgccccgtccgggagggaggtgggggggtcagccccccgcctggccagccgccccgtccgggagggaggtgggggggtcagccctccgcccggccagccgccccgtctgggaggtgaggggtgcctctgcccagccgcccctactgggaagtgaggagcccctctgcccggccagccgccccgtccgggagggaggtggggggatcagccccccgcccggccagccgccctgtccgggagggaggtgggggggtcagccctccgcccggccagccgccccgtctgggaggtgaggggcgcctctgcccggccgcccctactgggaagtgaggagcccctctgcccggccagccgccccgtccgggagggaggtgggggggtcggccccccgcccggccagtcgccccgtccgggagggaggtgggggggtcggccccccgcccggccagccgccccgtccgggagggaggtggggggggtcggcccccctgcccggccagccgccccgtccgggagggaggtgggggggggtcagcccccctgcccggccagccgccccgtccgggaggtgaggggcgcctctgcctggccgcccctactgggaagtgaggagcccctctgcccggccagccgccccgtccgggagggaggtgggggggtcagccccccgcccggccagccgccccgtccgggagggaggtgggggggggtcagcccccccgcccggccagccgccccgtccgggaggtgaggggcgcctctgcccggccgcccctactgggaagtgaggagcccctctgcccggccagccgccccgtccgggagggaggttggggggtcagccccccgcccggccagccgccccgtccgggagggaggtgggggggggtcagcccccctgcccggccagccgccccgtccgggaggtgaggggcgcctctgcccggccgcccctactgggaagtgaggagcccctctgcccggccaccaccccttctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaaaaaattaaaaaaaaaaaaaaaagaaaacaacgtcaaaataaatcctttctcattttcacccctagcaatcgctcacttggctatgtctatttcagggtgtctgcccacatctctctttatttactccttctctcctttctctctcttctccatagattttctcatctaatgcaaaatgtcctcaagaaggtgggcaaaggcctctcagggttgtagggggtggaaggagaaagaaccaaccatttcctagtgcacgataatgtttcagtaccacggagagcggtgccgggcgtggagaccagggaaaaatctgtcagccttgcgggtggttttcaggcaccatttggagccccacaggtagtggaaatgacaaacgtctacaaagaagctttgcagtaagaaccactctccccagagcctaagagccaagccttacatcgtcacatgcgaagaacagattgcatctgggcccgggtgcccgtcctaatgtcagcctgcttggcatttaccttcctttcccaggctgacctatgaagatggggcaggctctgggggcattgttctagccatgcaaacgctgtggccattgtgtcagcatggaagagctgccggttcctttccagctcaacactgtaattttatcaactctggctcagagaaacctatatttataatgctaattagaagggcacacatttaatttgagtggaagactatttgtatctcgctgagcctgatagcacagggctcaagcgacagcagtcagaagcaaagcaggcctttctgccttctccaagtatttgaaacagggcttactcttgccaaacaatttctctgttggattaaaaagagagagcaagggagagtgctgaatatgctggagctcagaaaactttgtgtttatctcctgcctgcataatatatttctctgtgcactgagaaaacatgcctcttatgttatctaattgtttcctgacacatttagcaacatttcacactctttaaagtgacattaacattgctgacagtggaggtattttcattagatgggctttgaattttaggcaggatgcactgcaggtcttcaaataggcttgtaaaaagtgaggaaggcattatttatgaaaatagagacttggccaacagtgccctgtggatgtgtattaattttgctgactctagtcaatttagagtatgtgtgtgtgtgtgtgtgtgtgtgtgtgcatatgtacatgcatttgtgcacacacacacatataacagcaacttgttgggagccgaactaaaacatcttcattatccagcataccactaggctccgtgagtatcatggaaactcccaaaacatctctccatccacatctttttagccataactaagcaatgtgctatttcagacaaaaatcagtcactttgcacccaatcctgaggatgagtagccatgtggctcatgtatataggcagcatgattatcactctcccagtgtaaagttaaatcctcctccttgttttctcccttcatgcttctttgtgccccaaggccatttttcttatgtcttcagctgtctgccttgatgcatagttttccccggagagtgtcctaagtgagccttcagagaagagtaccttgaaagcacctgcctctgcggggcctgaagagagacatttggaggttcattctgaccttgacgaagaaagtaagccaggcttggagaaggtgaggaagatgcaattcgggttgtgaatttctgctagggcacaacctcacatggaatctcgacccaattgttgatctccatacttgtcatgagaatagaataatatttagacattcaaagctgaagaagagagctcgctgcagactgtctagtcatcttgacactactaccatttccagtcagccctcctgccctaccctagttaaaattactcttctctgtttgcatctccaacattgcaatgactctatgtagccatacaatgcttaattagagagctctgagttcatatcttggctttgcgcattacttactgtataacctttgtcaagtcccgtgatctcttcaagacggtttgctcatctgtaaaatagggagaataatagtaactgctagatggtattgttggaaggatttcgtaaattacaaaccatgacgtgctaaacatactgcctaaaacatttgtgagtgctccagaaatgttagtaaatattagtctcttccatggcaatatgggccctcttgtgactgagacaatgtcatcacatttctttaaagtactgatgctggccaggcacagtggctcacacctgtaatcccagcactctgggaggctgaggcaggagaattgcctggggtcgggagtttgagaccagtctggccaacatggtgaaatcctgtctctactaaaaatacacacacacacacacacacacacacacacacaaaattagccaggcgtggtggcatgtgcctgtaatcccagctaattgggaggctgaggcaggggaattgcttgaacctgggaggtggaggttgcagtgagctgagattgtgccactgtactccagcctgggtgacagagtgagactctgtgtctcaataaataaataaatattaaaaaatactggtgctgttatgtcatagtacaataagatggatggcatgtgttgactgaggcctacagaatgtaagaagtttgttgtgacaagaagctagcagctaggtagccacaataaagaaccctgatctcctaactcctagcccagtactcttcctaactgtacgctagtggagatttttcagatacaaggcaatgatgttcgaacaattgttcagggagggtataaatcaatgcatatgttatccatgtcctaacatcttcctaacaacctagacctagtcctactctcatttacattttcaattctaatttcacaatatttataggtctttgagggggagcttttcatgctttatattggctactggtgggtagactcccaaggcatataatctttagcatcttatcaaggaccattcaatgaggaacgggtggggtactgtgagcgtgggcagcatagagataaaacagtttgagcatctgctgcctagagtgcatgttttatctttgtggtccctaaagcacatagcaaaacacagatttacagttgagaactgtttgctatctgcagacaaagcctttgaaaaggaaagcttccaataatgagaatgaaaacaattaccatttgcagagtacttcaccatttgcaatgcactttcatctatgttattatttaatcctcagaaagtcctgtaaggggaatagaacacctatctcttaccttttttatgcatgataataacacataccatttaattcataaagtttacagaattgtctcatttagtacatttaaaactagtgaagtacgtttccacacatttcacttacctagtagttgaacacagaaaagttagatgacttgcccaaggtctcccagagaatcagtggcagaatcaatatttgacattcaatctgtttcaatgccaatcacattgttacatcagcacttggtactttgttattataaaacctaattaaattctctgtgcactgtggcatgaggtctaaaatcagaaaacctcggttccaactcttcttcccaacgaacttatcccctctgcagttcactttcttcatgtttaaaatgggaaaaagattgtacaacctactcccaaagggtttgtgtcagattaaatacaataatatatgtaaagggcttggaaataatacctggtacctcataagagctcagtcagtctgagcaattggcaatattattgtttctatataccaggaaccgcaagaagtgaacataaaaatgagtaagatgaattcctttgcatcgtggaacatatgttctctaagggagccttttgaaaattgtttcggcatcggcatacagttccttttaatctttctctagcagttttccccccaactaagctcttacaaaatagattctaggacggcaagaaaacagctcaatgtatcttctgcatattactcagcacagacagacaactcagtaagtgacagcattgcccacatagtttaacgccttcatctgaaattgttggattgtcttgggttacatttccccagtagctcctgaaggtgagaagctttcataattagagtcaagagtggaattgaatttctctctctctcttttatttatttatttttttgtagagtgttgctctgcagtccaggccagagtggcacattcagggctcactgcagcctcgacctcctgggctcaagcagtcttcccacctcagccccccaagtaattgggagcacaggcgcacaccaccgagcctggctaatttttgcattttttatagagatgggattttgccatgttgcccaggccagtttcaaactcctagactcaagtgatcctcctgccttggcctcccaaagtgctgggattacagtcgtgagccagcatgcccagcctggaatcaaattttatacaacggttgcgttctaaagtctgaaaattaaccaaaaaaatgtggtcgcgctaccatgcctgaaaatcccttgcttctcttggagactgacatgttgtcacttaataaatctaacagccagtttttcctccaaggagcaccaagtgaagtagtggcttaatattctaggccacttggttaaggaaaaaaacatacatttaaattcagaatcaactcttcttagcaagatacttacacactgagagagacacccaaaacctaagacaacagccatagcagccaacagtgaagtgaatgccatgagtagttgatatacatccatacatgttggtggagtaaattgttataatcaaccaatcatggtgctatttattatgtacaggctctgtactgggtgctaggatacaaagatgtgtatagtgtataacctgtacccaaagtcactcatagtctcaagaatcagccagacatttaggcaagtacataggctaacatgtaacaaaagcaatgatgaaagtatgtcctgggtaccagtgagtgtggtgatcagaaaagacttctaaggaaggttgttcttgagatgagtctttagagtgtcttccaaaggtctctagaaggtgtttgccagctgggcgtggtggctcacgcctgtaatcccaggactttgggagaccgaggcaggcggctcacctgaggtcaggagttcgagaccagcctggccaacatagtgaaacttcatctctactaaaatacaaaaattatctgaatgtggtggtgcatgcctataatcctagctactcaggaggctgaggcaggagagtctcttgaactcatgaagcagaggctgcagtgagccaagatggcaccactgcactccagcctgggtgacacagtgagactccatctcaaaaaaaaaaaaaaaaaaagtatttgccaacaaagagagagcaccttccatgcacggagagagatatgaggagagaatgattcatattcaaaaggacagttgtttcggcgtgtttagagcatagggaaggagggagtctggcacaagataacatagagtttaaactatactataggcaatggaaagccttgggaaagttgagagaaggaacatgacctgagcaaatgtgtgcattcagaaagatgttagcttttgtatgaagggaaggaacacagtgaaggaaaccagtaaagggaaaggtagaacaatagtctaggctatgctgtccaacatggtagccactagccggatgtggctatctaaatgtcactaaaacttaatacaattaaaaattcagtttttcagttgtgctagccacatctcaagtgtccaatagccacatgtcttaaacactagggatgtagaacacgcccatcatcacaataagttctgctggacagcgtcaatctggacaactacacatgaccaacataatgtttttccctttgagaggatctgggaggtgtaattaagctgcatgtgtcaagcaattagaactttctggtgagaaggtatttgaggatccattgccttttggaaaacaggtgtgtcactgcaggtaaggtgggtttgtgtctttgcaagaggaagctgcaaagaagcactgcatttcacctcatgaagatgaaagggctagcattagaaaattacagaaattattttaaaaacagaccctactctccatctatagcctcatctatatttgacaccttctgaagtgcaatgctgccagggagatgtgatatataaatatgcatgttgttggtgagatatagaaacgacacccaaatgcatagggtctcaaactgtgaagatagttcatgcttgagctcctcctgcaagaggccctttaactggggccggtccaacagcatgccacccttccaataaattatgcataagagcttgttcacaattgggatagttttgccagggccatctgaaaacgatttgttttcaagaaaatgcttaactgggctttcgtgggttcagtgaagtgtgagtgaagagggcaattaggtcttccacagtaaaaataaaaacttaaagcgagatgatgtggaatagaacaaacccagtcaggctgatatcgtctcattgagaagacataagaggtcataatgaaaattcctcaggtgaggttgaataacctaaaactgaggtggaacattctctgaatctcctgcctccataaaggccacccaaccctctcttgtcaaacagatctctctcgcctctggggaaaagcatgctgaaacttcccccagtgacaattagacttgctttgaggaaattttgcctctttctgacttaaattccccaatggtaggttaagtttgttttcttgctgttttcttgggtaggggaagaaggctgactgaatcaaatgttttacttctaatatctgcccaatgcttataaactggaaaaaagagcaacttaaaaattgatcacgtaacataaagtatacttatctaaagccatcacacgtagtaatacaggatttctcaacctcaatactatcgatatttggggctgaataattctgtgttgtgggaagttgtcctgtgcattataggatgtttagcagcacccctgtccctacccaccagaagccagtagcaccccaaccaaaaagttcccacacattgccaaatctcccctagggagcaggattgccccagtggagaatgactgagctagtctgacattagcactaaatatagcctgctatcagaaatatagaaggtaggttaatagctttatataaatacataatatgatataaatacaaaatataaatattagaagtaaaatataaatacataatatatatctgtatttaaattttaagatgctgaccgggtgcagtggctcacgcctgtaatcccagcactttgagaggctgaggtgggcggatcacctgaggtcaggagttctagaccagcctgcaacatggtgaaaccccgtctctactaaaaatccaaatattagcctggcgtgatggtgcgtgcctgtaatcccagctactcaggaggctgaggcatgagaatcacttgaacctacgaggcagaggttgcagtagccaagactgtaccactgtactccagcctgagtgacagatagtgagattctgtctaaaaaaaaaaaaaaaaaaaaaatcagatgctttatttgttaggggtcattttgcattctgcaataatgattgatactacagtctccctacctatggtacagtcatgtatacacagcaggtgcttgtgaaccagctggaaccagtaagctgaaagtctcattatttccatctgggtcccttgtccctactgtctgtcaaacactgttctatgggctctacatataacatctccactcttcacaacaacatgtagagtagctgttaatatcatcagagaggctcagagaggtgaactgagttgctcaaactcccaaatagtagagtaagtggaagggctcagtctgctggactctgaattctgtgttctctccattcctcccttgggctttggaggaagataaaactggatgagttacaaagttggggatgaattacacagcacagagatagaaataaggcaggtatgaaggaagaaataaacatttgtaaaagacaattacgtattacatctgttggagcccagggttttatttggagcagggtagaaaatgagaatgggttgggtttccttaatgaaaccaactcataggtgaatttgagtgtaaggcgactctaggttgaggaatagcccattgaagtttatggcaatatgcaaacctgagttcaaatcttgattcttacctttgggtatgttattcacgtcccagagtctctatacttgttgaacaactgacagtgtgggtgataagtgtggaaggggtataagcaaaatcactgaggctggtgttcagcacatcaaataggctaaacagatagatatgctttggcttaacccacttttccagtggtggtgaatgcgatgagatggagacagagagtctagctggcattgttatcagggcacctcgcagcttctgcactagcaggcctggctgccatgacccagtgctccctcaaagcccgtggtgaaggcttgatgaagaatatcttgtcacacagccctctaaaagctgcacatgcagaactacacagaccttgaaaaacccgatgcactttcctgcaaaatattcttatggtcttaatggcaaggagaaccacgttaaaaaaaaaaatcattaaatgcaaacaaaaggagagcaatatcccaggtattgaaaatatttttatttgcatagaaataatgtaaatttttctcactttttgaccccttcaaaaataggggcttcacaaaccccaaagatttagagaaaagtagatactttagtcaagcatctgaataaatagcaggtattaggaaacatcattaggacaactgtttaaatcctcttgcttaaatgtaagtccttttgcaatacttaactttaacacaaaagccatgtttttattaagttcttgaagtcacataggattttaaagttttgactcaagttcttttttctctccttacaaattatttttttctgtgtgagtggggcaccatggttatttccaggaagaaccttgtttctgcccaggattaattacctcctctgggatgacttctattgtgcattccagaaaaggactcatgagtttgggattcacatcttattcatttgttagcacttttgtctaatgtggaacatagtaaaatgaaatactcaaggcttgggctttggagtcagatgacttgggttcaaatcccagctgtgctccctgctaacagcatgatgttaggaaagtcagttcaactaagcctcagtttccttacctgtaaatggggaagacagtcttactaagttcagagaaaagtactgaatgttaaaagaatgtgtatacatatatatatatatatgtgtgtgtatatatatatgtatatatatgtgtatatatgtatatatatgtatatatatacacacacacatatatagtaatatatatattactagaatacttagtacttagctcagttcttgaaataaagcaagatctatatatatatatatatatgtgtgataatgaggtcattgaacttattattttgaatacaattattcctagtactttttttgttactgttatctgagcatgtctctttgcttcatcaaatatcctgacatctcattgctacataaatcacttatgcattgcctacacagaacattctaatatctgcttgccattaatctgttgaataaaaaagaacccgttgttttaagtgaattttgggaattgatctgcaacatgccctctgtcataaattcgtgaatatattaaaaagggttgggcagagcagcaatttcactaataatatttactgctttggggatggagaggagattgtagtcctttggtcttggggaattaagtcaggatccaaatcaacttaaagagcaaaatggttctgtaattaagacaatgggagtgagagcactatggtttcaaccacagatggtgtaggataaggttttcaggtatgactgaaatggatgatgagtgaggacctggagcatggctgtcaaataagcactgtgatctgctacctctccccactccacgtccatgaaatttctaattgattatgtcactgtttcctgccaaatccagggcttcctcacagtccttctcaacacagcattccacacagccactaccaatctatcagagttagcacaaaactggctatcggtactttaatcaggaaaaaaaaaattcatgagttcaaactatcactaaattgtattcattaggagacagataaattagaaaaagttggattagtccccatatttaaggtcatggttaatccaatcacacagataattagtttgactttgatttacatggggatcttgaaaacacttacacacacacccacacatacacaagaccatatgagtttaatgaaaaagacatattgctgcctttgcctgtttcctttcgttttttaacagatcagttgaacctggttttctgtccatttgctggagactctatactcattcaaaatggaactttcaacatagttggagagtcaaggggcttcagcagtacataaagtgggaacaaggtgaatgtctatcacctggttacctgcccatgccacactgagcatttctgtaagaaatcaaaatttataaagtgagcctgtagaagtttcagttttctcccctgtactttggaacctgtttgtgtctgtacagatggtctctgtcagttggaatagtcaggggggaaaatgtagcataagtgaacaaaattagcaaatgacatagcaaacagaaaacagcataccagggctggcatgatggttcatgcctgtaattccagcactttgggaggctgaggcaggtggaggcttgagctcaggagttcgagaccagcctgggcaacatagtgaaactccttctatacaaaaaatacaaaaattaaccaggcatagtggcttgcatctgtaatcccagctacttgtggggactgaggtgaggtggaggttgcagtgagccgagatcatgccactgtgctccagcgtgagcaacaagcaagaccatgtcaaaaaagaaaaaaagaaagagaaagatagaaagaaagaaagaaagaaagaaagaaagaaagaaagaaagaaagaaagaaagaaaggaaagagaaggaaggaaggaaggaaaagaaagaaggaaagaaaggaagaaaaaaagagaaagagagagacagaaagaaagcaaacaagcacgaaagaaagaaagcacgaaagaaagaaagaaagaaagaaaaagaaagaaagaaagaaagaaagaaagaaagaaagaaagaaagaaagaaagaaagaaagaaagagaaagaaagaaagaaagaaagaaagaaagaaagagtataccatttgctgggggcagatctagggactgagaaatttccgaagtaatggtaggtaccagtaagcagagttgaaggagctcccaaaacatgggcttaacgtgggcagaaaaataacaggaatcagacaattctgtgatgcgtattctcaatacactgtagtaaccccaatgctttcattgtgttatgactgctcttctattgtctgtatttgtataaattaaacagcagctctctctgtactatatgaaatgaattcatgctgaacaaaatttcaaaaagttcatgtaaagaataatttcacagcaactatcatatcaggctcctggaaaattgcacttgaacttcagttccacctcagtcactcaaaggaatttaaaaattggcttccagccatccttgttcttcaacatgcagtttcagatatgcctcaataacacaaactttaaagcctattgattgtgagttaaaatctgttcctaccagagcctcgctgctaagtggacgtcaacactgacttcacagtgccttggtcaggattcctctgagttcaggagccttgaagaaggcagagggtaacactgctatgaaggagccactttgaactttataacaaaattacaagaaaaactttgaactctgtcggatgatagcggctgtaaatggttattcaaagaaatgtttcttatttgaaatctggagtcccttgggattgggagatgggaacgcagaaacgtgatctgctgtagatcactctccttcttttatgtcacttcttccctttttttctcaccattctgtttaggcaagcatcatgtaaatggttagagggtgaactttgaaatagttaaacccaagtttgaatcctggcctctgctgcttaactatctgtgcggtttaacctctctgggtctcagtttcctcatgtatgaaatgggaatgtgttatttcattttatgggaatatatgataattctaacctcaagggactgttttgaggattaaattagataatacatataaaggaactagcacagcgagtggcagatagttattgtgtaagaaacatcagcagttaaattactaattataatgatagttatttttgttagaaggagacctgggatgagggaggtattgattaaacattagcactgattctgatcaaactccatcgtgttcagtgtaccttttccagaacacccagcaagaaagtcatgccttatatgaatcccaaacagccatgaatgaatggagtttttcaagtcaaactccatttatcaactggtcaatttcaggaatgatttgtctccatttctattctgttactgtacaggagcccctaacatttaagctttaagagtatctcatctcctatctctgccacccccatcctcaaagggtaatgggccagtggtttgatgcctctgctgctgttcatcctgttttctctctccagaagtcactttcttcctctttggacgtttgctcaggtatcacctttcccaggaatccttatttgactctaaaccccaactcctacctggccaggctgaaacaagtgtctcttttctctgtccccacagcaccacgtcattacatgccgctattctgctttttatcatgtggcactgaaatgacacatttacctgtctgtctcccactagactataagctctctgagggcaggggtggtgtcttacttatttttgtatcctcaatgtctagcgaagtgcagatacattttattgaaccaaatgaacccataaatagcattaaattcactgaataatgaatcagaaaatacaattataaaagcaacaataaaaatggacattgatttgaggtgtctgctgatgtctctacatcagcagtacatctaaaagcaggaacacacatttcttctgtctcaggtacttcttacttgcattgcaacactcaccttgtcctcaagtttgctttctcaatgttctgtccttccttccacacccccagatttaggacatgtgccatgggttgcttctcttggctcattttcctgaacttcccaaatgagcaaaccagcaggcaagcaactgcaaaggccccaagatggaaggatgaagcaggcaaaagtataggtggtgattgtcctcacccagcaatttggctgccaggagctccctgccatgtgaaggagaggatgcagcagcctctgtgtgggaggacaacttcttgacccaagggccgctccatgtcactgagcaccttctgccggactggctgctcctcctcaaggctagagagtctgtgcttttctttgtccgaaaaccacagttatggtgtcccaaaaaccacataatgaagagggtggggacattggccaactctttgggatgccaatgcatcaccctttccatcactcttccacttctacctcaaactaatgagtctagttttagagtaccttatttttggtcattcattcagcagatgcgattctttaggaaggcattggtgatgcagggggtgaataaaataaacaagatgcctgcattcaaagagtagtaagggccatgaagaaatgtaagcagagtagttgcctagagcaggcagatgggcaaatttcaagaagacaaacatggaagggttgattgaagagaagaagtgagattgtgaatgttggcaaggtgttgtagttgggggttgggggtggtgtcctgcatggaggggacaggaagtgtgaagactctgaaggtggaatggcttggtgtgttcaaacaacagaaataaagatgaccatattggctagagaataaggggccacgtggaaagtcgtaagtgttactatgagagtgaggtaggagaggcagctatgggctggagtactcaagacaggtaggtcatcataaggagtttgggtttccttctgcaagcattgggaagtcactggagtgtgctaagcgggcgaatgatacaatctgattcctcaccttaaaatttcattctggctgctgtggaggtaggactgggacaatggggagtagatggattatgtggcaagaatggaagcagtgagaccagcaaggaggtagctcagagagagataatgaggacttagattaggactgtagcagaggaggtaaaagaaactggatggttgctagactgattccatttgagctgtgtacatggatatttctgctcatgtcctttttctgaaatatgcaactacctaaaatatgaatttagacttttggagaaacatcaaaccactcttttaaaaaagcacatctggagcagttcatttctttttttttttttttaatatttatattgtgagctggtttcaatgtaactttcttggggtgctctcgtgacactcattgctgacctttgacccctctgtcctctttcccaggtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggccccagcaagcctccagcagtggtaaggaaactccgtggtgtctgaatgtgtggtgtttcgtgagtgacattcttgattctccaccaaaatgacaatgctgaaacaagggctgggggaaggtggtgtggggagcatcagggtgaaatgcatttgtcattttgtggcatggtattttcaagatacatctgtagaaggttgaagttacttaagaggttttgcttatcttaacaggatttgggcctccttcagtggaaggcatttgcccattgctacatgtgtgagcatgctggtctcaaaggtgaagtgcagagagacaccggcatattgaattttgtattactatggttctggtcatagctgagtgaccctggacaccctcacaggcccaatttgtgtgtatctcagatccctggtttgttttttgttttcttgttgttgtttgtttgtttgtttgttttggcttttaacttctattccttgcttgtttagatgattttgaaattacaatgtgttccgttgacatcagtactgaatgtcttgccaagtctgaagtgtttggggggtgacctctcctgtaaccctttgcttgtgacctcactagaatttgacaagttggtggtgtggtactatggtaaatactgcctctaaatccatagttcttattttggttttctcattcatggaacagggaaactggacccaagatcctgtcccacttttgaagattttgtggccactgtcttagctcccaatctctgaatcttgggtggaattgccctgggcccagcgataatcatgccttattttgatttctcctgttggtgttatgttcctgtgaacatctgaacgtaggaacgggcaataactagagtataagtgtccatggcccagggagagacatttgcaaaaattaattactcctgacctaaaggcttgggagttatcttctgaactggtcagtcatgaggttaattagcatatcccatccaaagcaatacagagctttccatgccgagagtgggtcttgatgcgattgtgtttaggctccatccaggagtatatgccacccaccactggcctcaacctctacaattagagaggacctcccaaatacatttaagatgactcattctggaaatggaatgatggactgctacttaggatggcccatgcccttcttcatagccaggcctgatatatttagtaaactcatattctttttcaaaaaaaattacctaatcaaatctctcatcagatgagcaatccattgttgatattatgaaggcctttaatctaccataaatctttattagaactcatcagagcttctagtttgagagaaatgtgattatggcactcttaaaatgacattacatcattggggtgattggtttatcatttggagaagagacatcaatcataactagcataaccacacagtaaatgaattcaacctttctaccgcggaacaatgacactgtaattgctcaaaatcaggcttaaaatgaaatcggaaaatgctctttcttcaaatatgatgttaacttaatggaatatattatgaaaaatcatgtttgaggaaattctatataattaaaaatatgtggaaatatattccctttttactttcatcagaacctgattttagctacagagccctttttttgctgcagagattatgttgcatttaattgaactaccttcgcttatgttttgctgctttttatttcatactatgtaatcgtgatgaatattgtattatgaaggacaagaggcttttgaaatgaggtgcacctgctgatagctttttaaaaacagacaattattagggataaaatgagcttttaaaaactatatccttttatgcatatatggatacccaggcaatgatgatttccataagagaggtcagttcatatcttgaggccatctggaatgttttcttagcaataatgcagtaagtgatttcctttcttttggacagtgtatcagattgaaacttgttgatagggtatttatgtcagctttatgcctaatcaagacctcattttggtggacacaacagatctgtgtgttcagagtcaaacttgtccatttttcgtcactcacaccaatttgttcagctcacttaagactgatagcaatttaagctttagtaacaggagaaaatgccacagaaaatttaagggtccattttcatcccaaacaggagctgtgctgatatgatttcttcaactgagggagtgaaggcccaattgtgcaatacccttgttttcagcaggtacttattatcagagagtttgttaaagctccggtcaacaggcagtcattagaaattctggactctggcttagctaaaatgagagcaaatcgagttcgagtatgcgtgtgctcacgtctgtgtgtgtgtgtgtgtgtgtgtgtgtgtgtgtttcttgtggaatgggtttaaggtccagggcaaattggggattctatcaagatttgaatgcagttgtcatgaatttaaatttgacataaaggattgaaaattgagtttgacacggaagatgcaaagtgcagagctatgtctgagtgttttgaactgagtctgataaaaggggctgaatttttcaggaggtgtcacagcacaaacaaagtggccttgtgtttgggtgtgttgtgtttagttggttaattacacagaattttttaaatttgtctcttggcaataaccctgtgttctgagaatctggtactactttggtctttgtctctttcttaggtgaaataaaacactttccaacacatcagcccatacacgacagtaaaacattatttcctgctctcctcttatagttgctgttattatttgatgttggtgaagcccatcattaggagggtcacagtacacaattccttcccgaggagcacctgttctatagaaacaaatgggacataaactacaggaacgaaaatgtttttccccaacatgaaaaactcctcaaagcaacaacaaagcttcacctttatggcttgagtgtcattattttctatgacagtggtgcattctttagtgaatggtactaaaaccttgccacctttggagtcaaattgctctaaccctcaatctatgccaatcaagtagatacccaggtacagttagtgagatgtttacgggagtggtgtttctctcccccttaagcattttctttcaaatagctgagctccagcgagtggctcattctgtgttctgaccttctgccagagcgggttgctccagatatgtttcttgtatacagaagcataatttcaaatcctatggaataactcatctggaaaaaaaatctagatcccagcagcagcataatggaggcccctgcagatggaagaatgagactaccttccaaatcagaatagggtttgcagtttgctctcagcatatgatgcagaaaatatacaggcaaccacattatcttctaaaagcactggctttcctctacctgtgaaacattgaggttttttttaaagtttaaataaaggggctttgaacactcattagtagcatcaaactatacacataagaaatgtagtaaccaagatgccctagctaggacatcttggtagatcttatgtggcaaaagagctgtcccagtcagagagtctctgtttgtaactgagcacatgaagggtgccctaaccctttttaaagagcaatgccttagttaattctaaatgaaaatagtatatcaaaatcagcaggctttggggttgcctaggatcaataagttgcctgtctaatttatctggcatcataaaacaaatgagattcattcattcattccttttttgcacctccctcataatatgtaacagcttataaaaatcgttactttttttatttttgagacaaagtcttgctgatccaggctggagtggcgtgatcttggctcactgcaacctccgccccccaggttcaagtgattctcatgcctcagcctccctagtagctgggattacaggtgcacaccaccatacttggctaatttttgtatttttagtagaaatggggtttcaccatgttggccaggctggtctcgaactcctggcctcaaatgacccacccgcctcagcctcccaaagtggtaggattataagtatgagccatcacccctggccaacagttgttaaaaaaaatttttttcagctataattagatgatacaataaaggtaaaggaaaaatttaagggagaaagtatacatatatgctcaaatgtataaagtcctattccattatttaagatagagaacttgattttaagcttcctagcaaccaaagcaaaaagggaaacatagggaaaagaagatgcataataccccatgagataaaagcaaatcagtcatttcagggaaattctgggaatcctcacaatgaggccagaaagaagtttgtcataaaggagctcatgtgtgtatccagatgactggattcttagtaacatcatataatacatatgctaatttcctgtcaaaattccttgtaacctcccttaaataagacatagagcgcactttccatgtaaaaacaattctacaaatgtccaatatttgcacagtccaagggcaaaacttgacttgatcaatagaaaaaccttagttcttataaaggaccatgtaaattgcatgccctataggcaatagacctcaaatgtcattgctcataactgaatttttatgggaattagcagactttgaggttaaagtcaccattcaggacctgaaaagcagatgttctgtgttacagattcgtcctgacagcctcatagaggttagaattgacatcctctcatgaaaacttcaggacagcctccctcactcatctggcccctaatatccatccatggagatggatttgggatgaggaagaagtcaatatttttaacttaatgaaacttcttctccttatatatcttaggttttagaaagaaatttttctctgagatattgtaaattttcttgcctccctaagcagattatgcacattgtaatttaatttaatttaggattccctgaatagctcacagcagttattatgcacattgatgattgtacagtgctgataatactatcttgctcttttctacaaaagccattgtacatcctgtggttgtttatcccacttctcctaatgttctgcattgtaacttcttattgtgctctttatcagcttttcttcctcctcccagcttcactccgttcttcagggacctccactgcagtttctctggtgacagattcatagtagacactccgtaagtatttgttaaataaatgaatgagtgtctatagtaaccacctttatttttcactcttgattttggggtcaggatatcaagtgcaaacatcattcactttcccaagttggatttgtaccgcacataagccactttgactccaggttcttccccaagtcccttggatgtctggttcagacattcagagctacctgcggctccttcctggcatccaggcagaggtttggttccagctgcctctcttctggacaggttcttgtcccactgggtagtacaggctaagtccagcatgttatctttgctgtggaggtcacagaaacagccatccctcttgccccaaatgcagagccacacaggacttgggctatcagctcatggccctttttctccctcaactctagttagtatgctaagtactttacatgactttcttcatgtacttgtatttagtccctgccacctcccaatgcatgaaggattatcatcatacccattttctagatgacaaaaccacggcacaaagaggttaagtaatgtacgaaagtcacaaagctggaaagtgaaggatttcggcttcaaccttaaccttcctaattgcagagacttttctcctcactcctctgttaactgttaacctcagaatatttgtttggctgattgagatatacaacagacagtgaaagcgttgtattaaagggcatgggttacaattttttaaagatttcttaaaacgaaatacagcatcacaaaataccctttacgcccactgtttggcaaacacacatatccccagacacttcccctggagattctgattccctaagctcaggaggggctaaggaactctgcatttaccattcccttcaggtgaagcatgtgctctgacaagtcttggaaccattaatgtagtgggaagctctaaagtgaaagttggaaaacttgagttttcttcacactgctcctgattcacagcatgatttttgtcaagtcattcaatcattgtattagtctgttctcacactgctatgaagaaacacccgacactgggtaatttataaagggaagaagtttaattgactcacagttctgcatggctggaaaggcctaaggaaacgtacaatcatggcggaaggtgaaggggaagaacagcaccttcttcacaaagcagcaggaaggagaagtgcaaacaggggtaatgccagatgcctataaaaccatcagatctcatgagactcactcactatcatgagaacagcatgggggaaactgcccagtgatccaattacctccacctagtaccacccttgacatgtggggattatgggaattacaattcaagatgagattttgagtgggaacacagccaaaccatatcaatcaccatgaacctcagtttccctatctgattagattgagcattggcttaaaaggcctctaagctttcttcttgttctagtattctgtctctgtaagctccttgcatctggctggaccaagctgtcccaatgttagaggctccccaactcctcctctgtatagtgtggatttcatcccaatatctgggacattgtcaaaactaaggcctacacagtcatgcaaagcagatccttgtaacttacatgcaaaagttgagaagagtggttttggtatgctataacacttggctgaaaatgttgatggcaatcccatcaaggagagaaagtacagctccaccaacacaaacctgggctcccaaagaccctcaccctggcctcctaaacaaggtctcccacctcaataattgggaacaaatagtcctcaggactctctcggcattgttaacttgcctagcaatgtaccaaatagagatcagacttttccttcttttcctttgtgccttcttgaaacagacaaatactgcacatgtgcacgtgtgtgcacacgcacacacacacacacgtaaatgtgtagtttgtaggtccagcaatttccagcccaactagggtcaggaccactcttctgcaccatggtgcaaatgagcacacaatcaagatggacaggtaattcctttggagatgcacagcatggaagtgacagacggcagagaactgctctttctcagcaaataatcttgatattgacaaaattctcagggtcgataggcattgtgtacattctacctctccatttctgtccctggcttcttggtacatataaaaagatgtcctaggcaagcccagagactgggaactacaagtgatatcttaacagtttcgtgccctagtaatttttacccagaacttcagcttctcgcaaattcacttaaagagtacattcaattctaactagcttcctgcgtaatattcaatagtaatttttaaaagtgtccccagtcccttgttagggatgtctcaattcttgggttgaatcaaaggatttcattattttagcagtgggtagtttcaacagaaattatagccccagccctgggtacatctcttagacccatacccaaaataatcatgaagagtgtggactctgacgtccatactacatgctttcaaatgatagctcagccactttctaacactataatcttgagcaacttacttaatctatatctcagtatttttgtctgtaaaacaacaataagtgtctacaagtcctaaagctgttataaacatttaaatgacattccgatacatctaaataccgttaaaagaggcttagacaattgaagcaatgattgggtttgagagtacttgtttcctaatttaacaaacaatgttctattgtgggcaaatatatataacatgaaatttaccatttatactatttttaagtgtagagttctatggctttaagtatgttcacattgttatgcaaccatcaccaccatccacctctaaaacatattcatcttcctcaacagaaactctatacccattaaacactaactcgctttccctcagcccctggcaaccactattttatttctgtctctatgaatttgtgtctaggtacctcatatcaatggaatcacacagtacttgtccttttgtgatggatttatttcacttagcataatgtcttcaagtttcatccatgttgtagcatgtaattctacaggacagaattttcttccttttaaagctgaaaactattcaattttccttatataccacattttgtttattcactcctcccttactagacacttcggtggtttctaccttttgtctattgtgaataatgctgctaggaatattggtgtacaaataattgtttgagcacttgctttgacctcttttggatgtataaccaaaagtggaatcattgaatcatacagtaattctatacttaattttttaaagatttgacatgctgttttgtacagtgtctgtaccactgtacattcccaccagcaatacacaagggctccagtcactctacatcttctccaatacttgttaccttctgtgtttttgataatagctatcctattggtgtgaaatggtatttcttcatggttttgatttgcatttctctaatgattagttcttttcatgtgcttattgcctgtttttatatcttctttgaagaaacgtctattcaagtcctttgcctaatttttaatcagatcatttgttttttgttgatattgttgagttgtaggaattctttatatattctggataccaattgcttatcagataggtgatttgcaaatattttatcctattgcataggttgtcttttcattctttgatggtgtcctttgatgtgtaaaagtttttaatcttggtgtggtccagtatatctatttttacttttgttgtctatgcttttggtgtcatgcaacaaatactgttaaaggcttattctatggcagccattgttctaaatttttacaaatggtaattcatttaatcctcaccactgagaaagtgaaaagcagctcttgattctgggaacagacctgacaataacatctaggcttaggtgcattaggagctggcttgtcactcacaactaggttgtagtgttctcctactgaacataaacaattttacagaacccaagcacgaggccactccatggctgtggtgacatgaaataagatgacaagaagaccacaccatgatcttgccccaatacagacaaaaccaaagtcactgtccaaaaaacaaaaatacaaaacacccttctctctaggctaaaatgggtgattactggttttttgttttgtttttgagatggagtctcgctctgttggccaggctagagtgcaatggcatggtcttggctcactgcaacctccgtctcccaggctcaggtaattctcctgcctcagcctcatgagtagctgggattacaggtatgtgccaccacgcccagctaatttttgcatttttagtagagactgttttcaccatgttggacaggctggcctcaaactcctgacctcaggtgatccactcgcctcggcctcccaaagtgctgggattacaggcatgagccactgcacccagcccacaagccctttctaacattcttactgaagctcccttctggctccccttgtgtgtcttctccctcatagcaatgagttaatcaactgtgtttggccacagtgtgctcctgcctggtggtgttttggctagaggacatggacaccattaagctgtgaattgggattattatccctgttgtacaggtgggaaaactgtggcacagtgaggttaagtaatttgccataggatacatagttattaagcagtacaagaacttgacccaaagaaactggtctccagagtgatatatagaaatttaagtgaatttttaaaagacaattccagaaaaaatatatatattcaagaaataaaatgtagtcatcatttaccgcatggcccagctctgaatagcatttacatggccacagtaatgtaaacattgaataatgacttagctattaaatcagaaggatgagaggatatgtgggctgggcagatagaggaaaaagccaagacctgcatcttttatagtaagaagttacaagataatgcaagaagttactaaataaaatggaaaatgcaagaaatagcagcaaagcatgttatttatagaactggagataaataccaaaataattagctataaaaaggtaaatgtggttgctgctgggaaggaagaaattggcggtgatagaagaagattgctatttttgaactgaacgttatagaacgatttaattctttaaaccatgtgcacttttttcttctgatgaaaagaaaacatttacatgagattgggcaggcaaaacacttagtacaatgttaaaaccccaaaatagtagctgtttacttctctcaaatatattttattcaacaagtatgtattgatcagggccgatgtgtttgaaatgacatcaggtgctgtgaacctcagtagttaggcattggagcacttgcgtcaaacccacagatgggtctgtatctgcctctgttgattagggagccctgtggagttgttggggctttagctctttttcccaacacagcttaggatggcatgagaacagagaagatatcatgactactattcctcctcatttctaatccagtgtccatctaagcacaggtaccatcatttcctcagagctttcccaaccaacactgcccaactagaacttccctttttcagaattacagaacagctttatagtctgccttattcaatttagcacctcattgcattctgatttgtaatattctcttggcatttcatgcatgtaagtcacttgtgtcaacattaaattgtcaccacttaaagacaagggtcatttctttggtctttttgtgtcccttagcacatggtgcaggtagagatacgctcaagagctagatccttattgatctaccttaagaaggacaatgttagagtggggcaacaaaaaggtggcagcagcccccacccagtccttcagatttgggcctgttgactgcaggtcactgtaacatttttagatctgagaccatctgtgattgtggatgtgatcacatttagaaagaacagaaaaaataccacagggcatgatgagaaaagaagtgtgtttgtctaacctgcgtcttccttgggaaggacagagaggtgtgaatccaaaataacagttctttcttcatttgtttagtagctgctgtcctgagttgatgttgccttggaaatagttgctttcattgataaatgttttgtagggtacagctacaatcctagggaatgcatgcgcttagtgtatggattcatttgctggagctgccctaacaaagtaccacgaactaggtggctgaaaacaactgaatattattctgtcacagttctagaggctacaagttccaaaccatgctccttccaaatgccctagggaagagtccttccttgcctcttctagcttgtggtagctgccagcaacccttagcattctttggttgtggcagcataactccagtccctgcctccaccttctaatggccctcttctccctgcgtgtgtctgtcggtctctaactctctctccttatagggataccaattattgaatttagggctcgtcataattgtggataaatttatttgaattaagtctgcaaataacttcacaagatccaaataaggtcacattcccagctatcaagagtcaggacttcatatcttttggggaaacacaattcagcccacaacagaatccaattgaatactcagcaggatagagcaactagaaatagctccctatgtcttctctattattgaacccaccatgctcgttgactgcattcaccattagatttaagttctttgaaggcaagcaccctgtttcccttgtgtctcatttcgttctatgcatttagctaccactgagcctggcacatagcaggtgctcaataaatattaggtgaattaacaaatagtgcatgcagtcaaaggatggaggaaaggtatgcagagggtatttgcaatatccaaagaatggtccaaaaaaaaagtggaggcagaccctttctcacatgctggctccctctatctgcagtaggagagacagagaatgaagaaggcatttctggatgatggcatagtgcaacatgaatggcaaagaaagccagaagcaaacagagaaaaccaatgtagttaatatttaaactctagaatccaaataaactagttaaacatagaaaaactgttttgtgtggtgctttaaaattctagctcaggcctttcctttgattcccccagggccaataccagctctctcttttgtcatttccatcagatcttttgttttacgatttctgttgcttattatccttattcctttctggtgtttataaagccaaagatgagggggcacatgcattcttgatactgaagcatttaggcggttatcacttaaattaatgttttctgctagagttatattttagtggaaaacagtaattgtttctaagacagcatcttggagttgaaccaattctatcagtgaacactcaaccatgggaagctaacaataaaatgcagtgatcaatcgttcttcttttctctcttccactccaaaggcagacttcacatctctttgctttaaaaaacaaaacaaaacaaacaaaaaaaccacacaaaaacaaaaaaactaaactgatgatagagcacctttttaacacttcagcagaacagtttccccatagaaaatgacccccaaatttatctttattgcgacttcccacccctcaccctcacttagaatttacaaagatgcctttgcgtaagttataaccttgcaaacctctgcttttgaattgtgttgatgtccactgtggacggagggctgtgggacaggactatcttcctgcatgccagctccccgaataattccacgatgcaattggtggcattcacacttgactaggatcgcatttcaatctgttccatctgattggataccgtgttttcttcccgtctgtggtaatggagcactcgttcccagttcccaaggttattttcatctcaatgaccttttgcatctccctggggagcctgaccattacccacccccctttcactctgtctgcttagaatattgctttacatgtcgctcttcctgtagtaaccactgtctttgatacattcctatcagcgattttgttcctgtgggagcagtgatctttaccagtttgtgactctccctctttctctgtgggttcttctcgtggtcttacagctcagttcaagcaatttgcttttaaagatgaaaagagataggctgggacaccacctgtttacgacattaggatgctgggtttctgatttcttttgctaacctgcgtgccttctcgtgaagactaaaaactggttagaatataaaagatggaggatctgttgtgaaaataattcacagggaggggaaaaagtcatattacactaggcagacttggccttttctgccgctctttattgatctcaaattgctgaaagggttcagaagataaaaagaatctgtgaaacaaagaaaggaaaccatggtgaagaaagaaacggccctgatatggtggcagccagagaatccgtctgagtcctaattctacccaaaactcacggtgtcccctgggcagacccttctcctcttgggccctctgttttgtcttttgtagtgttgggaggctttgagtcagatgttttgaaagttcttttccaactttcaaatatcatgattctaggaaaagactgagaactaggcacgacacattattccacttccaatgatgtgctgagtcgccgaatctgtcgcctctctttaaaaacacacagaaacaactttttcctcccaaagggaggaaactaaagctgttgcccctttctggattggtgatgataatgatattaaataataatcatcatcacttatgtttgtgtaatattttctatttcaaggaacaagatcatgtcctttcctttaggttgcaaacatctgacccttggtcaaaggagcttgcaaaccagtttgatttgtcctgcttggtattatttttaaaattatgctttatttaggtgacaatgttgaaaaaccaagagacgtacataaacattcataattctatccttcctgaaataataacatgcctagtaatacctacctgcattatgtcatggccacaaatcactagagtccagtagagactgcccgtttgagatcaggcatgatcttttaatttattcatgtatgagatttgcatggcctttgtagcatttgtatcttcaatctcagttatctagcttgttggcatcaatgatgatgataatgataatgatgatgatgttaccactgctaatgtcattaacaataatctccatctccatgttggcacaccatctttacttttaggaaacactatcatgtgtattacctatttaaatccccactacaaccatctggtgaggaagatgtagaaggtattattatctctacttaacagataatccatttgagggataaaaatttcaagtgacttactggtggaccatatttagtctaatgatctcaaactttccactatcaaggtctttttaaattttcttaatgtactctatgttttgtaggacttggtctacctattcacatgtatttaaaaaaaataggttgtttacttattttgtgttacatgaagatatatagatagataggtacctctaacctctactctcaatgatgtatttgtttaccaagtacagttgtaactgctaatagacaaattttgtggttcctttgcacaattactctcttttttgtttgtttctttgtttgagacagagtctccctctgtcacacaggctggagtgcagtggtgcaacctccactcactgcagcctcagccttcccagttgaagtgattctcctgcctcagcctcctgattacaattactcttcatttcagtgctttcctagctggacttcttaacaagtacatacaattaggaggaaggaaagcttaagtgggccatgaaaaggtcaggtgagttttagggatcctggacccaatatccttattacatagctggggcttatgctgacccactaagatcagtgctaagggagttacaagcagaattcaaactcaagtttttgttactgtttttatgtttgacacgggagtatacagcatgggagatcacctcacctctggctctgaggttggtactcagaagctgtggactgtcagcatattttgattaaacacctatcatgtgtccaccatgtcacaggtgctgggcattgcctgggtctgaagatctatcatcgcatctgagccaggtccttggcttccttctggcattctgtttgacactgatgagttctgagaccttgctggccttgacttgcccacttcctcacagcagcacaggctcagcatgagatcctcttttccagaataacccagagacttcctggacttgattgagttgtagcttgctttggaaaagattccaacttttacaaagtgaaatttcctatgctaagcaaactctatttatattttattgtattctgttgtcagatgctgcaagtacttgaaaggagcttgtgatataacatattcttgattgtaatatagcattgtaagcacattatggactgaattacaacatttcatgagaagaaaagagaagtgctacattaaacgtacacattattcataaagcttctaattccaggaaaattaaacttgaaaaaattattttccagaatggatgatctgtagcacataggttcttataagtcaaatacagttccttataaatacatggaagatatgtgcccaactcatatgcaggcctagagtagtaagttttgcacaacctgaatcaaattaggtcagtcttctaagaaacattcccatgttacaatgcaaccaaactttaacagggcctctaggcagaggagtggttttcctctcttgggtggagaaccaaaaatgtagcactcttcattgtcaaggtgtatagcaaagcatagatcatgaggggagagcttacacagaatggcatggcatatgccatccagaatccactgtgcagctgcttagggataggagtgtttccattttcaaaaccacataagtttcagaggtcaagcttagcaaagcagcttgaaaagtgtgtacttagtaggcttggggaaaagttggaagcccatgccctcattttgcctcgattatagttctgcaaaaaccctctcttaagagctccaaagtctatgccttattcccttccccatttggactattgttaccctgggcaagttctttaattaacttctctgtgttttagtttcaccatttataacacagagataattatacttcaagataatgtgtggaaaaaaatacctctccattgcacaatgagaagtggacatgcaagttatcatgattgtttattaatagcaataacatcccacatgaacagtggaatcagcactcttccccacagaactcagaacctttgtcctgattaactcattatgactgacattaactctgagattttgctggcggcaatgtggagggagagtattaccttttggctaggtttcttcttgtcctgaggtctttttattcttcatcggcacctcctgtaagtaactgggtttgggctgctcagaaattcctgtctgtgataaataagggaaatttcagacaggatggtaactccatagctattcaggccaaagagttggtagaccattaaaaacaattcacatccttcatgttctgggtttaaatatgcatatttccatggtcttactccctccaaaattggtcagaccagttcaaggttggatgacagatgtgagcaaatcagcgtcagacaagttgagcagactttaacttcctatattgtagtagaaaattcctctcataaaacaacgaggcgcacgtatcaagacccctgctgtgtccaattagacttctttaaaaaggaacaacctctttaactctgtgagtttctgggggctgtttatcttttccttttggcttatcacaactcttaaattaccttggcatatgcttcgttgctagtattttcttgtattttctttttttccgttgccacaggaaacaaacaaaaaaggtttttttgttgtttttttttttttagtaagaggcatttcaagaacgtgttagagggagaaagaatgttgcttaatgaaataaagaagagataatttccaaacgcttttaaaactacatagtaggacaatcattcaagtatgggatgcacccttaagcaagattaggtcttatgggtgacagaggaactaagtttggtgtgtcagccttgatttcttattaccctagttcctgcgcttcatacaaatttaagatccaagcaattatgcctaacgtgctcttgaatacggtaaaatcatgcattttatgtagtcagtaataaaaatactgcagtcgtttttccatccaaagatacagtcccattatgaataatgagtcctagaaaaatatagcaaggtagtccaatgcggcagcataatcatttatgcatctaccaaacctctttcacagttcaagaagtttaatagacgatcaattccttgagggcagaagctttcttatttatctttgtatctttgttacccagtaagcaccattcctggcacatcaaaaatcacagatgatggatggatggatggatggatggatagatgatgaatggagaaaaaatacttccctcttttggtctttgaagtttctgggtattaccagtgaagatacagagtatagggcaaggttctcatacctaacaatcaggccaaaccagcacgtttaataaaatgttttttcattgcccttagaataaaacccagatcgtttattgtggctagtgtgatgtgatttggccacaggctaacattcataacttcagctccttccattctccttttctctccccactctgtgactagacttctttgcattctttggaaacatccaaactctttcctctgacagccttgtacttcctgttccatctgcccagaatctttccccctatctttccatggctggtatggtcattcactatactcaaatatcattccttggatacccctgccccatccaaatttgttcccctcctccctttcagtatcctcaacacccaacagtgccctgcacttagtatgcactccataaatatctgttggatggttgacaaattattgtgcatattttgcaaatatttaatgttactattgtatatttaacttaaaaattactgaggtttttcttcttcccaaactccaattaaaaagcaaacaaccaaaaactcaaaacaaaggtgaaaatgtttcttttgttttattctcgtaacttactagaagctaagaggttgcctcttctactcaccctggaaagaaggaaggaaggaaggaaggaaggaaggaaggaaggaaggaaggaaggaaggaaggaaggaaggaaggagggaaggaaggaaggaagggagggagggagggagggaggcagggaggacggaaaacttagaaaagactgaattaaacaaagcttaagaaaaacagagtcgtaaaacttctcagggcctttaacatgtttatgtgaactgagactttctattagaatagaggctttacttctcaaagttatttgaccagagagcatttttcctcctcctctccctcctcctcttcctctccccctcctcctcttctcctcttcctcctctccttccttcttctttctcagagtacttttgagactaatctttgatggcatacattttgggaaacaataaagtaggaaccaccatctgctgagcattttctgtgccctaggcactgtactaggcattttaagtttgtcacttgctttggttctcgtcctttcattaatgaaggaaatgagcctcacagagtttagctaacttgaccaaatgcatgtaaccatcaaatcaagcacagcagctacgatttgaaccattgctgcttgattccaatggctttgatcttctcactgctatgtactacttcgcaaaatattacttctaattaattaaaacagaggttctcactctcaaatacatacaaagcttataaaatacaaactcctggaccctatgccagatttatttaattcactatgtctgagttgggatccaaaaatttgcatttctagcaggctcccaggtgatgcctgtttctctggcctggggcccacattttgagaaccattgacttaaagccctgcgattcctgtttaatgatctttgcaataatgttattagaagcttaagaagctgaagactttttcaattagtttatactgcctttgttaatgcagagaactagataacagggagctcaacaattcatttcaattccacaaatgtttattgagcatctactgttatagacgttatgcaacatacaggaaatctgagataactaagaccaggtacttggccttaagggtactttagtctagttaatggcagcatgaggtggatgaagctttaagaagaacaaaagcaaacagatggttgtgagtcagcaggtcaggcagtctgatagatgtcgacccagtgccagcatggcacatcgcggccctccccacctgggctagagctgggactggggaaagccttcccacagagatggcacctgattggcatcctaatcatgatcagtagtcagctggggtggaggattttaggaaatgccagcagcaagtgcaaaggcttggagagacgagaaaacatggggcctttggggaaagcttgaatagctaaaggaaagactagcacacagatgtgtccagatttaggttagcagaggggaatgactggattgaggctggaatctggctgtgaaggcccttgtctgccttccgtggattatacacaaaagtcagagcaatgtttaagagaactcatggttgagacatgtggcttccaaccattcttcaggcatgcattcctttcataaataactttgcaaccctactggctgatgagggcggtacaaagaggattgaaacactgaatctgtcctctaggaagagaaataaaacatttacaatctaaaatccaatacaaaggtggaaatgtgcccttattaaaaagcacggagacataggaagaagtcctggaacagcaaagagggaaaggtcactccatttatgataactctggtaaaagagtcaaagatgggaagcaaagcaggtgccattatcaacctcgcaatacctttatggatatttttacagatggttctcttagtcacctcaaagagtgccaggatagaagctgggaagtggaaactccgaaagctgttagagaggaattgcctttagaatcacgcttgctttttcctcgttgctaaaacgtccagaaaatagctagcatgtgcgtttccccagcctgattaaagagtgcatgtgcaagcctctaaataattgctgcatgaatctttataaccacccgaaatgagcttaactcggttggtctacgatggcagaaaggcttataatgtgaggctcatcattctatcacgcatcaaagaatgggaggcagaagccctgttccattctcccctcgcttcctgattaatccacacttttagaatatgagtaagggctgactgatgagctggtttagtttagctttgtaggatttttcctccaatttagcaagcaatgaggacccgcactatttctactctttcatttggctcttaagtctcatttgtgccattagctgaactggtaccttttttttttccctcctgctcagaattcagagacttgtccttctcttgtaattataaagtgctcacaatcaagacagccctggtaaacttttctttttggcacaaaaacaatattagctaaagagctggttgtaacacagatgcttagaaaaagtaggaaaaaatcaggtcttaaaaagatttataaaccccattccagcttgtattcatcatcttcctttcttgctatacaccctggagaataaaggatgctatttacaatgatccctgtcaggagatgttgaatacagacttatctgcctgccaggtcacaattacctttaaaatctaaatgaaatgaaggaagagaaaccgcatttttcccagtaatgggatattccagccatagtctcattggcacccacagtctttgcctcatttgtgagggctgcctcaggtttgtcaaagggtccttattttagaagaaagatatacagatatatagatatatagattgatagctaagtaggtagatataggtaggatggtatggagagaacgaaacagagaactaagtttatgagcctgggaatttcagttgggtaatccgtagtaaattgttttttttttttttttttttgcatctgctgggcaccgggtactaccttaaacattggaagcagcatgaactccagccccttcgtggtgggcaaagtgattggagaggcaagagatttgcacacagaagacatgacttccccctacctcctgctgatctgggtttgtcattgaagagccctttgctatagcattgcttaggactccttagtttactcaaacctaatgaaatgtggttttcctctccataaaccacctttggatgttgccaatagagagaataatttactgctatggttctcaaattttggtcctcacagacaaacaacatcaccagctcctggaaactagttagaaatgcaagtcctcagcactctacctctctcctttccctggacctagggaattggaaattctaggggtggggcccataaagctgtggtttaaccagctttccaatgagtctaatatatgctaacgtctgagaagcactgatctagtagcttggacttgcttagctatccctttaagcttaaattggcagcctaggccagtcactggaatcacctcaggagtttgaaacaatgtaaatgccgggatgccaacccagaaactctgatgtaatagggccaggcagcagcctggacaccacagtgtttaaaagctgcccagatgctcttgagaaagagttcatatggaagcaagtgtaagaggagctgggggagagagactggagatgtacagatatttagttgattactgcaagacctaaaccaggctctcagcattaaggagaaccttgcctaaggctaagtcactgggtataggagttgccagggacttcatcaggaaagaaggtagagagccataggctggatgaatgtggagggaaatgagaaggaggagtcaaagatagctttgagttcttgagcatggctagtgtgatgagcccttcttaggaaaagcaagaatggggattgggagggaaggagatcttcgtttgagcgggggatgggaaataaatttgaatctgaaaaggcgtggattggctcgatggtcatatccaacagacagctgaaactttgggtctggatttcagggaagagaggcaagagggaagaaaagaatggaagggaagagaagatagagaggaatgaagggagggggaagaagagacaatgagaaacactgagagagattttgcatttttaaagcctgtgacaagaattccattactgaaagaagagcatttgctgaaaagagaaaagaggagaaagaggaccgaacctccaataatgcctgcatgtgcaggggaaaaaatagaaagagaagaagaaagcaaaaggggcaagagttaggagaagagtcacgttaatgtcgcattatcaaagctaaagaaagagtaggttgggggatgggtgcaggaaaggtcaattgccagcaataccaaacgccaaagacaggcaaggagggtgagatatttcaggcaagaagaaagcttgcaaagtcatcatgatagcatagtaataataacaataataataataattggtgttcacaatggatttatcgtgtgccacgctcctggccaagtgccttgcgttaattcaacaacaactctccaagtattaggtatccccattttgcagatgaggtaacagagattttaggtaccctgcacaaggttacacagataaaacgtggtggagtgaattcaggaagtccagctcccgagagacacctgacctctctgtggaaaccagagtgactcatttagagggcaacactcagtgtgggtgggaaaaccagtaggtgccggaaatctctgtccatgtggatgaaaacatctccctggttgttccagacagagttctattgcacaggaagcagattccctttctggagtgaatgttgctgggcacatgaccaagtgcccattaggatggagcgaaagaacggcatccgactcttacaaaaagttgacatctgaacaaagagaaataaaagcaagtatgttaaattaatttgaaaggtcttgtttaaatccactcacgcaaagacgttctcaatttaaggcttttattctaccctaacctcagttagttagtgtggcagctcagagcacattctggatgatgccaggaaaaattcatttcacacctgaaatgcttagatctcatgccgtttcttacagtatctttctgtctgtgccctcaacccactaaaaaaaaaaaaaaaaaaaaaagggggggggggttttggaaaggaaaggaatgatatctttctccggaaacattgcactgaggcaaacgttttccctttggtgcattaggaagcccttagatgagagaagctggtgagctatgaaacagcattgggacttctcttgcaattaaaaaaaaaattatcaaagcactttccatacatgaaaccaccgtcagttatgtgggggaggaattattatctgtgtatcatgaaggtggaaattacggtactgagaggttaaatgatattcccagcaggcaagagaagaaacttttccaggcttggcatgaggacctctctgtttgtatatgtgttcccattagggctgctctgatgatccaaataaaagttgggagtgggggtaatgatttataagcccaaggtttttaaaacatcatttctcatgtttggaagtgaaagttggctgtgagaattcatcgaaaatgagcctggatagatgaggctgatgcagattagtttttgaagtggaaggactggaggattggccttgttttcaaacggctaattttcttgttaatcactgcgttggttaataaccacctagttatgaccgtggcagagaaagactgtctgaaataggtcaagccttcagtcagcctggcgtgtcctgtcttgattgaaggctcaggaagcaggaagactggagtgattggggtgggggggtgaggtgggattgaggccttgagaggagacagcagtgaccacctgggggacttttctgtgggagattgacaggactggatgtactcctgaggagtcctgcggggtgggggacaggaatgtaaaaaaggcctgagatgtcttttttggaatatgtgtgccttttaattccttgaattttttttcattaataacatgaattagatatgttttttcctacattctaagaacacgacagaataattggaatatgcatgtgcaatttaagaagacaatgaaaaccacccaaaattgaacacccagagatgatcactgttacccttttgatatataacttccttttctctttctctttctttctctttctcacacgctttttcagtttatcttaataggtcctgactgaattgttagcacctaccacggttcctagcacatggtagatactcaataaatgttgatgtaaggatgaaaaaaatcatatttatgatttgtggtatagaattatataataggtattacctaattctagatcattacatatttttacagttttcaaataccaggctgagctattacctaaggacacttctatcatatggaaacatacagcaccatgaaccagcacgcagtgacactgtggtctagagtttgggttctgaagtcagtctgcctggattggaaaccagactccaacacttaactagcagttcttaatctgtcaagtaggagcaatactcataacatctcataacattattgtgagaaggaataaattagtgcattgaatgggcctagcaccacacctggtacagtcataattgcttggtaaataatagttattgatattatagtatgtttttaaatattatgctagagcaccgtattaatgttcttccatcatgctggcacatcgcaatttttaaaaatctacccccttttgacaggcatttttgttgcttcaattttttgttatgtaaaatactaaatagatcctctttatataagaatttatttgcatatctatacttatttccttataataaaattgtagaggtagaaatataagatcgcaggcaattaatctttttataactttatatgttgccaacaaaatgtgatattagcatagaaagcaacggtgtatgagcgagtctgttttcccatatcctaagtaatcgtcctatcctttgcacattttatgcaggctcattttgaggagcaaatccccttccatttcttgaggccatcttgggttaggctaagtggaattctgccaacatgcaacagatttttaggagcaggttctgggtgtttgtgcatgagagtggagtggggagtggggtggggtgcatgggcatgtaccctctgtcccaagaagctgcagtgagtatgaaagataccagactttcaccctcagtaaatctaaacactcaaagcaaagtgtaaaaagtgctcgacaactgttataaaggatttggaaactgtcttctcaaggtgtggactggggttggaatctggaaggctggctggagaaaagaactctgcttctgtcattggtgcagttggttgccttgtcgttttaattaccttactcttctcaagatcagattcaaggccaatccagcctcctcggcccctagcttctgcctccgcgacacagataacataactcacttcctaactcacttcctggggctgccccagcctaagaggattaatccgtcctatggagttacctcctcaggaggaaaactgataagacggttgtaaaactcctgggagaaatggaatgagttgtataaataaagtgttatggcagccgactcatcgagaatgagacccgatgtcacttaaatgttttgtcactctctgtatcttatgaaggggaacctgttttcatattgcaatacttcagctctgcctggaaagtgatcgtgtgtgacagtttgcttttgtactcccccactttatataaaaggagcaggacatttaggttggctgtatttgttctgaacaggaaaacaaatctggcatttttacatattattctgtactcctgggaaaaacagctttgacagcctaaggaaaaggcagttcaaatggtagtgattcccatgaacgttttgttgcactttaagtaaatctaccataaatgataagtatttgagatgatggatacattaattagcttgactcaatcatttcatattgtatacatatatcatagcatcactttgtaccccatgaatatgtacaattataatttgtcaatattcaataacatttcaaaaacaactagaaaacatatatataaaagatgccttcatgcaagaaaagagtaaatcttatatttggctggatggtgcatccattcagctaataataattgtacacctaccccaagccagcactgttataagcattgtgagctcaagagtacccaagaaagatgtggcctctaagctcacgaagcttctcttctaaagtgaaatttaagattttggagtaataaaaatataatgattaccaatgtgagagcgatgccagaaagagacagggtgctgagctagacaatcacatgaagccgcctactcaggtagaatggaggaaaaaaaggcttttgaggtgacttcttagctgaaactgaaaagtgaaatttcggtcacccatgtgacaaggtttgggtggctggggtgggggtggagggtggaagggctattttcaggtcaaggaaacagcagggaaaaggatctaagacaagaagcaggaaagttcttggttgtgttgaggaactaggagaaaatgtgtgcagctccagtgtaaccaggcagatgagaggagtttgaaaggagacagaatagtaggtggatgtcacaccagcagcatcagcagcatctgggagtttctcagaaatggagaatcccaaccttagaccttctgaattttgattatcaagtggttcctgggaaagcacatcaatgttggctaagtgctgatgcaagccatggcaagaggcttgggtttgggatttcactgcagtggaagttattggtggatttaaaatgggatgtggtgtgctcaaacacgtatttaaatatcactctggctgaatagaggattgcagagtggcaagaattgaaatgggggactagttaggaggctgttatagtaattcatctgagcggtcaatttaatctagaccagatgacagagaatttccaagcattgctatgtgcctgggaaggttgtctgctgtctcatggttattggcaagcagaaaaatatatgcctatttatgccccccaggcaggaaaatagaaaattgtttcccctaaattagatactttgtcttagaactcttggagagtcaataccatcaaggggctggattagctgaagtacactgtgtggttaggagcatgggttagaggatcatcagagctgcatccccacctgccaccccacatcctacctggacaatggtgagcaatcacctagactctatgtcttggtttcttcattggtaaagaagggataaagatagtacaacactgctttccttagtacattgatgtgtgtgttaattaagaaaatgcacttaactagcaaagtaatttaataaggcctctataaatgaagctattaatattagtaatattatttcacaataacaataagtacagagtccctaccacacgctggatactgatcgagcttgcatgcttgtatgagttacaatgcccagccccgccccacacagagattacgtgctaatcagaaaacagcatcagaaagtgattaaatccacctttttatttattttttctcatttccccctgtgtctgtcttgtattcagaaaactcagaacttaaagaaagcccaatgtataaaacattttttaactcccaattcatagacaagttaacttaacccataaggagggtgaccaacgctgccagttctctgaggactgtcttggtgctgacactgaaaatgcctcatctcagaaacccttcagtcttgggcaaaagggacagttggtcactttgactttagggtctgtggttgagtcaaaagagcttctttctctcagtttaatagccacagagtacgtatgaaatcttggacaactctttaagcttcaggttctttatctgtaaaactgacatatatatttcaggatatggttataggatagtcagacagcatttcataaaacacatgatcagaaatgttgagtccaaaaatgatctcacggttgcaactattattactagggcggttgtatgtggaaaaatcagaggtaaaaagaaagaaacccccaaatgcgaacataactgtttcctagaaaccctctgtcgatgtctattccatttcccgacagttcggaatacacaggtagtctaaaaaaatcaactttcaacctcatcgttttgtggctgggaaaagggggaaataggcactatttagaaggtatttgggatagatggagttaccacgaatgaatcttcattgggatgggagtttagacctgttgaatgaataaaaatgagccatccttgaagatgattatgagaagctaagttcataccagctcgtaacagtggcacgctgtcagtagctgggctaaggctgagatttttcaatgagagcatctggcttaaaaactccacaggagggggctaggggtagaggaagaaaatccaagaaatccctatgagacctttttaaatttagcactcaaggcactaatataagaatataccagtgtgtggatgagaaaacgagggagtctttacaaataggagaatttgggatatctgtgtttgagaaattcttttggacaaaagtggagaaaatgacattatctgtaattagaaataataatgtgtaattggttcatttgccatatttctacagttctgatttagttgaacaatgtgatcattatgccaccagctttcaatagaggtgtcacaatgaaaaataattgcaatattccacaatattaactgcaccctaattgcaaaagttttgaaatataattaccatgaaagctaatgcgacagggaacattaagcataattagtgttttttaaaaaaaggaaaaactgttaggagcttgttattgtctagtaaggtagcttcaaattagctggctgtagagcactttcatctagcttttctataattttcattattagcacagactgtaataaatttatttgacatagctcacacctgccaaccctgcaggagataacttataatgtgcgccagccccaagatttcccactgaacctgtcagagcttcctacaaggaggcagccaggagtgaggttattttaaaaaaaataaaataaaataaaaaccctcaattgcacattacacagttcagatttaacacttaagctgtgttttaagtaattttcatagaaagccaatgctctaggaatgcaattaagaacctcttgtgggtggtgctaaacaatcaaatcagtgaacatttcaaagaactcctaaggtgcaagcctgctctccagtgactagcaagccgcaccagggagctgacaattagcccgtgcacctgtttgcccaagtgcagcccctgattttctgagaaaggcaccaaccctgaactcagtggccaccatcaaacccctcaatttcttctttgacaaaactactcaaggtcagcattttgaagcaatcacctgcacctcctacccactctggcctcagcctgtccataatgaggcttaagagtcaggatcttgactccacatagaccatctgatgaaggcaaggagtgtactctgggtgggtacacaactccagggagcgccattcacgttgttttttatgtaaagttgtgcattggggggtgttcaatgtgaatggtgccccctgttgtttcttacttctctttttttaggctctctgctaattggctacgttacatccctttgattaaaaaagagagtcaggaaagctaaaaaaagaggagggagtggggaggagcagatatttttgagacctgacatagaatctaattaaaagagaccctccatcctggatgatgcagcagacgacatctaaaataaaggacgcaggccgggcgcagtggctcacgcctgtaatctccgcactttgggaggctgaggcaggcggatcacctgaggtagggagttcgagaccagcctgaccaacatgaagaaaccccatctctactaaaaatacaaaattagccgggtgtggtggcgcatgcctgtaatcccagctactcgggaggctgaggcaggagaatcacttgaactcaggaggcggaggttgcaatgagccaagatcgcaccgttgcactccagcctgtgcaaaaagagtgaaactccgtctcaaataaataaataaataaataaataaataacataaaaataaaagaagcatagcaacttaaaagagtacaagtttgaaatactatattccatacatttacatgtcaactttaaaaactcacagacccttgtttacaaagcattgtatcgaaaggtgaacattgtcattttaaatgtggtcactaataacactaactgattaaaaggtccaaataatagtagccaggaaaaattaataactttcttgatcaagatggcctttctgccttagtaattttgtttagatcaccctaaatatatatatatatatatatatatatatatatatatatatatatatatgtatgtattatcataaattcttaaagcatatttatagagctaagaatttatggctgggtgtatctcatgcctatagtcccaacactttgggaacctggggcaggaggattgcttgaggccaggagttcaagaactgcctgggaaacatagtgagactccatttctacaataaataaattataaaatatatttaaaaaaatttaggaagttatgtattccatcttgtctctggcagccccaccacagagataaaagttccacgaaccttgcattaataaccatgcagccaatttgttaaaatgatgatgccctaacttaattaaatctgatagagctgatgacattgaacctcttaggggagataaagttctccggttaataaagacaccatgtttatagatagataaccataagagagccagtcacgtgcccatatgcctcagtttcctcatttgtaaaatgaggacattcaatttgattatctctgtctgtctgtaaaatcaaagtgagtttttgactagagcattccttctgattgcagatttaatacttctggccaattattggttctcggaatcactctgtcctagactttctcttgttagaaccacacattctgttagtaacagatgagcctaaaaatgttgtctggagacaattggcaggacctcagcaggctgtaaatcctttcaggaaaaaggatccgatcctccctttcccctaccctcccttcccctcgcttctcctctcccctcctctcctctcctctcccctctcctcccctcccccctcttctcctctcccctcccttcccctctcttctcctctcccctcccctaccctctcttctcctctctcctcctctccccttccctcccctcccttctctttccttcccctcccctctcttctcctctctcctcccctcccctctcctcccttcccctcccctctcttctcctctctcctcccctgccctctcttctcctctctcctcccctcccctctcctcccttcccctcccctctcttttcctctctcctcctctcccctcccctccccttccctcctctcttcccctctttgcttttcttctatttctttttctctctccctctctgtttccctctctctctccttctctcttttcccaacacagtcctcagcatataggttctcaacaaatatgccctgaggaaagagaaaagaaagtccaagcttggcagttctccagccagagtgtattgcttgtgtaaagaggaagctaccacagatcagagttaatctttaggtctgcacaccatgggcatcatagaagctttccttagttcagcatttgaggcccataatctgctgaatagagtgcctttcaatttatggaaaggggtcatatattttagtggttatgcatgacttaaataatatttaattcttattatgattcctcagtgtgacatttctgctgaattttatattttcgttttcttttctctctcttttttttttttttttagtaaaaattgaaccagttttattctttttcaaggaagagaattcacttttctaaaggaagaagaggaaacaaactagaaacttacagcatatattttttatctttggtgacacacagaagtttgctttgttttttactttctcctgtgtccgagtttacagttggacttttgtaagggaagtggaccaaatgtgtggtccttgacttactttcacggtattaactacatttcctttgttctgttgcataatgtaatcacttgtgtttaatctcccttctatagggaatgatggattattaaaagtattgctgcaacctgtgcatgtaccccctaaatctaaaataataataattttattgaaagtattgttgcactgccactgtaaaattactcaatgaaatctacattgtcactactcagatattgcccttcatttataattgtgtggtcattaattcttatttgtcagtacattttaggttaagaggttttttacagccttaagatctaatctttatttaacaatcaatcatcaaatctgcatttgcaaagattagaaatctcatttttaagtaaaaacagacaaagagttaggatttgaacccaaagtttagaggactgtattatcacccaaatgcctagatgttaccatgcaaatcaaaaataaaattttgaacaagtagttttattttgaagagagaaacataaatatagaacagacttatctcatggataaaacagaggatagactattaaagtcatgtgtttagggagaaattatgccttccaaagttaatgcctggctttgaaattgtgagtaaggcttttttttttttttttccagcataaacacatctagacaaaatgtaagactctgtgtcaatattttttttgaagggcagattgggcttataattatataatactgacctatgacttgtctcttaggacttccacaaaatgagattttgatctggtacttttggatgtgtaatttatctatctacaatgcaacacaatgaaaatgttctctcatggttttggaattatcttcattttggcagatacaggcacatgtgctacacacttctcattcttgcacccagggcagacatcactaatcgatcacagccctctttcccactgggaacagatggagcctgtcaatatttctcagcggtcctccaggcagctactactaatcaatcagaattggcatgcaagattaaatgcccttgccattcagggcaataatcacagaaaatgacaatcacacagatgtgagtccctggggtagccaaaattccaaaacctagtataattgcctcttcaaaatgtgattaaatatcctctttccctccatcacaagcaaaaagaataaagtcatgcaaagtaggtttggtttgggaggaaaaaagaaaacaaaaaaacaaacaaaaagaaaccttctagcatctgcatttctttgtggctccaagatccgaactgttcttacacaaaaaagacccatcattgaactccactaacttatacctcagttcttatttatttcctccaaaaaactaacctttatactacagttttactattattaaatcactcttccatggagcagatgtttctgaacgcttttttgcgttctttgtcttgaatactcttactaaatagtgtccttccacagaataaaaaaattcctaatcttgaaggagttatatttatagaggaataatttatcctaagttacattaaaataagtaaatccatggcagcacagttaaattcataagagcaagaacctatcattactctcagattctctttggatctctgctaaattgaggactatacaatttatgaatacatattttttggttaaacaaaccctaggaaaaaagcgtatttatgcatcaaaaacctgttattaagagctcaaaaaacgtaaacttcttattagaagatttgatgtttttttcaactacaacaatctcaagaattaagagtaattttatatttccttttgtagtaaggtacaatcatatcatgttttacttgggatgaatgtaactatctatggttttaattgttactgtagaatggagttgtttcacaaaaatgataatccatgttgtagagtggttagtgaggtgagaaactcaagggccgggcacggtggctcacgcctgtactcccagcactttgggaggccgagacggacggatcatgaggtcaggagatcgagaccaacctggctaacacggtgaaaccccgtctctactaaaaatacaaaaaaaatagctgggcgtggtggcgggcgcctgtagtcccagctactcgggaggctgaggcaggagaatggcgtgaacctgggaggcggagcttgccgtgagccgagatcgcgccactgcactccagcctgggcgacagagcgagactccgtctcaaaaaacaaaacaaaacaaaacaaaaacaaaagaaactcagatgacatcagcaaatatctcttgggcacctaccctaggttacacattggaactacaactggagtgctttgggttagttccaggagcactggggcaggagtactcaccatggcgtgtagaaataagtaaattccaacagtcattcacgcagcgaatatttattggtgttagctgtgtgccaggcagtgtccttgtcctccaagggcactaccagactacagaaatacgtacaactggggatggtggcttactaccatgaataattgattttaagtttctcttttacaataagcttccttttttaattaacaaatatatatatatttatgatatacagcatgatattctgttatatgtatgtaatggatatgtccataatgttatggaatagctaaatcaaatcaattaacatatctcttaccttgcacactttttttgtagtcagaacacttaaaatctactcatagcaattttcaagtatataatactttgttattaactataatcaccatgttgtacaatagatatcttgaacttattcctcattccaattgaaattttgtatcttttgaccaacatctacccaatctccaccttccagcccctagtaaccaccaccctactctctgcttctgtgaggtcaaccttttcagataccacgtgtaattgagaggggtggtattcgtctttctgtgcctgtcttatttcacttatcataatgtcctccaggttcaggcttactgtcactatgacaggattttttcttttaaggataaatagtattctgttgtgtatatatgccacattttctttacccattcatctattgatgcagacttagctttctcttgaatagagttctttgggagcagaggccaggctttcccagttcattgttgttctccagcaggtagtacagtggtagcacatagtagtcactcagtcgacacatgttaactgaatcaattatacaacgggagtgggaggaaggagtgggtgagtggaaagtccttttgcacgttgcttttgcagacaatgagctcctgaagggaagggcacaagtctgttattcctgtgccctgagatcctggcatctcatgggcatgccaaaaatgtctgtggaatgactttggaggtaaccaaggaacagttagaggtcagttacgtgttaggatgtgaagcaaagggaatggtcaaagcataagaaacttttagaacactgattttgaatatagaaattcaaaatacctttccttctcccaagagtaactagagagtgggggtaatttacttaatgtacacattttgtccatcaatattccttgtgccagccactggtacaccctgggcaaaggcaaggaaaggagaaggtattcccagatggaacaggaccagccaagcagcaagaaaggttcaggcaggcatgatgtgatggatgacagggctatctcttaaaaggcctgggggcattcattccatagcatccctgcattccagagaaaaaaaactatgcagcaacctcagcgagatagagcagcattgccataatgttgagaaccatgggggcgctcacccaagctccctggccagctggttggtggaccattttaactctgcatccacctgcctcttctcctagtacaacctggagtttctgactacattctaatgggctgacttcatcctctttgcatgggatttcagtgtgttgactttgtgccaaagatcagtgggttttataaactttgataaagcggtaaagaagcaagtttcacatactgccaccaatcatattttcatattgggcaagaagaataagtttaagtggtgttacaaagcatatttatttatgcagacgctctttttatccttttctcgacaggatattggcactacatttgaaacagggagaaaaaaagcaacatgttcccatttctcaatctctttactgccaatttctgaattgagactagcttcaagattttgaatatcttcagcattgatctactgctagtttctggtggagaaattgaaacaatagaaatctgaaaccgagatagacagcaacttgcagtgtacatttcctctcctgatgcttttatagacagaaaggacagaggggttatatctcgttctccagcttgtctggccatcccatccccaggaagtctatttactccagaaactactgtgatgcccacctaactgccatttctgtcgattcctgtccaagctgcacaactgaccagctttgtaacttaggtgaagttatttaatttctattgcctctgtcttcttatcagtaaaatggacatatgcacagagtttagtacttaaggttgttgcgaggattagaagagaccatgtatattaagtgctgctaagaatggtgcctgcgtctggtgagcaatcaataaatgttagcagctgttgttattatgactactctttttattgtatgtgtatagaagggaaaatcacctgtgtgccttaaatgggaaggggaggatagtagagtcttcccctgtcttcctatattgactgagcctgggggacctctacctctctgagttgacttgtacaagttcagcattacttccctgcaatagttttctatggctgctatggcaaattaccacagtgatgtggctttaaaaacacacatttattatctgagagttttggaaatgagaagtacaaaatggtttgatttgtgctaaaatcaaggagtcagcaaggctgaatttccttgcctttttcagcttccaaaggacgcctgcattccttggctcatgtcccctcctctgttttcaaagccaacatcattagactgagtctttctcatgctcctgtctctctggttctctctcttctgcatccctctttcccttataagaacgcttatgattacattgggtccacccagataatctaggataatctctccatctcaacgtcagctgattggtcgacttaacctcatctgcaaccttcattccccctggccatctctattcatttctcaggtctgcaattgcaaattaccactgaatgggtggcttcaaacaacagacatttgttgtctcacaggtctagaggctagaagtccaaagtcaaggtgtcagcagggccatgctccctgagcctctcagggaggatctttccttgtctctccctagcttctggtgttgccagagatttttggtgttccctggcctacagctgcaacacctcactctctctctgcctgtgtggtcacacggtgctctccctgtgtctctctgcatctttacgtggctgtcttctcataaggacaccagtcattttggattacgagtccacttgctcaggtatgactttatcttcactagttacatctgcaataaccttatttccaaaaaaggtcacgttgtgtggtcctaggggttaggacatcaacatatctttgtggtggggagacacaatttaactcataatatcatgcgagttaacatattcacaggttctggagatgaggttgtggacatctttagggggccattatcccacctaccatacctcccttcactcccgattgggatgagaagatgatagtgtagagtggatggagatagtttttccccaaccttgagatgctaacatctcaatgtccattactgcaaaaaaaggtagaccccaaatgacacatgcagcacagctagacgtggtattgtcagaaagggttgtagtccacaggagtagggaagggagatggaaagacaggaaaacaggaagaaattaaatccctacaacatatggtcaaatctcatcccaactgagctttcatgtaaggtgtctgaatccgttcttggaagtgtcttttcccctcctgttcgctaaaatttgctccatattgaattgcttttctcccctacacccccaccaaccaccagctcccttcagctggcattggcctctgttcctctgctgatatttgaagcatgtgggtgggtctcactttcccagcaaaatcttttgttcccctgtatcgattcaccaattatcacctcatccccattctccaatccctccccttacaacaaaaacaacaacaaaaattaaaggcataaaccaaaagaacagaacaccttcagccttcatagcatccctgagagagaaaacctatgtattaacaagaaagatgatctgtatttctttttccctaggaaaacatactcagcattttatttcatgaaaagattgtatttccttgattgggagggtaattactcttccaaaatagacttgctgttaagtaatcttgtccatgcaagtgacatggtatatgagtgagaaatgtgggcaataggtatatttgattatccacactgctatcttatctgactgaccttagagaagttatttggtctccttgggcctcagtttccttatctgtaaaatgaggattttaaaaagggcctaatttataggtttgtgatgaggattaaagaagctaataacagatatcgtgcacgtgccaggtgccgggtactgtgctcaacacttttcatggattatcgcatgagtttgtgttatgtccattagcgcagggtctgaggcttcgccagcagtcaaagaaccgtcactatttttgtgagtacgtggcttgctttatccagtctgccgctggaagcaaaatattctttctatcctggatgtccagtcttggaaccagctccgaatccattgaaaggcccctggtgtctctggggggttggtaccttcagacgttattgtactacatttttgttcaatgagtcagagccaaaggacttggttggtgaaaaatttaaatcagatcggtgagaagcagcaatcttcatctcccccactgctcggtggtgcacctttgccaccaggtcagggaaatcatcaatcccggggagcaactacaaagctgtttccagagccaatttcctgctgaactgtgtgttatactcttagcaacattccaaaaattatactcacttcaaagccagctttgatctggcccccctccctcccttctcccccagcctttgccgagaagcgcatctccaggagtagagttcaccttgaaaggctgagacgcctgtgagcagagctcggatcttcctgagaggaagggagggaggccccagaaccaaaaaaaataaaaaataaagaaaagaaaatccgtgggaggcctcacttattctctgtggcccactgcccttgccttggcagctcagttccttcttggggtaagcaaaaccatcagcccaggctctgccctccacagaacagcagcagccgcagctgatctcagcattgttgccctcacgtggttttggtgttgttgcttaagcagggagctgctttgggtttctcactcagagctgcaatgggaggtatgtaaccatcacccagggctagggcaggaaggaaaagcttgccctgaaggggaggtactgtaccggtgcctttcagggaaaggcctttgtttgatactgtcaggcatcagatgcacctgataattttttggaaggaggaattcttgcagcagctcatctttccttcattttacccactccctttccctcactcctagattacaatgtggaaactgaggtacactaagagacttgctcaccaaacaagatgcctgtggattccagagtgattcgcaaatcccagttctagcccaagagaaaattccctcagaagccgagcaaaaagaaaggggcaattagctgcaaatgcctcatgcatggatgtggtgctggagtctcggggggttgtagggattgggcgctctaaacccagtagatgtgccgcactggcttcatttgtgagttgggaatcctggggcttccctaggcagggagtttttaaaataatagttaccaagtttaaggaatttatttccacctatttgggagtaggagcaagggtacgtaatgacagcctggaggaggagcaaagcactgccacctgcttgcttgtgaccttgaaaaccccacctcacctgtctaagtcttagggtccttgcccaggaaatggggattttgtggtgaggatgagtgataaaaatccatgtaaagcacttctccctgtaactgacacagttcttgccctacaagttcatagttgagttggagtgaatcaagaagccttcactgaaaggggtctcacacttgtctatctccctagtatgttgccttgcatttgatggagattcaaagtgcgttgactagtttgagtgaccttcaaggtaatagttcaacatgttgacaaaagtctccataagggaaccttgtgacaaagtattgtgtaaaataaagaatctgtgtaaccgctccaatattattctattattattattattggttagtgttattattataggttattattattactatttttggctataaaagacaacaataacaacaatcactgcttactgacatatgacatttagtacagtgcttagcacaaagttagtgctccgtgaaggttaaacaacagtgagaaaaaaacactgcctgcttttcaaaacattgatttctacatgcagttttagccttgcatctgtgagatcatgacgggtttatttatatttctctttttatgaaagcttagcggttgtgttgagtgaatacaaacagttaccataggtccttaaaaaggagctctgagatgtgtattgagcgagcgctgaacattttcaggatgtgactggttccctggggcccactgcatcaggctgaccattctgagaattaatagccaccctgacacttgaagcccatcaggaatgagatgcttgcctcgtctgggaggacggtgggacacgtcaccacctgcacgtctccctataagctcttacctgccgaattagcaagctgcagctattatgttagacagagccacagctgagcccgcagtttgatttttgtcaccataaaggcaggactggaattgacactggagtaattaggaatgaattctcagatcttgacttatcaagcacactgccagggagggagacaggagccgtgtggcagtgttttggaagctgagatggtgaccttgcaggctgacctcactcttaatctttctattagagagaccagtaagcatttggccagcacctcctgttaggctgacaaccagagcagttcgtttgggattggatatttttctccttttttttttttttttgtagcctgtaggcacttagaagaaaaaggagcaggagaatgaagccaatatgggaagcaaagttaccacggggacaaaatgttcttccgagcagcttgaaatgagcataattttggagaatttctgcaatagcgagttaattcataattgggtttgctgagcaatcaacaatgtgttgcttgtattttcatatgctgggagcatatgactccgtgtgtgcactgtgtgtgtattataatgctccagtactttgatgcttcactaatgtgcaatctctatttcttgcttttgtctgggggcctctcatattacgtttagattgtatcctttatcatcccaaattgacatttatgcttttacttctattgtttccctagcttctccctggtatggatcaacaatttgttttaatctgtgtcacttctcttatctccctcgacacagaggagcagtcattttgcaccgccatccgcctacagaggttgtgctgtcgagagtgtggtggggtccctcaccctctccccactgtctaaagtgctggcgaatgttaattgcttttccagttagtttataagaatgcagaaaccgctgaatgcagcttgactggttttgatgaaagtaatggaatgctagtgcctatgaataaataaatctgatttacatagaggactattgtggtattgggtaggaagcctctgaatgcaagcaaattatagtttaaggacacattattccttggcttttattctaagtaaaggagaagagctcaggtttccttgggttcccagaacgggaggcgaagaggtaaccccttgacctaagaggaaaaatgctttctgagagcagcgttgatctgaaacttaagggggatgcattttgtttggagagaagctgtagatctaggtctcacttcctgaaatccccttacagaaagcatatagaatagcaagtggtgaagaatttatgagaagcaaactgaaaatgtatgagtgcctatcagagtgctttggtgaaataactggagaacactcttagaggaagacgggatcacaactattatgactatcacgacatccagttttatttgtgtttcctaaattcccacaagagtgtgtggccactagaaatggaataaatcaagacattcttttttttggacgagaaaaggcaagtgtggtagaagtaagaggactcacatcagggcatctgcatttcggagtgcctgaggattgttctgggatgagtccatctggcaggaaaggagatgggaatagagaggctatgggaggcacaattcaagtagatgctcagactaaaaatgcaaaactgctacgtttcagaagtgaccctattggtggcttctgataaatgaatgaggattaaacgccaaaattaaatcacttaaaaaatatttgtatgggccaggcgcggtggctcacacctgtaatcccaacacattgggaggccgaggagggtggatcatctgaggtcaggagttctcgaccagcctggccaacatgatgaaaccctgtctctacttaaaaaaaaaagaaaaaaaaagaaaaaaaaaatcaaaagttagctgggcatagtggcgggcacatgtaatcccagctactcaggagactgaggcaggagaattgcttgaacccgggaggtggaggttgcagtgagccaagctcgtgccactgtactgcagcctgggcaacaagagcgaaactccatcacacacacacacacacacacacacacacacacacacacacaaatagcatgggcaaggtactattgtagatgctgagggcacagcagcaaataaagccaagtcccagactgtgtaggacacttacattctcacacccagctcgcagcaaattataaactctaaggagataaataattgggggagatcttgaaacttgactacaggcttaactgggtaagactgccagaaaacaggaacagttttctgtgtatttagtgccattcataacatgacagcatccacagtgactaagcaaacagcccagaggagcaagggtgtgagttaggagttgagtaagaatcagcgacaataaaaatgaacacctgacatatttttcccattctagggtcctctgtctataaatatgtttgaaactaggttattatcctctctcacccatgcttatctcccaaattcttcttaatcatttctcgggtcctgatgatatattgataggctatggattaaatatgaaattactgcaaatctcaagcacccaaagatttatggactgaggcttaggccttatatcaaatcaaccatctaagaaaatatatgatttcaccataatattaaaaattactggcagcgtcttcatcttatccgattggtgttgtcctgatgataagctccagtaagcagagagagaagttgtgtgataaattatggaacagacattgaaaaatatatttattacatttggatgtgcaaggatttcactcgctgtgtacagaaaaaaagagagtttgtgttgtaacgcctactttggttccaaatattctacagtctctaaagactagctgatcttccgttggcctcattcgcaggagttgagttcctagatgggaaaactgtgtagtgattacaaatgaaagtatttgttctaaaagtaagagtttcctggtcaatgtgaagaatatccacagagaggagaatctaggtccatgtttctcaaagtgtggtctatggaccagcacattgtcagtccccgcgagcttttgagaaatgtatactccctgaattaaagtcagcctcttaacaagacccccaggtggtacataactgtttgagaaatgagaaaaacaaactatgatagacgggaagccagacaggaagagagaagttcttaatgtatctcagggagggtgctcgatgggaggcatgacagaaattatattaataataaaaataaaacaatgaaaatcatggttaatgtttattaagcacttatgaacagacattgtacaaagattacttgacctcatgaaatcttcatgaagacagccctgtgggaatactagtattaccccaactttacaaatacaaagatgaaggctgagaggattatagaactttctctggctaccaaagcttgcaagtagcagagccaggatgcacaatcacacttatctgatttcttacacatttcagtgaagtctcatgagtcagaaactctagtggacagggccagccatattggagggaaatgttgaaatatcaagaaaaaagagtcatgaagtaggaactgtctttgtacataaggagaaaaggaaaactggcaaaatggtcttttaggttctactagcatatgcctccctttgaaatccccagctagaaacctgcagtcatccttggttcttccttttcctcatgacccatatccatgagacttctgatttccatcatgtcccctccttagtgtacactgactgtgtccctggctcttgaagtgcacctgctgtcgtagttcagacttcatcatcagtagctgggtcttgagcaacatcctccaaattggcccctgcagctccatagtctcccttttccagcccctctatcatgaatcaccatatctccctagaacccaattcaaccatgttccttttctttctgactctgtgctagatgctgataaaacacacatcctgccctcaaggaagcaacaagcccagggaaagtcctcacactctgccttgtctaccactccactcccatctcaccttcctctctctgtgcttgcacacatcactcttgtatttgtcttcatacatatcccttacaggtgagcagaaatcaggcgcagtccttggttctcagccacttcctgcttctcctcagtcactctctttccactgcccaggatgttccctcctccttaattatcctgtgaacaccaacccatccttcaagggccagctcagctgtgcctgcctctttgaagccttgtccttagccttacctcggtgtaagcagtcactccctcctctttcagatccatcagcatttgtcttccttgtttattgctcctcctagaccaggatgtagatagattcccatcatgtccctggaacaaagaaagggcaaggagacagtagaatggcttacaggccgaaaacctgaactttcaaacctgtttttgggtttaagacagtttagatgcttccccccagtgcctctgtctcttatactctaatcgaggccatgagggccaggtgcagtggctcatgtctgtaatcccagcactttgggaggccaaggcaggtagatcacctgagttcaggagtttgagatcagcctggccaacatggcaaaaccccatctctactaaaaatacaaaaaattaactgggagtggtggtgtgtagtcccagctactcaggatgctgaggcaagaggatcgcttgaacccgagaggtggaggttgcagtgagctgagatcgcaccactgcattgcagcctgggcaagagtaagactctgtctccaaaaaagaaaaaaaaaaaagccatgggaagaggttatagaatgttttcaggctttaatttatgatccaagcacaccacctggtctacctgccacctctgtgccaacagccttgtttgcatctgaatagaaataggattaattgatgcataaataatttaaattacctgtataatctcagaacctccgccgctgaggtagaaagacggcttgggtgacttcaaatcagaattatgtccccaggggataggttgtcagattcagtccacacttgaggtcctagtcatgtctggtctgcatggtaaatgaatgccacatgtattagctcattgatttctcctagcagccctgtaaaataaatgttttaacttccattttacaaataagcaaatcagggccctggatctattgaatactctgcccacatagctccctcctgcacttgaaagtgggagagttgggcattaactctcgggaaggaagcctagtatctcccactgtcttatgttgtcccacccagaacgaactctctttcccggccatcacctttccgtcaaatgttctcagggtgcatgtgcgttgaaataaagagataaggtgtgactgtcaagcagaaacatgccagaataaggcatacattaaagtctatcttaatgcttcgcaattgtgcccgtggtgtgagcatgcttttgtgtttatatgtgtgaccagttgtcagtgctgacaaagagtgtccaagtcccgggtctccttatttctgttttcttattgcttaaatagaccatatggaggacaggatgcttcattttagctcagggatctggttgcatcgtctccccacatccaaacatcagtcccatatttgtcttcatgcatattccttacaggtgagcagaatcaggtgcagtttttggctctcaggcccagttagctgaatacagatgacacgcaaagtgctcttgctgactcctctgtcagtgtcgtggggaccagctctgatccatttctgtccatgagcgcttgccaggaaccattcaggcgagtcaataggatgcccattgatgggccaaacgttgtttttctcgacaggagcatgcagagtaggcaagaatgtccaactggctgcgtctgacctgtcagccaatttttatctctccaggcaatagctttaaaatggtaaaatatctggagttcatgacataggttagcacttctttcaactcaaggtggcagcagcatgaagaacgcattcatcaaaaccaaagggactccactgaaatggatacatcagaaacatctgaaacttatttcccagcaccctttgtcaaagtaaagtgggaggaccacctgcattagaagcgcctggagagcttgagattgcacgtcttgtctaaaggttccacctagaggcaaaacctggggctttaatgaggtctgacttcatgtctaatccatattacaaaatgtgtctcaagatcctctttctaccatgccttcaggtagaaagggaaaaaacacttaggtatcatttcataagccccagaatgcctaagattacaaagactgagaacaccaaatactggcagggatgtagagtacctcacatactctacatgtggtaggtgtataaactggtacaaccattttggaaaactgtttgacattctcttatacagttaaacatatacccaacaatcccactcatcagtattgaccccccaaataaaaatatatgttcaactgtagatttatgcgtgaatgttcatggcaggtttgcttctcagtaaccccaagctggaaataaatcaaacgtctatccacatgtgaatgaatgaacagacttgaatagcatcatacaatagaatactattcagcaatacaaaggaataatctactgacaactcaacagcatggatcaacctcaaaaatgttatgctgaatgaaagaagtcagacataaaatagtacttgcttatcattccatttatataagttcaaaacatgtaaaactaacttatgatgatagaaatcatgggtgtgacctccagagggttgaggattacctggaaaggggcacgagggaactttctggagtggtggaaatattctctatcctgagaaagccgatagttacatgggtatatgtatttgtcaaaacgtttcaaattatatgcttaagacactgctggtgggagtgtaaattagttcaaccatcatggaaagcaatatggggattcctcaaagagttaaaagcagaattaccattcaagccagcaatcccattactgggtatataaccagaggactataaatcattttatcataaagaggcacgcacataaatgttcatcgcagcactattcacaataccaaagacatggaatcaacctaaatgcccattaatgacagattggatttttaaaatgtggtacatatacaccatggaatactatgccgccatgagaagtacaagatcacgtcttttgcagggacatgcatggagctgaaggccattatccttggcaaactaatgcaggaacagaaagccaaatatcacatgttctcacttataagctggagctaaatgataagaacttatgaacacaacgaaggaaacaacagacgctggggtccacttgagggaatagggtgggaggagggagaggagcagagaagatcactattgggaactgggcttaacgcctgggtgatgaaataatatgtacaacaaactcccaagacacgtgtttacctatgtaaaaaaccttcacgtgtaccctcaaacctaaaatgaaagttaaaagaaaaataaaataaaaataaagttcagggttgagtatgatgaacctgaatacaatttttagaaataaaaataggaaagaaagacccacgtaaagatgaaaatgaaaatcacctgtattcttcccacacagaaatactcctctttataaattttgttgaattcctctctgttgttttgcatatatatatataattaaatactcctcaacttgtcattgtaaaagaaatgatttctatatgtaaacttccccttagtttttaaaaagcagagtgggagagaaatgggcatggctacaaaagagcaacaagaaagaccttcttagccaggcaaggtggctcatgcctgtaattccagcactttgggaggccaaggcggacagatcacctgaggccaggagttcgagaccagcctggccaacatggggaaaccctgtctctactaaaaatccaaaatagtagctgggcttggtggcacacacccgtaatgctagctacttgggacgctgaggcaggagaatcgcttgaacccaggaggcagaggttgcagtgagctgagatcactgccactgcacttcagcctgggtgacagagtgagattccaccacacacacacacacacacacacacacacacacacacacacacacaagaccttagtgtcttagcgatgggagttttctgtatgttgactgtgtcgacgtcaattccttagttgtgatactatgatatcattttataagatgctagctttgggggaaactggacaaagagtacttggcatctctctgtcttatttcttacaactgcatgtgacactacaattatctcaaattaaaaactttaattaaaacacaacaaaatttggtattaacagcttggagtttgatatttttaatttttaattttttggccagcttcaggttttaatttggacttcttgtaggtagcccattgtattcgtgtgtatgcctgcatttgtgtgtgtgtgtgcacatacaagtcttatgggagagagagaaaaacagaggtgttttaaaatttactttgatttttgttttgatttcccccacagataggggctcataatttaaaagtcaccctttccatcaggctgggttcatcggtctaaagtcaaaaatctctatgccactttctacttcttcccaatgttttataattccaaagtgtccttgctatacaaggagccttcttcttgaatgttacattattctactgacattgtagagtgaatagtgcctgtgagcatcttggccactgagttgggggagatgtcagccacatgtgattctgcacatcttccaggtaatgcagcggtgctaatgtagtctcctggatgcagggacaccaacggggcttatgtcactcccttggtggccttaagtgcataaatcaatccttatttttatgccaatccatacagaaggcttccttgtgtgtgctgcacatagggagggagggcaggatgcctccttgagcaagtggtttgcattcgaagaaagcaagcagtattggaaactggtttctgggtatttttgtttctttatttaaatcccctaggaaggctgctctggcttggacagaaccagagtgaggggactcattagctggagtgaggttggtgtcaggaaaaaaacagagctcctgccttggcttgcctgaggtcgcaggacgccacccttgagtctccatttctggcccgggtcctgagtgcctgcccaccctaactctaaagcagacctagcctggtggagcctgctatagagaggctgatgttctgaaatacatatgccaacgatgataaaggcatactgtaggaagactaaatgcttttttgaaattattttggtagggaatcaccagcattatcccagttaacccaacagtgtccaggaggtgggttgatacagtttatttcattcagcaaaaaggaaaatcagttaatcacaactcttcctcctactcttcctcctctccctccttcttctctggggtatgggggcataataacaatggtaagacaaatgtaagaattatctttgtcatttcttgtctctcctattggcatttccttaccctctctaggagcccccgaaatgtctatggttcccatttcattctcactccaacatcaaaacctatcaattatattctcaaggccctcaaaaccccaagtcttaataggacattggatgacaatgagtttaatttgataacatgaagctttagcaaatttgaagacattcatttcctctaggcccataaaggatattactaacgtatcccaggcaccatgatagagctgtgggagagagagagattgttaggcagatagctagagctttggtcttctcaaaattgcatccaatgggaaaacagcacatttaattatttagttattactgaaggagggcgatatgcttatatcatcccctggcacagaagagacaccaaaatatgtgttaaaagaatgtgtgggccaggtgtggtggctcacacctgtaatcccagcattttgggaggccgaggcaggtggatcacttgaggtcaggagttcgagaccagcctggcaaacgtggtgaaaccccatctctactaaaaatacaaaaaaattagctagatgtggtggtgcgtgcctgtagtcccatctactcaagaggctgaggcacaagaatcacttgaacccaggaggcagaggttgcagtgagcggagtttgctgcagtgcactccagcctgggtgacagagggagaccctggctcaaaaaaaaaaaaaaaaaaaagaagaagaaagaaggaaaaagaaagaaaaagaaaagaaataaaagaaataaagggaggaaggaagggagggagggaaggagagagaaagagagaaaaagaaagagaaaggaaagaaagaaagaaaagaaaaaagaaagaaagagagaaagaaagaaagaaagaaagaaagaaagaaagaaagaaagaaagaaagaaagaaagaaagaaagaaagaaaagaaagaagggagggagggagggaaggaaggaaagaaggagggaaggaaggaaaaaggaaggaaggaaggaaaagggaaaggaagggagggatggagggaggaaggcaggcaggcaggaagaaaggaaggaaggaagggagggagggtgaagatcaggatgattcctagactgtttaaagagcatttgagaaatgcctcttagaggatgttacagcctatcttgcttgccaatgaaattgccctagtctagaaaattctgagtctatgcaaaagcatatgagtttctattatgttaccatcagaagaagatagttccagaataccctgcacattcccttttctttccatttatcaagttctgttgaagtcatctgtctctcttactaaaggaccaactcctcaaggataaggactatattttagatattaccatgttattagcatcacaatcaggctcaggcatacaatagatgcttcataagtggctgttgaatttatggaatattatttctgggtcattttccagaaagattgcccatagaatggcttgtcaaagaagtggactctggacctgaaggactctaagagatgttcctcagtgatcttatttcagattccctcgaattgctacatgggagagtggattctaatcaaggtcagccatgagccacaagcaaaaatagagactgacaaaattggtaggggaagagttaggaaatttttccttatggctcagggctatgttttcatgcaagataagagttgttgtgcctcagataggagcacaagtgagcagttcagctctgcctctctgccttctgtcctcttcatgcaccaattctcaagacaacactgttatcttgccagaaaatacagcccaaagcattacagatgtctggtacaagcggaacccatattaatggttattgcttaaagaagaggcatgctcagatctctttactgcactccagggaaatcgcagtttttactttcttccagagcagaccagagatgtaaaaagatcaattgagtttggcctatctcagatagagggggctttcttagaggtaatttgaatggtagtcgtgacatggcctgagacacatcctcacaaatacagatttcttaacacttattattttttttaatcaaggtgcttagggatgcttagacataaatgtttcagttttctataggaacaaataagttagtgataatatatgaagaatcaatgaagaatcgtttttaaaaaggcatttttagtgtctgttaacaattgacttatggtttaatttaaattagctgagcttttcttagaattttatttatttatttatttatttatttatttatttattagagacagggtctcaccctgttgcacaggctggagtgcaatggcttgaccatagctcactgtagccttgacctccaggaattaaatgatcctcccacctcagcctcctgaatagctaggactacaggtgcatgccactatgccagctattattttattttatttttatttttgtagagacaaagtctcactacattgcccaggctggtagaattttttttaattcttagccagtttctgacagagtgaatcatttctaaagaagagaattttttttttttaaaaaagcatgatttcttttcaaggtgccattaatggaattaaactgaaaatgcattaaatgacatttaaactagccccaaaagagttattatttttgctctgatagaaaatgcccaatttcaaacacttattaagcaatgtgtgcacaccgtatagttgcataaggtttacaactttgtcagtgccacctttagccaagaggagttatttgcctttaattcttacaaaaaagcagaagatcgcaaactagtgcagcaccattctgaccatgccttatgctataagctctggaaataagataacaccctttgccccttgaaaagcattgccatttgtaatcatcccaagtttccaactatagagattgtcaacagcaagaggaacttttaaattggttgcctttgatgaaaatgaaaatgttatccatgaaaaatctctaggaaaataaattcaggcctgattcctgctatgcaaacagatatatacagtatcaccctgaatcagcttttctcatcagaaatggagctactgtactttattgtgatgtcagagattgaactggggtgagaatgcacttctgataattaagatcatatcgggttgggaaagcctaattcctaacagaagataaagagtctcctgatggtatagactcaaaaggcctgtaaattgggccatataatagtcgtagaatattgggatatgtttgaaattccttattgctgaaatgtgcagataataccagaagggagagcaccccaaccccataaacccattggaaaaaaaaaaaaaaaaaaaacaagaaacatctcttggagcaggcaggtggtgtatcatatgttccccgggtggagaatgagcttcttgcctttaaaagtaattgattttatagcgaaacgtgtcaagagcactggttttcaaaatgatttcgttcatgtgtgttgggaaataatatatactgctaattgcttcagaaatagctggattatttaactttggttttgatgggatttggaaggaagatcttgagcccttatgccttttcccttatcgcagattaatagctgttttgaagctgtgtctacttctgccgttgcagagatgaaatctgcatcccctcactttcttgtgtagggcactagctacagtgttcttagttcaacctctatgagtgttctaaagatagcagtgtgacatttctgtttcaataaagcccaaatagtaggcgagatataaaacaccagagaagaaaaaagatatgtttgctgatttcaccgaggtccgtattgagctgcctaggtgaacagttgtaagtcgggagtctgactgcaggtgcaggagggggagagagtgttaacttctgtgaggcatcatctgttggctgcttagcagcacacatcttgctgcaattccatcgtgaaggtctcagtcccctacagactaatggtgagtggatgtaacatgggacctgcgaaaggaaaggtggttgtttcttgttctgtggcttttctcctcagttgtgtcttcaatgagctaaagtgaatgtgctgatttacagtctgtatttgctcatggtagctgtctcattattaattattcagggtcttcttccatcttacacacatgtgtatgtgtgttcatatgtatatgtatgtttgaatgaatgaatgatgaaataaacaggcataattagtagggtcgaatcgttgtccatggtcaacactaattgaccctaccagttatgcctgtttgtttcatctttcattcattcaaacatacatataatatacaataaacatacatacatatgtgtgtaagactgaaggagaccctgttgaattaataatgagacagtgcctgtacctcttcctccaggaagccttccctcatccgctaagccaagaatcagcaatttttttttcctatgaagatccagatagaaaatatttcaggcttcattttgtgagctgcacgcagtctctatcacatattcttctttttcacaatccttcaaaaatgtataaaacattcttagctcggcggctgaatgtggtccgtggccatcgtttgcccgtttgccaaccccaaaaccaaaccaagtgtctcctgtcttccccaccaaccatagcagcctacatgttgtattgaaaagagctaaactctagactcctggaaagggggttcacatctttgcagccccagcctaagcagtggcaagaattcatttttcaaatataaggtgatctccaccttccaattttatattccacctgggaaaacaaggtcatgtgcaaaaaccagcgaagtgacaattcagagcacggtcagtgttcttgacaggcccttgacaactttgactttctgggcgataaccccaagtaaagaaattagtttcaaaaactgccctgtaagctctcaaaatggcttttagaaggcatttgctctatactttgttaggccttcagctaggtgtttgtttgttctttgttaacacatgacttttaaaaattaaatgtttttttaaacaaaaacttcagagatgaacagcaaaaatggtaaggagtgtgtgatgttgtgagcagcaggcctagaaacagcccaaagattgacagcgtgacctcaaggatggagacaaaataaatcaaaaggaaatacacagctatatgactgcatagtacaatatgttttctcttaataggttttcagtcatcaattaaatgttgaattatgctcattatgctctctttaaaaatgcagccaaatttagcttccaatttggaattattatatccacacagcatggttaaaataaaaatatcgagcgtttgcagacagtgagttgggtttgtctgggaagttcacgcatttcgactaattcatttatgaataaattgtgaaaaaaaaaaaggcacattcatgacccaggaccaactagagtgaggagccagggatgggatggcctgggctgacaatgacttcctacctgaggcaaggtacttaagctctctaaacctcagcctcctgatgtgtataatgggtatctccttccaccccggtatggtcactgtgatgattaaataccattacctatgtaaagttcttaaaacaaaagctggcaggtggtaaaagtgctaacaaaaaattagcaattgttattattatcattatcatcaatattgttaatgaataagtgtgaaaatgaatttgacacacacagtgtgccaaaggagatgacagaaaagtgtaaatatgaatatggcgaagacatctaggattgcaccttataggaggtggtacttgatctggaattatcaaaccaattttagaaatcaagttaaactgggactgattcccccagaacacatattatcatggacagctttctttggttaggttgagaaagactgttttgtagaagagtaaaacctgcccacataatattacatcagatcctattataaactttcaaatgttttgaatttccagcaccatatcacattaattgttttatccctaaactatcagagaaagcagcatcgtaacagggtggaacaaatgcatttaactcagaaaataagacatccctcctcctagaaggggaaagattccaatttcctttcccaacattttctttaaaattgttttggcttcagaccatacctcatcttatagccaaaatgtaacctggtaggagtgtagacatccccatttgtcgtcacctttaaaagcaagtacttgaaagggtctgttttcctctggaaaacaagtaccgatgtcaagcctagccactgatgtaacacgatgaaagctgcttcagaggaagaaattggaacgagggagtttggctggagcaatgagacatgtcgagagcctttgggtattaaccagactggcagtgtgatccctgggagggaagacaaagatagcactcgcctgtctgactcagggcataccaatatcgctcgaaccttcccgtcttcccacaaggaaactcggctccagcccattcagggcagccttccagggcctggcatgtgtgtgctcagcatcacgggcagctagcaaagaccagtgcaacggaggaggcttagcttagtacgcgttcggcaggacgggtgtgcaggctgcactgcccttgagtcgtccaggtaggcagaaggatggcttttattgactttctgagactggaagcaaagaaagggggtgggaaagaaaacagtaggtgtcattttagttgtgccctcatgagtgcgagcgggaaaggtcagaacacctcaggggatgaggacagagccagggcaagagtgttccccagaaagctagacagcaatgggacaaggtactgctctacaaaccgagagagaaacagaggcgtgaaaagagccgttagtgcaatggagtgtcgtgaattatctgtcagtgccgatggcactcttgttaggattctcacacttctcacatgttgtcctggtctacttcctgggacaagcttttgtgagccaaagaccctattgtgagcctaggcagtgccatttttctgtacatccctctcttttctgtgagttcccagccccatcatttaggaaccccctggaatctgatggacaggactgatgtgggtcacaggtgccaaaactgaacagacagctatgttaattacaccacacctgtttccccaggttaagccgttgctattggaaactgtgatctaatgaaccgttattgcaactccccttcagtcatgtaacagaccttggacttggagctcagtcccttgtgcaaaaggataaggagagtaatgaacgagagtggcgggtgggaaaatagcatctgtacatggttcctggaggtggtgaaggagagaagttggttccacctgcaggggaagagagtggtccaggaaggtactccaggatgatctgagaactaaaagatgagaaagcctctgctagctgctggcattcatgacacagggactagaacagaccaagtcattttagatgtctccgtaagttgccagcactgtatttggcatcccctccattcctaaaggtgtttttccaataaatccatggcaacatgcagagctgtgccatcgcattaaacaaaacaggtatgattttttttttcgatttccccagctcatgttctgtatctctacccaatatgttgccgagctgtgagcacccttaggcttccatctaaataatttttaaactttttatttcttttaccactttgcactttttgttcccagaatgaaccccttctactattggaaatttcctaagacaaacaagtttctcttcctgggtagcaatttccattgatgaaaaaccgccttgtatgcagtcaggaagtagagcaggttgggaaggtctgtaatttgtttcccatcaactaataatcttattgtgatgagtaatgtagtcctgttaatgtctcaacaaggttatggattgtgctgagtgtcagtagagaagccgacagctttgtacagtgaaaccattcattctcctttctacacagtatagtttcttaaacagcttgcaatagatcacatgagctttagcaaacaatatttaaatgaatgtaaatacaaaaacgattaacgatatgccaataggacttttactgagaggttgattccgtttttgtgttttccagtgtgcttttatttttaaggacatgacaaatattttggaaacagatttaccaagttttcaggctgcctttctcccttgttacagagtagcctcagtgtctctgcctgaaatggctcctaccgttaagcaagtctttcccccatccattgaagcaagtctatcctattcttagcattcagcgtgatgtttaattttattgtggtattatatttttaaagttaacatacagtaaaattggcttcactgtgtacagttctgtagattttaacacaaatacaggtttctggaactgtcacaactgcaggaacccaagacaacccttttgcctcgaaaatttcccatgttctccttttgtagttacttacacaccccagccctgtctcagtctctcctagtcactaatctgtccttgtcactacagttttgtcttcttgaggatgtcatctaaatgaaatcatagcttttgaaactaatttctttcattcagcatggtacctttgcaatgtatccaagtggttgtgtgtatcaatagtccatccttttctttaattaacttctttaatagacaaataacatttgtatatatttatggtatacaccacgatgttttgatatatgtacattgtggaatggctaaatcaagctacttaacatattcattacctcacatacttttcagttctttgtggtgagaacatttaaaatctactcgctcagcaattttcaacaatacaatactttgttattaactctagtcattcctgcttttgcttcatagtactccatgaattatactttgtagtatatgaattactatactttgtttattcagtcacttgcaggacatctggttgttctcagtttttagtgacaaggaataaagccgctacaaattttcacgtgcagattttgggttgaacattaagtcctcatttctctagggtaaatacctagacttgggattattagggtgtgtggtaagtgtaacatcacgggaaactggcagactgttttccagactggctgtctcattttgcatacccaccagcaatgtgtgagagttcccatcatggcaatgtggttagctttcatgaaaagtaaaacatgtatttctagcgtgatactgtattttatcatgagctgcttctggttaattctgtaagtcattttttttttattccctaatgaaacagtccttacattttctgttggttaacgaaaaagaaaagcaaaatttgcctgcctgcttttctcaattctgtttgtggtttctccttcgggtcagaccgcacgtgttttcattagaaaaatgctgagtcatgggtatttgtttcatccatggaattggcatgatggcgctcagagtgttcaaagacatatagagagatgaggactggatgattggaggaaacccaggaggtgacgtatcttcctatcctcctctttcattttcccttcataagtcttgctccatttcatgcatgcaaagagcaccctgaaaatcacgtgtctccactgctctccatcatcgtctccactcagcaactcagaacccagggcaggaattctgactctgaaccttgcaaagaaagcaattcagcacatgtattccgtgtgcttaattgaagactccaatttgccatgctctattatctagaattaaacacaaaagacagttgataaataccacattcagttgaaaacacaaatgaatcaaaatgttacagtttctctccataggtaataattaacattcttgtgaattgctctgtgtgccatgatgcatcctttaaatggtgtgcaagcaaaaaacctgcacattgagatgtgcatatgtgtagacccaacagaatagtgacttagccttgggagataaggctggggtgaggagaggggaaaggcgttgatgtagagtttaacaatatgcctctgtgaaacactttcaaagcagtgtgtcataatggcctctacaaaattttatacatgagctgaaacatgaaaacaacatacatggaaaagtaaagtattttggtggttaaaaaccacaagggaacaaaagagttaaggtgaagtctttgtggcttacccaaaaggtcagcataggacatgtctctttctttaccttcgtcaaggccaggaactctgtacctccaaaagccctctgacccagggtaggtgcccaatcattaattgctgaatgaaggaacatgtgaacaaatgaagacgtgaataaaggaacaaatgaacaaatcaatgattaagaattgaggccaaggcagtcagatcacgaggtcaggaaatcgagaccatcttggctaacatggtgaaaccccgtctctactaaaaatacaaaaattagccgggtgtggtggcatgcgcctgcagtcccagctacttgggaggctgagacaggagaatcacttgaacctgggaggcacaggttgcagtgagccaagattgtgccactgcactccagcctggatgacagagcaagactccgtctcaaaaaaaaaaaaaaaaaattgtttgtcataagtgagcttagctaatgtgtcactgttcttgtgtaagaaatttaattggacagaaggcaaaaggaatcttgtggagaaaactgtcactttggatttctctcagagaatataaaagactttctcaagtgactccctgcgcatggcttttctaggctctatacaacagcattcctcaacctttttggcaccgaggaccagtttcacggaagacaaattttctacggaagagggggatggtttcgggatgaaactgttccacttcagatcatcaggcatgagttagatgctcataaggagcgtgcaacctagaacgttcacgtgtgcagttcacaatagggttcacactcctctgaaaatctaatgctgccactgatgtgacaggaggcggagctcaggcagtaatgcgtgttcaccctctgctcacctcctactatgctgcccagttcctgtactggcctgtgtcccaggggttggggacccctgctttacaacaaaaaaatctgttaaatggaaactctatccaagctctatttccccatgtataaatcagagaagcttataacaatttagtgggctaaaaattatcaaataaagtgtttcaatatataacgtgttgatgttagctccaatgtcagccctagaagggagcaaccataaaacaacatacttgtcagcatagggttgaggaagccattggatttcatctgatccaatccaaaaagtcttcctgaaagaagcggaattccatacatcttacttttgatttgcaaactcttagcaaatcatcctctttctgtgccacatcgagttcctttctgtatcggcaactacgcagatgaatcaggattcacccagcctggttgagtcagaagcctttagcaaagattctttgatacaatggatttgtgatgaaaagtgaacattttcaggtggcagaaagagccacaggagatcctgttagtcagagtttggaagtgaaatgtgtctattcccgcttggggtgtgtgggaggcctctgctcccattagttccatggggatttctgcttgtaaggcatttgttgtcgtgtttggattgctgtaggaagagaaaaaattactacagtttgcatgagatagagctgtgttttggcaaggaagcccatgataatttttcttcttgaactttgatcaagttcaagcttttgagatttgtctcaaatgataccgcagtatacttcaacatactttcatttctgatggaatttggagcatttctccaatttctttgttcttgccatatttgtcaatgtgtaattaattaactaattcggtcatttgttcaacaaccgtctattgtgtctaccaagtactccaagagccagggattcaacagagaataaaatagcatctttgccttcaagatacttacttcctggtgcagaaagacaaatgagttttttaaaaaatgggtgccagtatgtgctttagagaaaaagaaagcaatggaaggatgataagatgactgatgctgtctcggaaggcaggtcttaaaagatgacatttgagctgagacctgcagacatggaaagaatgaactactcaattatctgtatctccaggccaagggtacagcaaatgcaaagagtctcaaataggagcctgcttggccggttccaaatcaggcagaggccagtaaggatccagatcagggcctttcttatttcttgcaatattttcttcaagaactaggcttgaatctgcaggaaagagacgaacctaggctgatattctgggcaattcctacacaccacacaagtcccagatttaaaatgcctttgttcttgctttttcctctgcctgaaacattgttccctcagacactggaatggctctctctctctatttccttcaggtctctgatcaaatatcatcttatcgagaagcctttccagactacactattaaagtgtcagataggcagtgttagaaatggaaattattttctccgccaaatctgattatttcacgtgagagatgactccctctctacattatgggattaagaatgatcccatttgagatgataaatactagaatgtttcagtaacccaagaagccctgagaaacaaattgctaattcatgacttaaaccatctaaatgtgatgaacaactcaggacgtcagtgaattgttcaacagtggattgcaatgatagagcaacttgcatggctcataaatgagccaaagaaacttgaaaaccttgattttattttaaggtttttcatgcaaaatgggggctgatgtttaccaggactaccagaactcaaggaaacacaggtcttcttgtgctaattaataaaagaagaagagaatttatcaaaggacaaaagctgctataaggcacttcacattgtccaccattggacagttttatttcagtgtatttaaactgcaagtgtgaaaaataagtgcactgattattttgatattctgtaaggcctggagttactataactcagtaggaaaatggtcccttattcttaatggtgctatttaccttagaagtatctggcaacagaaagtttttcaagtcattgaaataataatcctggctgggtgtagtggctctaaacctgtaatcccagcactctgggaggccaaggtgggaggattgcttggggtcaggagttcaagaccagcccgggcaacatagcaaaatcccatctctaccaaaaaaaaaaaaaaaaaaaattagccaggcatggtggtatgtgcctgtagtcccacctacttggaagacttagtcaggaagattgcttgagcccaggaattcgaggttacagtgagccatgattgtaccactgcactccagcctgagtgacagagcaagactctgcctcttaaaaacaacacacacaaaaatctaaatcacagggtctgtgtcacccctctctccaacatctcaaaaaacaggccaggcacagtggctcacacctgtaatcccagcactttgggaggtcaaggcaaaaggatcacctgaggtcaggagtttgagaccagcctggccaacacggggaaaccccatctctactaaaaatacaaaaattagccggatgtggtgacacgtgcctgtaatcccagctactcgggaggctgaggcaggagaatcgcatgaacctgggaggcagaggttgcagtaagccaagatggcgccactgcactccagcctgggtgacagagtgagactcccatctcaaaaaaagtaaataaataaataataattagcctattcaggtgaaaataaatgctgacatttcctgagggccttctatgtgtgatgcattttctgagcactttaaacgtagtatctcatttaactctctttaccaattaggaattgttattaaccaccttttacagatgaggatacagaggttaagcacctcagaactttggtggtctaacttcagaagtcctccaggcaaaactggagagatcaatgttttcaagactgaaaaggccctagaaatggcctcctgaacccttgctagaaagaaacctttcttctagtggagcacaccgggacccagtgattcttatggcaatgcctcttcctcccactgcaaaactgagggctgataacacactggcctcctggtggtcccagtttttttctaaaagttagtggcatcctggggatcttcaaggtgagggtgagaggtttctcctctaagcctgctcagcagcggggtacttctactcatcattcatgcaacatcataagaaaggtcttgagcactgtgagaggtctgatttattttaattgggaggtaaagacaactccaagacaactttgaaagaaaccagtaaacaattaccagcaaaatccagagagtgctctctctgacagtagttgagccatgtagtcttaggcagtggatgtttctccagatatttgattatcttgggtaattacttgtgtgggtgcgtacgtgtgtgtatgtgtgtgcattctaaaggcaaaaagggggttctgaaaatatctccagcgatatgtctttacatcccatgacatcagctgttacttgacgtgacaccagatgcagttcaaggtctgacattcagctggcttctgtttatatagtatggagaaacttttgttcccttgccctataaggcatgtaccaggagagattttgggaaaagttcacccagatagtaaataattctgctgagctttgaagtgaaaatgctccaggaacctttatcccatccttgccatttaactggtatgcttcggccactcttggtattaatgaatggtgtagatcagagtttgtttccattattctgttcatcagaggcacaatctcaaatcaaaattatattttatctttgttttgatctttctatgtttgggggaaagcactgtaaacatctcaaagagagagagaaaaaaagaatgaaatacacccccaggaaattctagttaaagacctaaagaatggcatctcagtggaaaagaattccactgtgaggtttggcttttttaaaaaaatagcctggtctttgaaaaacatattatctttcatgggtagggaaatatccaaattttgcccagcctattttacaataagaccttgaaaagctatgtgatgagctggaatgagaggagtttaaatttttgatgcaattctctgcctgggaaagtgataatgctgctcacataacagaaagagtattttctgctacagcacaacaatcaacataacgtctgggcatattaataatttcactcctaaacttctcgacagggagtgcatgggtcttaatagtattgtcaagatccttagggcaattgaaaaacccaaaatcattactttctactgataggctttcctctcccagaggaggccaaaatacctagggtaatgtagatttactgaaatgctcagataggcactgctcagacgtaactgtgtaataaaatcttctctttagaagggtccttctcagatatttcaagtggtcttttttattttgtctttgtcacttggaaagtagctaatggagatgacgctgatctcaagtaatactttcctgatgatttaggaaggcaaagaatgagtataggggcaatggtcaaatgatgtggcacctacgattaaaatccctttctgacccttcatgtgtgagaacgtgccctattggggcgggatggtcccaaattcacaatagctattaagctcttaacccaagggcagctactgacttggcacccagttcgagtccccttatcctttcttgtttcccctcccacaaatgtccctgcctgtgcctggctaggtgattacagccatgcctgaaccgctagaacaaattcccagctcgccctcagacattcacatgtgcaactcgttctcaaatgccatcacctaacaatctccatctgaagaatatcagcagctgcagggtctcagccaaaaaaaaaaaaaaggcctgcaggggacctgcttcaggttgccaggggaagatctttttaagtgctaggcagtgtgccccgtttgagattgaactttgactggctctgatggagctctgcaacagacagatgtcgtggttataataaacagagggaattgccatttccatgaaatgtccaggattggcacatccataggaacagagagtagattaacatttgccagaggctatgggagggaggaagggactgggccgtgactgctgatgggtatgttgtatcctttgagggtgatgaaaatgttctaaaattagatagtggtgatagttgcatatcttggtgaatatactaaagtaacactgaaatgtatacttttaaaagctgaattgtatgatatctcagtaaaactgttattttaaaaaagcagaagaggtgatcaggcagcaagtgccaggaaaaacaaccaaaaaacaaacaaagacggaggagtttgaagtcaccttccctctgtgtctagccatctccctgttaaaggagccctagaggtaacagaaatgagggaattaagtgggagggcatcattgattccagcaatcaactagaatgctctagggatagaggcagaaatctactctgatccctgtcctctgagactctaaatataactcccagggacatgatttgttcattcattcattcattcatcaccactagttttataccaggcactgtagccttatgctgggatatacagacaagtgagacagactgtttttaatggaggcactcatgatctagtggagagcacaggagagtccaaaaataatataaaaccatgtgctgagcgttacaaaagaaatataagcagtgggcaaatcaagcacccggggggggcacagatacgttacagttaaatacaaaatttaaggagagagaattatgttacttaacctccccacacctcagtctcctcatctttaaaggggagagcaatatcttctttaaagtgctttaaaggttattgtaagttttaaataagatgaaatatgtagagtgcttatcacacagttggtgcttactaaatgggagctattggacttaggtgatctaagatgtccctgccgaccctagtcctttacgaacgtaggcagagcggaggaaaactttgaattctgagcctgcaaatgattgctccttgtgactgtaattcccgtgttccgctatgcagtgttgatctgtgcgtcattgcgaatgcattcggaatgtttttctctgaggtcatatattttgtgtaagaaagagagctataaatcattccttacaggcaagcacagccctttctttctctgccctctgttcaggctgagcggggtgcttccttcaaggacagccccctgatacaggcctgtgcaacccaggccagaggcactggctagagctggagccagcggctggggagatgaggaggaggctacaacttgactcactccttcatcccccttcttgtttctcctccactctgaaatgtggaaaagctgcagctgcagcttgcgacagcagtgaccagatccaagaaagactgcagacaggccacctgccctgtgaagccagccataccatatgtgtgtcaataacaaaaaatgcaagtccattctttaggagataagtcattctgtaggtgttaagacagaaggaggaagcaaggtcattgtcccacatgcccagtacttagagacaaataaggaaatctcttcaaatatgggaggaggctggatttggacctattccttccatccctgggctcttggcaaagtacctcaggtcagagcaggacaggacaagctgggatggagtgtgcccttggttctgcccctgacaggcctaattgctgctcattcctcatgctgcccctcacgccgctggttagggagccagggatgcagcacagtgaaggaagtttggggagggcctttgggaaggcatagaaagagattgcactgcagtttggctgttctggcctatttctcctgattcaagcagcatccgtgaggtggtgcagagctttgaggtgggcgattccctccagtttctcacaagattggattctgccatttaagcaaatgtgcaaagaaatgagtccaggctgttttcctctgtatttgctaggcatatatcagccagggcaggggacctgtttcctccctgtgtgcctgtgttctggttttgggttcctttgcatacagctgggaggggaagagacctgggatcgtgtgccagctctaccacttactaagctatatgacatctggtgcattacttaacctctctgaacctcacttactggatctgtgaaatgggcatgataagtgacctgtctcctaggagtaagtgggaatatattgaaatgatttatgtacaacacttggcacagtacccgacacacagggagaacttaactcatggcagccatggacaatattattgttttgttatcatcagcatcaattgttttgcttatggaaatggagcagttctgaatcccgttttatttttgtgggctcttacagagacactcttgagactatctgttaatagctcctggccacgtcacttagtcactctgccctcctgctggccaaatttgaaggtggaggggtcagagattgatgattttgcagccaaatgcagccgcatgttcattgaatatccccctccaagaactgccatttcaaaggacttggaaaagttgggcccacagtgccctaggaggtactaatcattttcctcagagtcatagttgctatagctgccattgctattatcagaatgattaattatatcaaatagtaataatcataataatatgtgttaatagcttgctatgtaccatgaattgtgctaggctccttaaaaatatatttccatttgactctcctaacaatcatgtatgagaagtaagattactatatccattttacaagtgaacgactcagaaagaaaaatatgtcactttccagtgtccacacatctggtcagtggccaagcagggattcaagccaaccactagcctgaacatctgcaacagactctgtcctccttggatctaaccagacactgttattcttgaaaatcctcacccccaattccctctggccaattcaaggtcaaatttgaacagggtgtcctggtgccagttatcatcaaccagagattctcaagtctctgccaacaccatctcctcttttagaaactttaaattgctattgagatgtaacttgccctaaaaggtggttcaagagaagaaggcaaagagtttgtggttaatttgtcatctgagggtctgagggagttgaaaattttaaagaccaaccattggcatgccattcccaggaatgagtgatttattagcagctaggcaggccctgacttttatttttttctttcatatattttatcatcatttctaatcaccaggaaaaattggtgaagactatggcgcaagacaagcctggtttaatttgtctctgctttcccaccccatctatttgtcgatgcttggcaaaagtagacccaacctaaacacgtcctccagctgtttatttaggcagaatgcaacaacaatagtcgattattaacaatttcttccttagagcccctgaaagtcttcctttatatgttgtttaaaacgtgggcattgattgtttccccatgccgtgtgagcaactctaatggagtcaacacaaaagttgatatgccaaggtttttcacttcccacatctgactttatgggaattggtatcgttactcaacaaagaagcactgcttcatttttctcaagtttcactgccaaccggtaggcatttaggaaggacagactatgtgactggcatccctctcaaaatcaactggcaacaactgtcccacagaaaatctaaaagcgcagaagcacagaccattctttagcaggacagacagcagtgctcattcaagcccttgatttttaaacatacaggaaacatcttgtctataaattcacttatcatttccaggcaccttacttatacctcccctggtttttagtaaagagccaataagacagttccttcttcctaggactaaaagccacgcagtacctaaaaataaattccaggttctggactgaaggtaaatcaggtgcagtgtcaggtcagcaccaatattttaatgacagttgccttttgtctactaatagcatactgattaggttgatactgtgtaagaatttaccttatatagtttcttatgtttaaattgcattattatgtaatttcatatttatgtaatagaagagctcttagtaatatgcacattaattaaacccaataaatgtatggaacttacagtggacatgagggttccttcatcaagctgagttattcatctccgtttcatagtaagttgaagacatcagttgctttacagaagggcttttcatgtattttggctttttggaaagcaagagggcatgttgtcagcattgtttgcatttttgaaacagaaaaccttcccacccagcaagtgtgttggatgactgtagtgaaaagtgataaatgcaaaaaggtgcttgtgatcatttgttgtagcagaggtgcttcatactagaggtacgttactgatactgaataccaaggcacccgagtgaaactaggagtcaaaaacatactattaggcgtcagtaacataaatacatacagccagctaaattacgagaacagggatcgctagggttgatggcaaatcagataagccaccccacccctcacagcattcagctctatccagttgttttgaggggatacagactccatattttgggtttggttttgctttcaagagaagtcagaaatctggaacactatgcaaaatctcaactttgaatttttgataatattcagcttgagggctgtcagtctgtgacatctgccctagatagatgaaatttggatttaattttcctactcaaatctggggtccctgagagctgcagttatgtcttatccatcctttcatccctgaaagaacccatcactgttctctacacttggttttcggggacttgccaaccatcaggcagcatgcttagcactttacattcatccttcctctctaactttcacagcaaccttagcgggtagttactgctgttttcaccagttggcagatgagtaagctgagaatgaaagaaatgaggtagcacgcccaggttcacacaactagaaagtggcagactcaattcttgaacccagttctgtagattttatctcctaacctctagctaaatgcccctcctagatgttcccacattcctctgtatatatcccaggggtcacatttaccactctgtattgtaattgtcttttccttctgtctcctgcacctcgttgggaaatatgactgcaggatagatagacaaatgagcaaatataatcaatgccgtggtgaaaatgagcaacagttaggaggagaatgtcttccaataccgagaacgctggataatttttgtttttgttgctgtcaataatttgatctatctgcaatgaaatatcatcttgctttataggagggctgggtgagcggagaattaagtattcttccatcttcccttactcttccttctccatttcccccaggaagctctaggctttctcattaggataaatgaaaagagaacttgacctctcttctagttaactggaaaactcccaattcattttatttggaacataacacatggcacccaggtcggtgcttctcttccccctggggaccagccctggatattgtcagcacacaagcaaccgcaggaattctgcccacgcataacacagatggacctcacaagggccacacaagctggagtagataaggagaacttagctcagagtgaatacacaggaaggaggagggtctggtatctcatttagggaattaaatcctttatatggcctctttgtactttagaagagtgtgtggtctggagaggggagggtggggggccaggacagagggagatggaaagttaggacttagggctggggagggcaggttctcacttgtgcactgacccgccccatcttcctgaggcaagtctcgtaattacctaactaatggggaataatgacaccacttggatgggagttgagagagggggaaagaaaggcatgagaattcattaaccatgtgtgaggggcttggatagcatccctgaaggatcattattacatcatttcacccccctttcccacctctttccactaatatgagacagacaaatgctaaataactatgtaataatacattactagacagacaacaatgccagaaaatataatagcctgctacagctatgaaactctcccaaagatatatttaaaatgtcactgatgcataatgtaaaataggaattacaggttcatttggaggacatgatttaaaatctatacaactgtacagtggtatttcccactgggtttttgttgtcactgtccttttctaaacatcacaaagaaaacaaaaatcacccaaataatttcagcctagagatgcgaacttcaaggaacctgtttcctccacatttttccttcttgtttttgttggtcaggatgctctccaaacctagtatcttcttgacatgttgtcttttcttcagaatgtttctgcagcctgcacaggaaccccagaatgtagattacaccttttggagatgtagcccggccacataaggagacaagtagttgaaatttgtgtcaaattgcttgtttaaatgacttgagccaacttcttaaagccaggacagcaggggctgaggatttttaaagttggcaggggccaaaaatgacaaggctcagcagtcacctggtgagctgccagccctgactggaagcttcaaaaaataaaactttctcaaaggacacaaattaaaagtcatgtttcagcatccattaaaacgaaattataggcttcatcgcatagcaaactactttcattttcattatgcttaaaatatttcattttgtagattgagaatcggttgctaggaaaaccttgtgtggagttgtcagagacagcgatatctacaaggggatattttccaagggagagctctcctttgtttttcctgcaaggatagaggattttgttatttaaaaaaacgcaggatgcaatttggagtcggggtcatggcttgaaaacatctgccatgaccttctccagagaccgagtcctcagggttcatctctcagaggaaagaagttagcaacctgctgagctgagtgggctcacaggtgtgttttgttcactctcattttaaaatagatatatatgtgtatattacacatatacacatatatacacacatacatacgcaaatatgtgtgtatacacacatacatacgcaaatatgtgtgtatacacacatacatatatataaatctcattttgaattgtcaacatttttaaaaactaggaaattttatctacaagtccagatttccagcttttctagagaaattagaaattacggctgccttgagctctctccctcattcccacgtgatcaaattgacctggtgctgagtgagggctgccccctagtctcttcacctcaactcagtccttagctagcccactccaccttcctgcctagtccctataggtatttaaaggtactattccctgacttagagtgttccatattcttaatatcttcaaaagatgaaatttttgaaaagaatgtgtgcagtataccagtttacctggaaagggaatagggacttgctacgccagcgatcagccttgaatgtcatgttactttcattgcagtattaatatgtttcaaataattcctctggtcagcccttatccacctggttttgctaaattagtttctcattattcttcatttgatgcgtgtggataaatgcaaatcaaagcccattatttatttgtaactgactctgggatgcctgccgcagtcttatctgtcgctctagcttgcagctttcagcaattgtcagcttagagactttggtttgaaactctcctccagtggtttgcagagtgcctgagactggaatttgcagacgctaacagtcatttctcctttttttttcaggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggtaagtccccatcgccagctcacagtcacactcagtgtcaccttacccctgagtcaccacacagagccactgggtgtctcagagttccagtcggagagaccctctgggtataaataatgagacaagtttaccacctccttgttcccttggtaatttgaccctggacagtaggttgacaggtatttcttcgttcacatgtgtctccttttaaagcttgtttactttctcggatagctcttgtgtacccaactaatagaattagcataacatatttttactcgaaggctcatgggaaacatgcttataagggtatattgactgaaagctgctgataaattatgcatttggcctttcttgaagtaataaatgaagactcatttgaaattaagtgtttggggagaccttgagaaacaatccctgattccaaactgacagaagtataatttaaatttatatttcatccaacatgcagtctcactttaatccctcctgtacacactaacagcttgatgcctgtggggcaaacggtaatgtataaaaacaaacaagaaaaaaggggcagcacttacgtgaggagggaagagtttgaaaatgatctccaggtctggctttgttttgtgtagcctttgcttctgtccttttttcaccttcgattctgttctccaaaaccatatacaccttaatgatctgaaagaagacctgtcagtcagggtatggaggggctggaatgtcactgacagtgaaggctctgtgtgggttggccagactctgaaacagccttgctgctctatccccaggcacattcttggtttgtgtgtttcaaatgctattgtttccttgtctagaagaaccatggagacggaacagagaggagggctaattcatactgacccttcataaagttcccaaatagattttaaactttaataacttaggtttgaggaaagacagaaataatctgtaatgtttctgataatggccagtgaattctcttcacacagctggaagcaattttgaaagtagcatttggagttgtttcttacctataatttttttgtttttttataagatcctgaaaattaatatgttatacatctttgtcactataatcactccaaacttttaattttattttctgacaattataggatttttaaagaatttttgctttattaagagaaactaaaagaatgaacctaagctaataaatatccttgatctcaacattagtttaaaagaattggtacagaaataaataaaatgacacaaaatgaagcactaagccaaatacaaagggtgctgcattattattattttcctctgcaaaaaatacctaacgtgtgtgcacacacacactcactcacacacacacacacacaaacaaacacacacacaggctctcacacaaagaatggttacataacaaagtaaacgttataacaaccacatctgtttgactcttaatccaaactaacacgaaaaatctgtcaagacaattggggtaatttaaacacggattgggtatttaatgatattaagaatataattataattttattaggtgcagttttggcatgcatgtttggttcaaacattaaaaacattccaattgaggaatgaaaagctacgtatcgggtattatgcttttttaaaatttattatagtttaagttctgggatacatgtgcagaacgtgcaggttcgttacataggtataaacatgccatggtggtttcctgcacccatcaactggtcatctatattaggtatttctcctaatgctatccctcccctaggcccctgccccctcacaggccccagtgtgtgatgttcccctccctgtgtccatgtgttcttattgttcagctcccacttatgagtgagaacatgtggtgtttggttttctgttcctgtgttagtttgctgaggatgatggtttcccgcttcattcatgtccctgcaaaggacatgaactcatccttttgttatggctgcatagtattccatggtgtatatgtgccacattttctttatccagtctatcatggatgggcatttgggttggttccaagtctctgctattgtgaatagtgctgcaataaacatatgtgtgcatgtgtctttatagtagaatgatttataatcctttgggttcatacccagtaatgggattgctgggtcaaatggtatttctggttctagatccttgaggaatcaccacactgtctttcacaatggttgaatcaatttacactcccaccaacagtgtaaaagcattcctatttctccacatcctctccagcatctgttgtttcctgactttcaatgatcgccattgtaactggcatgagatgttatctcattgtggttttgatttgcatttctctaatgatcagtgataatgagctttttttcatatggttgttgcccacatgaatgtcttcttttgagaagtgtctgttcatatccttcacccaatttttgatggggttgtttgtttttttcttgtaaatttgtttaagttccttgtggattctagatattagccctttgtcagatggatagatggcaaaaattttctcccattctatagattgcctgttctctctgattatagtttattttgctgtggggaagctctttagtttaattagattccatttgtcaattttggctttctttgccattgctttttgtgtttttgtcatgaagtctttgcccatgcctatgtcctgaatggtattgcctaggttttcttctggggtttttatggttttaggttttgtgtttaagtctttaatccatcttgagttaatttttgtataaggcataaggaagtgttccagtttcagttttctgaatatagctagccagtttttccaacaccatttattaaatagggaatcctttccccattgcttgtttccatcgggtttgtcaaagatcagatggttgtagatgtatggtgttatttctggggcctctgttctgttccattggtctatatatctgttttggtaccagtaccatgctgttttggtaaatgtaaccttgtagtatagtttgaagtcaggtagcgtgatgactcctgttttgttctttttgcttaggctatatcacttggccgtatgggctcttttttggttccatattaaattttaagtagttttttctaattctgtgaagaaagtcaatggtagcttgatggggatagcattgaatctatgaattactttgggcagtgtggctattttcactatattgattcttcctatccatgagcatggaatgtttttccatttgtttgtgtcctctcatttcgttgagcagtggtttgtagtcctccttgaagaggtccttcacatcccttgtaagttggattcctaggtattttattctctttgtagcaattgtgaatgggagttcactcatgatttggctctctgtttgtctgttattggtgtataaaaatgcttgtgatttttgcatattgactttgtatcctgagactttgcttgaagttgcttatcaccttaaggagatttttgggcagagatgatggagttttctaaatatacaatcatatcatctgcaaacagaaacaatttgacctcctgtcttcctatttgaataccctttatttctttctcttgcctgatttccctcgccagaacttcgagtactatgttgaataggagtggtgagagagggcatccttgtcttgtgccggttttcaaagggaatgcttccagcttttggccattcagtgtgatattggctgtgggtctgtcataaataactcttattattttgagatatgtttcatcaatacctagtttattgagagtttttagcatgaaggggtgttaaattttattgaaggccttttctgcatctattgagataatcatgtggtttttgtcattggttctgtttatgtgattaattacatttattgatttgcgtatgttgaaccagccttgcatcccagggatgaaaccgacttgatcatggtggagaagctttttgatgtgctgctggcttcagtttgccagtattttattgaggattttcgcatcgatgttcagcagggatattggcctgaacttttctttttttgttgtgtctttgccaggttttgctatcaggatgatgctggcctcataaaatgagttagggaggagtccctctttttcaattgtttggaatagtttcagaaggaatggtaccagctcctttttgtacctctggtaggattcaactctgattccatctggttctgggcttttttttttgttggtaggctattaattactgcctcaatttcagaaattattattggtctattcagggattcgacttcttcctggtttagtcttgagagggtgtatgtgtccagcaatttatccatttcttctagattttctggtttatttgcatagagatgtttatagtattctctgatggtagtttgtatttctgtgggatcagtggtgatatcccctttatgattttttgttgtgtctatttgattcttctctcttttcttctttattagtctggccggcagtctatctattttgttaatcttctcaaaacacagctcctggattcattaattttttgaagggtttttcatgtctctatctccttcagttctgctctgatcttcgttatttcttgtcttctgttagcttttgattttgtttgctcttgcttctctagttctttgaattgtgatgttagggtgtcgattttagattgttcctgctttctcctatgggcatttagtgctataaatttccctctaaacactgctttagctgtgtcccagagattctggtacattgtgtctttgttctcattggtttcaaagaacttatttatttctgccttaattttgttatttacccagtagtcattcaggagcagattgttcagtttccatgtagttgtgcagatttgagtgagtttcttaatcctgagttctaatttgattgcactgtggtctgagagactgtttgttatgatttccattcttttgcatttgctggggagtgttttacttccaattatgtggtcaattttagaataagtgtgatgtggtactgagaagaatgtatattctgttgatttggggtggagagttctgcagatgtctattaggtccacttggtccagagctgagttcaagtcctgaatatccttcttaattttctgattgttgatctgtctaatattgacagtgaggtgttaaagtcacccattattattgcgtgggagtctaagttgctttgtagatctctaagaacttgctttatgaatctgggtgctcctgtattgggtgcatatatatttaggatagttagctcttcttgttgctttgatccctttaccattatgtaatggccttctttgtcttttttgatctttgttggtttaaagtctgtgttatcagagactaggattgcaacctttgcttttttgttttttgctttccatttgcttggtagacattcctccatccctttattttgagcctatatctgtctttgcatgtgagataggtctcctgaatacagcacactgatgggtcttgactctttatccaatttgccagtctgtgtcttttaattggggcatctagcctctttacatttagggttaatattgttatgtatgaattcgatcctgtcattatgatgctagctggttattttgcccgttggttgatgtagtttcttcatggtgttgatggtctttacaatttggtatgtttttgctgtggctggtaccagtttttcctttccatgtttagtgcctccttcaggagctcttgtaaggcaggcctggtggtgacaaaaatctctcagcatttgcttgtatgtaaaggattttatttctcctttgcttatgaagcttagtttgactggatatgaaattctgggttgaaaattcttttctttaagaatgttgaatattggcgcccactctcttctggcttgtagcgtgtctgcagagagatccactgttagtctgatgagcttccttttgtgggtaacttgacctttctctctggctgcccttaacattttttccttcatttcaaccttggtgaatctgacgattatgtgtcttggggttgctcttctcaaggagtatctttttggtgttttctgtatttcctgaacttgaatgttggcctgtcttgctaggttggggaagttctcctggataatatcctgaagagtgttttccaatttggttccattctgtccatcactttcaggtacaccaatcaaatgcaggtttggccctttcacatagtcccatatttcttggaggcttagttcattccttttcattcttttttttttttttttctttttttgagatggagtctcgctctgtcgcccaggctggagtgcagtggcgcgatctcggctcactgcaagctccgcctcccaggttcacgccattctcctgactcagcctccccagcagctgggactacaggcgcacaccaccacacccagctaatttttttgtattgttagtagagacggggtttcactgtgttagccaggatggtcttgatcttgtgttcatgctttatttcattaagttgatcttcaatccctgaaatcctttcttccacttaatctatttggctattgatacttgtgtatgcttcacgaagttcttgtgctgtgtttttcagctccctcaggtcacttatgttcttctctaaactggttattctagttagcaattcctctagccttttttcaaggttgttagcttccttgcattgggtcagaacatgctcctttagcttggaggagtttgttatttcccaccttctgaaacctacttttgtcaattcatcaaactcattcttcattgagttttgttcccttgctggtgaggacttgtgatcctttggatgagaagaggtgttctggtttttggaattttcagcctttttgcgctattttttcctcatctgtgtggatttatctacctttggtctttgatgttggtgaccttcagatgggttttctgagtggacgtcctttttgttgatggtgatgctattcctttctgtttgttagtttccagtcaggcccctcagctgcaggtctgctgaagtttgctggaggtccactccacaccctatttgcctgggtatcaccagcggaggctgcagacagcaaagactgctgcctgttccttcctctggaagcttcgcccagagggctacccaccagatgccagctggagctctcctgtatgaggtgtctgtcaacccatgctggtaggtgtctcccagtcaggaggcacgggggttagggacctacttgaggaggcagtctttcccttagcagagctcaagcactgtgctgggagatccgctgctctcttcagagccggcagggtgggaatgtttaagtctgctgaagctgtgcccacagccgccccttcccccaggtgctctgtcccagggagacgggagttttatctataagcctctgactgggtctgctgcctttctttcaaaggtaccctgcccagaaaggaggaatctagagaggcagtctggctacagcaggtttgctgagctgtggtgggctctgcccagtctgaacttcccagtggctttgtttacactgtgaggggaaaactacttactcaagcctcagtaatagtggaccccccctccctcccaccaagctggagcatcccaggtcaacttcagactgctgtgctggcagcaagaatttcaagccagtggatcttagcttgctgggctccatgggttgggatctgctgagctaaaccacttggctcccttgcttcagccccctttccaggggagtgaacggttctgtcttactagcgttccagtcacctctgtggtattaataaaaaaactcctgcagctaactcagtgtctgcccaaacggccacccagttttgtgcttgaaacccagggccctggtggtgtaggcacccaagggaatctcctggtctgtgggttgttaagacagtgggaaaagcacagtatctgggccggaatgcaccattcctcacagcacagtccctcacagcttcccttggctagaggagggagttccctgaccccttgtgcttcctgggtgaggcgacgccccgccctgcttcagcttgccctctgtgggctgtacccactgtctaaccagtcctagtgagatgagcctagtacttcagttagaaatgcagaaatcacctggcttctgtgttgatctcactgggagctgcagaccggagctgttcctattcggccatcttgccagccagcagaattataggttatttttaaccatgtctacaatcttaatctttaaaggttaaaatatgtaaagtcaataaaaactgtatataatagagatatttaaacttctgccctgatatggtaaaccattaataaacagctttgctggaagctgactggctggccaggcttaactcaggatattgtcaaagttgatggtggtcttaaaggctggatggtattttctgtctttttcctctccacacttacaaactgccatagagtttgttaattagtcagcctatttttacgttaacagactattatttgaaaaatagtttctggatataaatgctacttagaatggactagatgaagaagaagaaaggaaggaaagaaagggaagaggagatgtaatagctattgtagaaaaagaagaggaccaccatgaccattatcaatcagttgttattgtttagtttatatatgctgaacattaatgctttacgtgcattatctcactcaagcctgaaaacaatcctatgaagtaggaagggacttttattatggccatttaaagatgcagaatctagggatagagggacaaagtaacctgcaggaagtctaaagcttcagaaagatagtaaactatgagccatgttggatgaaacactggaagttcctacacccaaaataaggtggtggaatgtctgatgggtgaacaaccacaaatctaggtttattgccctagttgttacatttacaggaccagatccaccagagtgtctgctcttggcaatgagtcttcccttagtgataagaacacacgaaacacataaacatatctcccagctcccagctcctgatgcaatcagttggttttctagatttattttgaataactttttgtaataaagtgtcctcttgacaaatatctggtagagaggaccaatgaaaccacgcagatcactgtcctgctttcctaaagtaagctcttccagaatttactttctggtctagagtccttcttcagatcctttgaatatttggcttttctccaaggattaggacttctcaatgctaattttggaagaagcacattaaagaaaaaaattggtgggaagataggagtgccaaaaccttgacatccatcaaaaggaaaaaaaaaaaaatgagacaacatctgagtattctttgatccatatgttcaagagccaaggattagagctccttgggatggagttgttggcagaaatccagcacaaggtgcaaaacttggtaaatatttgaaactccactcatggaactgagcacatagaatatgcatctagtctcatgtatgaaaattctagtcatagtccatagaactgatgaaatgtatgattctgttttaaatattatttgtattagtttgttctcacactgctaataaagacatacccgagacccagtaatttatagaggaaacagatttaattgactgacagttcagcatgacgggggaggcctccagaaacttataatcatggtagaaagggaagcaaacacactcttcttcaacatggcagcatcaactgctgagcaaaaggggtgaaaaccccttataaaaccatcagatctcatgagaactcactcactatcacgacaacagtatgagggtaaccgcccccatgattaagatacctcccactgggtccctcccatgacacatgggaattatgggaactacaattcaagatgagatttgggtagggacacaaccaaaccgcattgttattagttcagtctcttattagcaaatatttattgagtcccttgtgtatgccaagagctatgttaggtactggcaagatactgattaaaacatgtattgtcccattaaagatcgtccaacctaaaggaggaggcaggtacataagcaaaaagatagttcaacatatacagtaatggaagtctaaaagttacagagattttatagtggaagaagcgatttactatccgagaaagatcaagaaaatttttatagctgaagggctgcttcagctgggttttgagggatgaataggaatttatctattacataagtaaagtcagatatgatagcatattattatttgttctcattcaccactgtttttccatatagtcttagcaatagataattgaatgaattccctgattcaaatgctaaaatattgtgagtttattggtgtcaatttcttagccatgagagagtatagatatgggatttcttctttttaggagcatgatgccatgctagtatttccatttctgtctttcataccaaataagaattggtctctctccaggagagagaaccattaaaagcaagacattctgaaggttgattataatttagtcaccatttttgaaaatgtggtgtaaatttacaaacagcttgaccacccttactctcattaatacagatttctgggtttgatggaataatttcaaaactctgagaggtaatgagcaggcattctgccactcccagaatgcaaagcgtgtctctttagtccagtgtgtctccttagaccagtggggagtgggtcctttcctctctgcattgctctcttgatgtccccatcagtcttaatgaagcatgttagatcttctctgaactatgctgcttttttttttctatgatgagtacattggaggggctgattaaggaggcataaccagaaaataggactgtttggaatttaacaaaagacaaacaagcatataagggaagttctgcatcaatgtaaaataaaagaacaatgcatataaatttgtactaccaaaagcagtctattcatgtataaaccataatataatccaacgaaaatcaaacataaggcagaactaactgcaagcagtctgtactgtcttttcttaagtagtgtgttacagaatccctctaccctccaccttcctcccagcctattcacagaaggttttgaaacaaagtctacttgcaattcttgttcaatatcacctatctactccttcctctgctgaaagtgacaaggtgagaaatcttcccggtcggctgcttctttgggagtttctaaagtcaacttctcttgtctaaaacagtagaaagtagctcagtgacagaacctaacttttcttcctttgtgtgttttgctgaagcaagcgtctctctttggatctgtctgagcagtagatcacaaaaaagagtccctaagcaggacaaaacttctctctgagttcacttttgccctgacatactagaagccctaattttaatcatcaagatcctcaagctgcaaaacggtttgcaatttgcctttttaaatggtcattcattaattattctagaaatagctatgagaacctaccatgtgtcaggcactgaggatccggcaaaggagaaaaacaaaacctctgtccttatggagattctaggctggaagcagacagaacataaacaaatgtcccttacaccatgacaaatgcagtaagtgccacagacggctgaagaagccagacccataagaaatggacatttaagctgagcccttaaggatgagtaggggttaatcaggcttaaagagtgctctagatcacaaaaacaatgagccactaggggcagaaacactaaggtgccagaaagagaaagcaagagaaagcaaactagaaaggtaggcaagggcaagatggatcaaggctttggaccatgttaaagcttttggactctacctcgagaacaattaaaagtcactgaagctttttaagcaggagagcaaaataataagatacactctgctttttgcttttaataatgatagctgccctatgataaatggattggggggcagttagagtggaaagtatgcaagactaaaggtccagtttggaaaataaaataatagttaagataaaaagtggcatgcctttgattagggagtggtgctgaatattcaaagatgtgaggtatagtttgaaggtaggatcagtagaaattaatgattgctgggatttgaagatgaaggttaggattcttcaagtttttgacttagatgtctgggtgaatagcaatgtcatgtgctgaagaaggaacaggtttttgtggcagaaaacaaaagttcagttttggacatgttacatttatgaggcaagagaattgagtgcagttattggccagacttattttgattctaaaataatatgtataacacagaaaatcatccatttacagataatagcatatgtagtatatccaaagccctcagcaattgatttttctctttaaaaaatgtctctccaggccagatgcagtggttcatacctataatcccagtaatctgggaggttgagatggaagaatctcttgagcccaggatgtggaggctgcagtaagctatgatcacacccctgcgctccatcctgggtgatagcgtgagattccatcttaaaaaaaaagaaaaaaaattctctccagaaatttgttaaatttatttcacacaatcatataggcctgtgaatactaacttttctttgtcaaatactttttgcttggcactaagctttacctacaggatcccatttaatcccttaagctctttgttaggtatatgttactatccatatttaaaatacagggaaaccagggctgggggaattaagttatttacatgtcacccattagtaagtgacagagctgaaatttgaacctgggttgacctgactttaaatcccatattcttaatgaccatatgataatgcctggggaactaggaagggcgggggctggaaaaaactctgtctagcctgatggcaaacaacaaattaatttgcttaggccatgaaatgaagtcaatgcattacaagtggcataaggcgagaaatgatctatgggatgaactccagcctgttactggacatagacttagtcattgtcaaactcataagccaggccagatgcaagagacccttctctgaagctctgaggaattggtggcaacccggatggtaaatctgaggcctcaccactccatggtggtggcagcatagcatatgatttacggggagaggttttatgccctgcatattataaaatatgagtgcagattgacaagggagaattaagaagcacagctacttgtttagctctgcaactcgtaggatctttttcattctaaacagagctctgccagattgctgggagaaagcgcaacagccatgggtgccatggctgacccttggggcatcccttgaatatcatccttgttcctgttagcaggaagcatgacaagtgctcagaaaaagaattgagcatgttgggcttgctgagtggtatctaaggaatctaattttggtgtcagaatttttaaaaacacactttttgtcttcaagaagaagcaatcttagactaatctggatgccttattggtagtgcgtatttggaaatcgagattcaagaccttcagtaaatgaggctttcacagagaagaaacaagattgttgaaacatcttcaccatgctgagtgcaaagactattccaaacttgttctcagattgatttttctacctaaggattaattttctgacagaatcactgacaagcctgatctttagaatattaaacctaggcaacctgtttgcttttttgtttgttttttaatgttttcaagtgaggtttaaaggtaggattcattctgggtgaaccaaatgcatcgaagcactttcaaatcaataggcagcttgatttctctgtattgcaaaacattatgccccctctaaattctcatcacaggcaacatggaaattaatgagacctttagattagcctttcaagctcagccttattttatagctttaccttgcctttttgacaccacgatctcgcctggccaccagcagcatttcatgttgcagtgcactttaattttgcagttttcttagtcttccttggaaactggcagcttattaatctcaataactgagctgctcaataggcaagctcaccaatgagagaccaggctgtgtcttttttttttcttggcagatggaaacaagggggttggttgttggatggaggcaagggaggtggcagagaaaaagctggttaggaggggcacctcatcccccacatcactttctgataattggcaggaaaataaagcaagcctagtctaatccactgctctgtaatttatggcttgtggtgttaaacacactcgaacccattaataagaaaataaataaagtgttgtggcacgtgtgcaaattacaaggtgcattaagaaagaaacaagcattacatcttattcaagaccactccagcctattcttggcatggtctgcaaacttggaagcatcctggaaagtggaggtacctaaggagaagctgtcctttttaaatttgcctgcctctacaaaattaaaaacttattgaggaattgaacttcttattgcagggtaccacagctaagtctctaggtagaaagaacttaaaaaaaagaaaaataaaaatccatccctcagcagcctttaccgtggggacccaattacaaattgagaccaccctgtggtcatgcattgtaagagcaagactttgccctgagtctgtgtaaatgtcgaagactctggggttaagttcacagttgaaaaaagccaaatatttccatctctgtctgtgctctttcacccattcaactaatatcaactgtcattcccttgaggcacttcctgaagtcttcccagaggatattttatctggctcagacagggagaaacttgatgaagcgcaagtcctttctaattctggctccctgatgatccttttcttttcgcagaagccagataaggcatccgcagtcctaccaggcaggggaagtaggtcctgcaacttttctgaaggcacctttgatttattagtcttggccttatttgcttttgtgagttggaatcttatgtccccagacttgcaaaccgtcacgagatactcagccattctgctcagctgcagctgcatcctttagattttatgggaatgtttaaaaaaacttttcctacattaggtttttttctttcaaaacccaccagacaatttggggccattctgtgagtattctttgcaaatactcctttgagaggtcatggcaaagcgctgcacaaaggatcaccctcaaaatcgtgtatttttcaaatcccttattgaatcatttcttgctcaaaataactgtttaggagtgaggaaatacctccaattgctgtcatttgtacttaagctgtgtatgccttatagttcaaaagagactgaataccaattcttttctatgtgttaaatggtactgaaatcagatttcaatttgctagagcttcaattgcgaaccagcattcatgagtccatttctcaacaattaatactcctgtaaaggtattgcacaccaataatacgacctttaaatttttattttattttttaattatttgaacaaagggttaaaatcccgccctaaagggaaggtgggaaatgttgctttacttaacactggtatgttcttagataagaattttcgatgatcttagtgactttcttatttcttatcaacgcagatcctctccactatacttggggacatgtaatgagaaggcacagggagctattaggcccactgaagcatttggtgggactctaaggagctctactctcccccatccccactctcaccaattcaggaaaatgaaggaataaatttacaagccccctgtgcaaggggcggtgctatgcacatgtgcattttctggatgttcttgtactcagtcatcttttccagcttctaactctcagaatccatacaaggagacattgtagttctattgacaatcttttcacttcttggaaaccacggaccactccttttggtctttgtttttagacataatcatctctgaaatgccgactttgtgcccagtaggatactaggcactttacatcatgttatctgaattaaagcccttaggggagagatgttgatagggtttggctgtgttgacacccaaatctcatcttgaattgtagctccaacaattcccacgtgttgtggtagggacctgctggtgggagttaatttaatcatgggggcgggtctttcccatgctcttctcgtggtagtgaataagtctcatgagatctgatggttttataagggggagtttccctacacaagcactctctttgcctgctgtcatccatgtgagacgtgacttgctcctccttgccttctgccatgactgtgaggcctcctcagccatgtggaactgtaagtccattaaacctctttctctttataaattacccagtctcgggtatgtctttattagcagcgtaagaacagaccaatacagatgttcttgtcccctttcaacatatcaggaaaatgaaacttgagaaagtggaggatttgggacagagagaagatcctgacagaacaggattcaagtaatacttaaactcaggctttgggagtctctcagccttgcacttctttactttctaccatcgctgttatgtaggcctcctcttgtgggatttttatggtaactatatgctatattctcaaagcttagaaacctaacagaaagtaaagcacttcttgacatttcaacaacactcccttgattgagtctcatggaatccaactagagtcacatgcccacaactgacccaagcctcaagcctggagtcttggcgagcagaccacattaattggccaggcctggatcacgtgcccatgtgggggcctcatagtggagaggaaggagtgtggcccataaccaaacatcgtgctattaggagaccctgaaatggagggctggcaggcaaaagccacagaccaactcaggccacattcaatgttaatttggtcacagcccagctcatattgcctgattgtaatgattttctcctccaggcagacacagtcccggccagggtggggaaattgcaggacattgagttatctcacttgccagagcacagaagggggtttacagctgattccaataagaagtcgaaaaaattaagtttcactgactaacttctgcccccttctgactcatcaccctctctggttgacttctcaaacgtcccacgactttacttttgagttcactgtggccacttaatgcattttaacttttattagtctcctgacatctcttttaagctatcatcttctttcctgcaaaagtgcttggattccacattttctaattaaaacatgctcatttattgtcttactaaccagtgctctttatgagggctcatgatgagaaagttaactcaaaacatctcgatgcatttcctctctcttggaaatggctggagaagcagttttgccttatcaagttgaatgacttcgaagaacttttggttttgctttttaataaaaccatgaatgggaaacatttaactccatgcttcaagctcctaatattctcagcaatgcagtatattctgtttgttgtggtgtgtgtaggtgagacagattgcaggggtcagatagctccataatgagtataggtaatatcagaatagttctgtgtttaattagataaaaatttttgtcctaacatgcaacacgtcctaatgttcataatggtgcccattgctgtttatactccagtgaattaatctgatattattagaggttgtaagcttcagtgcagcagggggtaagggtggcacacatgcatttaaacccaccgagaatttcaatataatcgtgtgtgtggtggcactggggtgggctgggaacaaggtagaaggcgcatattcagtatatgtctgcgtatactttgttttttcagtttcactactatttgctttgtctttggaaacataaaagcagtgttacaatggggacatcctcatgtcctgtcgataatgtgcatcttcaaattcataataccattcagtttggggaaaagagcgaagtatagcattcttcacagagcttaccccaaatagctaattcaggcagaaagggagagacagagatagagatagagatgatagagatagagacagagatagagataaagagagagagatggagatagagataaagggaggcagagagagagagagaaagaaaggggaaaaagggacctggtgatgcagatatggaaaaaaatagatgccctcttcagggaggtcggcccttgattctgaccactacattagaaaatattagaaggagtcaaggtcaacatgaattgggttggccaaaacaactgagcccagctggacgcggtgcctcacacctgtaatcccagaactttgggaggccgaggcaggtggatcacttgaggtcaggagttcaagaccagcctgacgaacatggtgaaacttcgtgtctattaaaaatactaaaattagccaggcgtggtggtgcacgcctataatcccagctacttgggaggctgaggcaggagaattgcttgaacctgggaggcgaaggttgcagtgagccaagatcgcgccactgcactccagcctgggtgacagagtgagactccatctaaaacaaacaaacaaacaaaacaaaacaaaacaaaacaaaaacaaaaaaaaccctgagccctgatcatttaagtgaaggggtcatcatttggctgcacagaggcagagttttcaaactggaaaccaagttaagatcacctagtatagtccaatgtctatttttacagacaaggagagtgaagctcagaaagttccacaacacgccagcgccttccactataaatgccggagtggggctggaaggcaggcctctggccagagctttccccagcacccctcactatttcctgcatgattagggaatgttggtgcctacttatcccacacagaatatttatctccatttccttctgcaaaggaaaggtcatgaatttaaggcaaagaattagagcacatattgcaacagcttttgtcttttcagttattttattgtagaatgtacacattctcttggtaaaatattcaacacatagacagaaaatggaaaggaatattccctgcttttcaatttccattttcaaggaaatttcatttgaaggttgattattttaggctttcaaaaatgcttgtggatgtctgagcatgtatattttaagtttaatataaatggaatcatatacatatcatttggcaacttcctttttatcacttaatcagatattgtggaagcattttcaggtaattttatgtagacttacctcattcttgtttaaagtccgtgtaatattccataatgctctaatttatttaaccagtctcttcttgatggacatttagatcgctttcagaattttgctattaaaaacaaatctgtaatgaaacatcttgtgtatatatctttctttgcatacttatataattatattcaaaagttaaattcctggaagtgaaattactagatcaaagggtatgtataatgtgcattttgaattttgatcgattgtgccaaattgtatctgtctccattcaaatgttacgatctctctttacttctccttatttgatggcctgagtttcttttgtggctttaaaataagagcccagaagtttatggtgttagatttcagacatagaattaagaggattttttttcaagtaataatgtaataaataatacataaataccctagaaatgccaatacctcttcttaatgccagatatagtatgagaaacagacatagctgcaggggaaaatctgactctctcactccccttggttctagctgtagggccctttctcttcattcccagactgtgctacagcatggcctacgtgattcaaaactcctaacctttgttgcctttcctttctcattattatttggcaatgtttgagtttgcctcttctcctcatccaccttgcctctatctacctaatggggatattataagaatgtctaaaaagacctagtcaagtttctgaatcccaagagaaatgcctagtaaggcggtatgattgtttaactattacagaaaagcattatgatcaagggcttgaaaatctggcgaggaagacagccttttttgtgaaataagtatgtgagggctctgtcagtaagaggccctcaggccaaacttatatagttactttatctgaaactctgattttatgctaactaaggatttttgtatttcccacctcctgttggtaatcccattaccagctgtgttcataggacttcagcttaattcagccaacatttgtaggggcccaacacgcagctgagcaccatggcacagagagtgaaagatcgaaaagacatggcccctgacctctgggaatcacagtctagtgggagaaaggtcacagagcagattatttatattgatataggatgttgtaagctggacatgagctcaggggactctacggaagcatggagcgtggagtgcatccaacctacctggtcagggaagcctggctggcagatacggggtctgagttccatctgggtggaacagtgagagctgccccagcaaaagggcattccaggcaaaggtgagagaataggaaaaggccggaagagcaaggctgtgccagcattctggaccaaccagagtgagactcaggaggcagggtagagaggtctcatggcccaagtcaaggtcaccttctgggtgcagtcaagcactctaaggtctattcagtgtgggatggggagcccaaaagggatgtacacaaaggcatgttacggttagatttgccatgaagaggtggaaagggaggatacaccagaaagggaggaaactaaaagtacattgaagttaaccagtgcctctgatggaagaaggaagggagaaagggagggagggagggagggaggaaggaaggaaggagaaggaaggaagggaggaaaggagggagggagggaggaaggaaggaaggaagggaaggaaggaagggaggaaaggagggaggaaggaaggaaggaaggaaggaagggaaggaaggaagggaggaaaggagggagggagggaggaaggaaggaaggaagggagaaagggagggagggagggagggagggaggaaggaaggaaggaagggaaggaaggaagggaggaaaggagggaggaaggaaggaaggaaggaaggaagggaaggaaggaagggaggaaaggagggaggaaggaaggaaggaaggaaggaagggaaggaaggaagggaggaaaggagggagaaggaaagaaggaaggagggaggaaggaaggaaggaaaaagggagggaggggtggaggaaggagggaagaaagaaggaaggaaaggggaactagaaggaaagagatacatacttaaagtaggcagtctatgggattcattgataattatctgcataacagtaatagccaacatttattgaggatccactcaatgtcaggtgtgtgctgagccactcatttaatagacacaatattcctaagaaatactttccatcattttcactattttcatatgaggaaacgaagatgtaataataacaagtcatttgccttaggctgcacaggttaaaggtgaggcaaccaggctctgaccccacctgctgccgacagtttccttattaaccatcgccccatccagcctcctagaatcagcagggctgtcccaacctgaccgactgtgaccctgaacttccctcttcttccttgcttctcctctctatcacttctcttccccctccttcctcacttccctccacagaaatgcagacattgctttgtttttcacataaccacttaatttcttgtcaagcaaaacttgagagccagaaaggatcccagttcaagtccaagccttcaagatgtctggaaaggcagcctccccactaccagacttgcctttaggttttgtttaattctgccacttgcaaagcaaatgcctgaaggcgggcacctgccttttagtctaacatgccacctccctgtcaggcaaatttcaatttaccatgcctcggcttgtccaactgtatctgcatcaatacttccaagatggcagtgacaagcttttcaggtacttaaggcaaacctgcatgacagttttccttgacacttgcatttttaaaaagccttgcctggggccctaggaaacccagcatttaagaaactaggaagctttcaaggaagcccagctttcagaacctgctgccctgggacttgttttgtgatagggatgctgcagggtctgccttagagtatattaagtgccatggcgatatttatgtgttgatgctaaatgatggttacctttcttagtggcatttttttttttttgacgactgaaatatatagatctgttttgtgcattgtcagtgggtatgtgtctggcctacaaacacacttaaatggcacacttctgcacaacattcctgagtgtccaacagatatatgtaggcaggcagacatgtcacaggggttgccataaagcttagttaatatccctgaagagctcttgtgtcatttcatgaagagttctaaataagaagaaaatattgtacctatggctattacacaaacaaagaaatgtgagtaaatatgcagatagggtttcttctgtttgctcatgcctcaaagagtctgatgtaaattcaaatgggaaaatagatagtaatagagatcactactgtttatttgagggttaaaaaaaaaaaaagcaacagtgccccaaacttaaatgcttgaaattgctatacacagttgatgtgagaggagcaaatctataataagcaaaaaggagtggcagctttctttttcttttgttttctttcacctctgccagcccctacatttagaattgttttgatgacttaagaattgtcagtagctatacaagaattcggataaatcaattttgttttccttcctcggccttgaagaaatcacatatgatacttagtctgtcccctttaatttttacaccatttatataccttcctctttctcttctttccttccttccttcatccatctacccagcaaatgcatcttgagcacctatgaaaataaccattatgggttttttggttggttggttgttttttcacttctttctgggccttaggatactgatctagaaacagagagaaatgaattagaacttcatttctcaaatgagagatgctgtggaataccagttttacggctgagaagaagggtatatatatataaagctcacaaaaataagtggaataataaatagtgtagagtactgggatatttatgatatttaagtattaggtttgtgaagacctgcagtaatgtttactccatttcccaaatatcatggaaccctctctgtatctaacattagtaatatacaaatatacttggtgatccaaaaagcacattttaagatgttgtatttcagatcctctctgatcttatgacagaagtagaaaggccagaattttttcaatcccttactaggaaggactttgtgatcttgccttctaaaataaaatagaatttttctcttagcataaacttttaaaatgaatttatacccaaactcaattatcaagtcaggcaatatttgggcttggtacataagtactgtttataatacagtgcttagagtgtaggctaacaataaaaacttttgtttaaaaatttcatggatatcattgggtatatacccaaatgaatataaattattctactgtaaagatgcgtgcatgtgtatgttcattgcagcactattcacaatagtgaagatatggaatcaactaaatgcccatcaatggtagactagataaagaagatgtggtacatatacaccatggaatactatgcagccataaaaaatgagatcatgtcttttgtgggaacatggatggagctagagaccattatccttagcaaactaacacaggaacagaaaaccaaataccacatgtttttaattataagtgggagctaaatgatgagatgagaacacatggacacaaaaagggaagcaacagacactgggtcctacttgagggtggagggtgggagaagagagaggatcagaagaaaaaattcctattgggtacaatgcttagaacctgggtgacaaaataacctgtacaccaaacccccatgacacgagtttatctatataacaaacctacacatgtacccctcaaccttaaataaaagtttaaaggaaaaaagaaaagtatgtctatcacatattaaaataagacgagtgattatataaaaaattgaagaacttaaactgatgcatgagttcttctaaatactttatataatacatcaaataaaatagaaaaaaatgtcatggatcgatagctttcctagaatataaaccccactaggctctccctgaaagctctttcctgaaatgagagcctgctgacttggggatgttaagacattttctaaggtatgaaatattttggctctttctactactgctgccacctggctccttggtgatgcttcttgttttgtaattcattaacagttttcaaaaacaagctcaggatatggataggatgcagagagactggcaaaatgcttactgtcaaccagaatttgagcttcctgaagagttcaatgttgattatcattttctacatttagaaaacatttagaggtttctcaaaaagttaaccattttatgaccatattatgtagttgggatgtttgtcctctccatgtcccatgttggaatgtgatccccaatgttggaggcgggccctggtgggaggtgtttgggtcatgggggtggatctctcatgatcaacttggtgccttcctcccggtaatgaataagtttttgctctattagttcctgcaagatctgatcatttcaaaagagcctggtacctcctgctctctttctacctctcttgccatgtgatgccagctccccttcccctctgccatgattggaagcttcctgaggtccttaccagaagcatatgctgatgcattgcttcttttacagcctgcagaatcaggagccaaataaacaccttttctttgtaaattacccagtctcagggtctccttaatagcaacacaaagtgtactgaggcacctctatgatgcagcaattcctctcctagggagatcccccaaagctttcaaagcaggtgctcagacagacattttcacaccagtgtttgtagcagtactatttacaatagtcaaaaggtggaaacaacccaaacgttcatcaatggatgaatgaataaagaaaaagtgtacacacacactcacacaaaaggaaatagtattccaaaagggaatgaagtgctgatacatgctacaatggggatgaacttgaaaacattatgctaagtgaaaagaagccagacacaaaaggtcacatattgtatgagtccatttatctgacatatccagaataggcaaattcatagagacagaaaccaaattagtggttgccaggagctgggagtgagagagtgaaggaatggcgagttactgtttaatagattttggggggaatttgaggttttttggggggtgatgaaaatgttttggaacttaaatagaggcagaatttaaacatcgtgaatgctctaaatgccactgaattgtgcaattagaaatggttaattttgtatcatgtgaattttacctcaacttttataaataaattaattaattagagaaaatagccggaggatcagcgtgtcaccctctgtataaaacgtctactcaagggagagacaacaagatagttaggctagagaaccagtctcttgctccagtcttctcctagaaaggtgccaggaaaaaaaatgtctgttctcaaaacattccttgaaagggttaaagtcacaacacaaaatacccagtacatgtgatttgattaatagtggtaaatggatctgagtgtgtaatatgttgacatctgaaagactgtcaacaggatccccattcaacatcagggtaaatgcaactcttcagacagatgtcttgaagcaccaaagataaggaaataaagaaaggtgcaccaggcaggactcctttgttacacaggtagggggaaaagagaatgctaaatggattcttctctaggtggagggggatcaacataggatttttccaagattaaaaccattctatcatattctattaaaagtgatttagaagagaaaaatgcaccatgaaatctccatgtttgcagagataccaaacctaggaagataaactgctctgtaggtgggcagagaggtgacagataaggatcacgtacatttaccaaaaattcttctagacttataggaagattatctctgaggtcccagttacaaactgggaactggccaggtgattcgtgtgaagtaatgcctgaagatatacatccactgggttgctgtgggaagaaagaaggggatagggctgcaaaatacagagcatccctatagaaactcttagaaattaatcaaaaatgcattatcccacgattttccaaaatcattaggtatctacagtggaaataatcatgattatagctgatatccctcaagaatgacagaaaacttgaggagaattccaatctaaaagatcaataaaatgaagaggctctcacaaaacacaccaaagtgctcctttgaatagaaggaagatgacttcacaacagattttaaaaaataaccgtgtgtaggaataatacgaacatgatgttgtttatcgaaatcttgaaaaccagagtgacgggattccttgaaaaggacactaccgggaaaataaataaaagtgttgcatctgagagcagagagaaactttttacattcatcacctcctacaggcagtatgagatgatctttcaagatcttttcaagctctatattggttcatgcctttattcattaaataaaaattgttggaacaccaaacctgggctgggcattcttccaggggctggagatacaatggtgaggaagaagatgaaatcctggccctcctggaatgtgcatgccattgggaaaggcatgtgacaaacaaggaatgaaggagatagctgcccaaggtgatgcatgttaaatgagatatctcaatgaagggtgagggaaatgggcctttgtattccacccccatctctggatgttgactgttctcagctgtaaccttggacaaggtaggatgcaagatgctacgatgggaaaggctgatcaagaaatcctttctgaggaagtgagctttgaggagagacttgaaagacctgagaaagaggagccatgcaatgagaagacagaaagagaggaggagagaagtttccagactgagggaaacacagtgtgaccacctggacatggggaggagcttggcctctttaaggaacagcaaagaggatggcaggtgccttaggagcagagcacggagaggttaggaagagatgacctcgaccatcacaagacgccttataggccatgatgcagagcaggataacttctaagtgtaaaggaatgggaagatttgaaatatgttttgatttatgtttgtaggaaatgactgactcctgtggggagaaggggtgtaatgggtaaagtggaaagagggagacctctttaaagattgctgtgtgcagcaggccaggcgcaagatgatgtagaggtgtgagtggtaagaaaaggaaggggatgtgttggaggcaaagaggaaatcaactgatgatggattgggtgtgagagaaggacaggaaccatggtgaagcctagtgaagtagatggcatggtgcccacccagatgtcacccttcaggactggagcaggtgtccttccagttgctggtaatgttggcagccaacagagctcagccaagtccctccctgagattggccttcagcagaagagatccacgtcttccaaggacctttctctgggaacagctcacatccagtgactggtccgagtaaggatatgaaggcccagcctcctttgccctaactggaacaactcagcagagccatccctgctccagagctttccatggaatcgccataggcccctctgccacagcatcacagttcagctccccgccatccccacccagggcagtctgcttcattcacttcctcacacatggtcttcccaagagcactttctaatacacttcctgcatgcaatatcttcccattcctagggatggctcctgcacaactggagaagtgatgacatctgtaactgatataggtgaagcctggaagagaagagaagcttggagtggaaatcaaaagttgtgttttggtcatgctaaacttgagatgcctaactatatccaaatgtagatagggtaataggtgtaatattgtgggctggctagaatattctggacaaaaaccaaaaccctcaaggcagaggtataagaagacagctgagctctttcatcacaaaggcctgtgctgaattccccatgagtctctcctaccctagtaatttttcagatagaatgctcctaaatgtgctttgctaactcaaagagatggcatagttagaacccttcgtacttggtctaaaatccagatccccttggccaggcatggtggctcatgcctttaatgccagcactttgggacggcagatcacctgaggtcaggagttcaagaccagctttgccaacatggcaaaacttcgtctctactaaaaatacaaaaattaggcaggcgtggtggcgtgcacctgtaatcccagctactagggaggctgaggcaggagaattgcttgaacctgggaggcggaggttgccatgagctgacatcacaccactgcactccagcctgggcaacaagagtgaagctctgtttcagaccaaaaaaaaaaaaaaaagaaaaaagaaaaaaagaaaatccagatcccatgccttcaagccatggttactggctaccttttcttcctgccactggcccggaacacactgcccttctttcacatcctcaaaaattccgtctttcccaccccagggactttgcacaggctgctcctgctgcctgggatgctcttttttaccattcttcatatggtcagttacttcttatcctcagacttctcctcaatcccatggtgcttctgacattttgaaagtatttcatgtatttattgtttacctggatgtgagttctgtttatttgttctgtctctccaattggaaatttcctatgaggataagaacttactcatcaatgcatccaagcatctagtaccatgtgatatatattccatgctcaataaatactggctgggcagtgatttcatatttgagatattgtgttcattgcagaggtggaggcaatgcagtacatacatatattaaacacttcctgtgggcccgcttctgtgttctcggattgtattcctgttctttttcagcccttccaatagttctgggatgtaaatattgctattgtctctatttttttagaggaggcatctgaggaccagggagaatacctagctttccccacatcatgcagctcctggaggagttgagatttgagtccaggtgcacctggctccaagcccattcattttcccctctaccataattagtgaattccttcagcagactttttgagcacctactatgaagagggaagggtaccagaaagcaaaagagagagagcctgactttgtaatttgacttaagaaacaagacaaaaacaaatgtaatcacatgaagcagaataacctagagggtccttccagcttgaacactgtctaactgtctgaatggtccagacactaaatgcaatgggagaaattatcctgctccttggctgtgtctgagggtgtgcattttttcttcatctacctctacctgccggtgaacacaaatttaagtccattcgaaatggctgtctggacactcccatatgatagtgcatagcgaattcaaggtcaaatctaaagtcaaagtcagacgtctttgtttttcttcccctactatatcaagactcttaccaattaacttgaaaaaagtcaccaagttaacaactccagagggggaaaaagaagaagaaaaaaaaaaaagactcttcatctcatccaaagactctgaaatggatttgctcacaaaacaccaggtttctttaatgacctcgagagaccttgcctgtcacactgagcagtatatcatttcatggaggaaaaaaaaagttttaccatgaaaaatgctatgttgtatcacagtgtgacactatttaaatatcaagagtcgaagcttctatttagaaaacggaaggcaataaattgagttgctaattattccagctgtgaatatttttggtacggctgcaaattttgaagagggcaaaatagaggattttcctgttgttcacggcatatgcaaatgtagtggcagtcccctatgagccgaaaggttcagggatgagaaaccttgaaagcctatttttttcctgaatcaaacgggcttgagtcgaagcttagggaactatgatataaaatggacttttgactacactaattgggttattggcttcttgtttttcaaacctgagaagtaacgattttaaaaactgtaagtcctattttaaaggaaacaattcacttctcaacctaagcataaattctcaactggaagaagagaagaagcacattagtaacatccctagtcccttctcttcctaggggacagtgagtggaggtgcctgcaattctccaatcaccaggctaattagaacgactcattcattcaacacatattttaaatcagctgggcactatgctcggtcaaggagatttagtaatggctaaaatatactatacacggctcctgccctcaagccattaatatctgcatttattgaccattcactggatgtcaatctcaatgctaagcatttcacgaataaactcacccaatccccctaacaagcccaagaagtagctactatcattctcagcctcctagcaaggttaagtaacttgcccaagatcacacagtgataaatatagaagccaggatgcaaaccctggttgtctcagtctaggatttgcagacttaaaactgccttctaggtaccatcctattggatttcttaaataattaaatgaataataatcatgatgatgacaatgaggaaatgtttctatgtagaaaaagaaggctgactacaaacatcagatgtttaccagtctatctctaaagtacaggagatgtttactttctatttttaaaatgtatatacttgacccagtgcagtggctcatgcccgtaattctagcactttgggagactgaggatggtggatcacgaggtcaggagtttgagaccagcctagccaacatggtgaaaccccgtctctactaaaaatacaaaaattagcctggcgtggtggcacatgcttgtaaccccagctacttgggaggctgaggcaggagactcacttgaactgggaggtggaggttgcagtgagtggagatcaagccactgcactccagcctggacaacaaagcaagactttgtcttgggggaaaaaaaaattatatgcttgttttttttgtaatgtgtgcatgttatatttgcaaacaggaaaataaagacagaacgcttaagcgatcacctagttttgctactcaagtagggctcagtggtgcagtatccatcatttttctcgttatctcttttttcacctcatcctctatgcttctctccttctgtttttgctttctctccacgttccatgtctctgtctctgtctgtctcaggaccctgccccttgaattttgcctcaaccagcaccattccttttcatatcggagagtatattaatggtgccagaaagggtggtggttatttaacctctctccagctaaatgtttcattataactcctgaaaacctaattacagtaactttacatgctacagtaccctttatgggctgcctctttattaaacttactcttttagagacaataaacctgatgcttcaaagtgcatggccagaaccagtgaaatgtaatgaaatctggagttctctagtgcacacctgatctccctcactgagcaccacagccccattcctggggtgtttctgcctctatccttcccctagcttttgatcaaatttcagacactgcttgtatgatagtctgaatattttagggattaatgggctgtgtatcaatgttttcatccgctcctctgaatacccatgagtttatttactggggaggtcaattttctcggtagaacaacagtcgacacctggtttccctgataaccagagttgcttttttgcacacagcgctacgttgagaccatttaagacttttgctgtatttcaaaaacgtttgctgccgcagacttcgtgagcaaagaacaacatgtcagtctgctctgttagtcattagttgtcctggttagctgagtggtacactgtgatgagattgtgggatacggggtgagagagagagaggaagagagaaacaggaaaaaaggcattgacctttggagttgaggcagcacaattatttgtatagtacatttcttttcacagccctgctaggattttcccctgggaataaagccaaaacaacagaaaataaggggatccccctggttgcaagctgcaaaatggtacttagtgttaaggaattttatgtatttgtttgtttgtttctttggtgggatttaaggttaatgactaagtttacttgtgattgactcagagaaaagggaaaaacaagaaaaagaaaagaaatcttttgttggagcctcaggtagcttagccagcctccgcttctcaaagctaccactctagattagtcaagctccttctgtatcataagaataaaataaaaattcacagccttttgaattggtgggggctcttgttgcatggatgttatgaatgaggtttttttgtttgttaggtttctttttaaaatctttcatggttgtttaatcagagacaatgcatgcccttaattttctaagccaatttgaagcagaagcctggttaaccaagattctgcctgaaatccatgtctttgctgtcacgtaaaggatacaggagaatggctgttcagcttttaggtatgcttctcagtttttattaaatggttttgttttcacatgaggaaaagtgatgacatttaccaaaaaggttgatagtttagggtgaagtgatgatccctgtattcttaagaagtcacaggaatgcaggacacagagctgagaacgcagaacctttgccttactattccatcccaagcccctaacctgtgcctgacagaatgctgggtgctgtgaccaaagctcccatcccccgcatgacatgactgggaagggaaagaagtgtgtgagctcctcttttattttttgtaagacatcaaggactggttttctccatctcttggagtgttagcaaactccaaggatggcactttgggggcccctcatttgcctttcctttcggaggcacaagtggccaattctgagagcaattgagttgtgcttgaaaaacgtcaagtgcatttggaaactacacatttttgctgatgcctggagtcccgagctgagctacttccatgaccgaccgctgggaagaagttcagttggggcatcacaaatgattcatctgaacacactgagcaggcctctgaaggggagaagctgtcttaacagccggttcagggaaaaatcaggagaagtcccctaagccctcttggtcctccctgtgaccatctggccaaaccattaccttgtgggtcttgcttcattttatttgattttccagcagcatgtgactgaaatccttgggtgaatcaaagcttgaggttttttcaactttttgttatgaaaaatttcaaacatacaaaaaacttggaagaatagtaccatgtaagaataaccacctggtttcaacgattgctatcattttgccacatttgccttatctgtttttatagagcttgagagatgagatctttttgctgaatcttttgaaatgaagttgcagacttcatgaaacttcacctaaagacgcccacatccaaagcttacattaaaaaatatatatctactaacaatctggtatgtcctcttcaagtaagatgcatttggaagggcataaaagtgattcaggtagaatttcttaaatgttaatgtacactagaatcagctagggagcttcttcgcttcctttttttttttttagttggagtttccttcttgttgcccaggctggagcgcaatggcacggtctcagctcactgcaacctctgcctcctgggttcaagtgattctcctgcctctgcctcccaagtaggtgggattacaggtgcccaccaccacacctggctactttttttgtatttttaatagagatggggtttggccaggctggtctcgaacccctgacctcaaatgattcgcctgcctcggcctcccaaagtcctgggattacaggcatgagccaccatgcccagccactagggagcttcttaatcgatatactcccagactccaccccatacctggatagggcccaggattttgtactgtttttaacactgagtgccgcgttaaaaacagtacaaattcctgggaccaggcgatcacttgagtgctgtgttaaaaacagtacaaattccaggtattcatgggacacagtctgaagatcacttctatcgaatctttctctttttgtttgctgaatttaatcttctaaagattagtgacaccagggtgtaactgtatcatgggagaaataggattctacttatcgttggttttttgtttaatcattttaaaccccagagactagaaggaagggaggtgataactaaatgggtttctttcagctgcaatcatcacagacaccacagtgccaatgagcggcctgagagctacatcctgcgagggtttatgcagtgctgaaaagcatgcaggttgttttttctgtggagggatctggccttgcatgtgtaaatatagactcttgcctgcatgtacatatgcaaacttgtaaatctgtttggcaaacaggcatcaacacggcaggaggagcctattttaaaattaaaaatgttcacagcactattcttttagcattcattattttggtcttggaaaaggttgtaagttatttatttaacaacgatttgttgagttcccccactgtaagccaggctctattttaggtgacaggatgcggcgtgaacaaaataattattttaaactttattgaaattcagttctaacgatggggacagacaataagtaatatgcaaatatacatatgcatttaatgaagaaaaataggcagttatgacagggcagagagtaacagaaattgaaggggcccaggaagatctctctgaaaaagtgctatgagagcagagattgaaggaacaagttgtgcagatatttccaggcagaaggaacagtaagtgcaaaggcccggaggcaagaagatgtgatatgatgggcaatagcaaaaggataatatgatggatggagtgagggaggacaacagaggtggaagcttcagtgggagaggtagccagagggcagatcatgcagagagttgaaggccatgagaaagacacctgattttattctcaatattattagaagcctttgtcagggagaaagggcgctttgtttgatgacatgtgacctaagctgactttatttttagaagaaagtgtagaaaatggactaaattgtcaagggaacatttttaggatttcacgaagcagtgccatatgcaagatataatcatatccatttttcgtataaatgagtgtattaaaaataacattaaagccaatttaaacttcttatctttaccgtgttgctctcatgttgctaaaacatttctattttcaagttatttattctgtccacaaatatgactgatgtccaggcactaatgtttcgactctggagataacaggagtaaggaatatctaccagttcaagtgtccaggagttcacattctggttggggatagacacatttaaaataattatatatagaaagagattaataacaccaggatataactgtatcatgggagaaataagattctatttataaatagaatgtagatagatagatagaagatagagaaagagagagagagagagagagagagagagagagatagatagatttgtgagtgcacaaaatgaagggggctgtgttagaatagattccccaggtaggtggttggaaggtggataggagttagctaggatgggttaggtgggacagagaagaaaaagccatttgattcaattgaacgggcttgttaagacaaagtgtgtctttttgtgtggctgaagcgtgagtgcataggagctgggagcactgattagaaacaagggtcaaaaaatgggtagagagccatggttccatgttgtagagagcttggttccatgttgaaacttaggtctcatctttcaggcatggaaggataaccacggatttgcaagccagagcacactggcactgtggcttgggaaggaaaaggcaggaaggctaaaggacggggttggtgggtaaggttttcagaaatgaaattgttgggattcattaagctattggatggggaaaggcaagggaaaaggaggaagttccttgggtaactgggagtaaaggaagtccaggaggggtggagttgggcatgtaaaggaatatagtctgagtttggttgtgacttgttccagacagctgtgaaatgtagaagacaagctgcccaatgcacaacgggatgtgggtcaggagctaaggagtcatgagctagatagaaatggagctttggagactccagacccatcagtggtggctgaagacctagaaattggcaagatcactgaggatgcgagaactggagttcaaatgttttcactcattagtgactccttacaatgcctttacgttcctttgttttcatttgatttcctattttcactactcactctgggagaatcatttaagaaataaattcggaggactcctaaatcaaattccgaggtttctctgtcaccctggctttctgctgtggatatgttctagcgttgttataaggcagcagactattatttagtgacttagagaactcttcaggtgtttgttcaacatttgtcaagctttaaattaaaatctgcatttcaggctccttatgtagctctgaagaattaataataaaagctactcacatgggctgacacttactatgggacacaccttggttaagttcttttgctacgtaatcctgcatgatattgtaggattagtgatgcttttcctacacagtgttgcaatcctcacagcaagcagttatgaggtacctgtacttttattacctctgttttacaaatgaagagatggaggttctcaaaagcagtgtcaggtacttgtcagaaatggcacgaccaggactaccaaggtctgtcttgtgctacaatgctgtcatgaacaccatgcctagcttcctcttccaaaacaccattttaaaatggagcattaaaaaagagccattggacaaggagtccaaagccttatttatggaatcaaacttctaggctttattttaacattagctgtgttaaataattcactaatcagatactcattttctgacatgattgtcagtcatattgggtttgtttgatctctgtgaaggattaaaatactttcaaggttttatctgcaaacagccaagatacaaatatttgtaatgatagcaatcctgccttagaagcccactgggaaagcctgctagcccccagaggcaaggcagtgtggtgtagtaggtctgattagagcttccaaagggtctaactggatgtaaataaaaaaattttttaagtcaggcagactggagcttgagccctaatgacccgcttgccaactcccagcgtcagttttctcatctgtaaaactgaggtaataatagtacccacctggtgggattaatgtgaggtttagttgcaagtaaaacattcagcattgtaactgacacattgtgagtggtcaataaactaagtagcacctactgaagacatcaagagaaaggaaataactgtagtaacattttgaaaccttagaattgcagctgagtaaaattgcaagacaatgagaggacttcattcattcactcattcattcactaaaatccccctctgcatgttgggcttgatgtgggtactgggaacataggacgaacaaggtacaaaataagacatagtccatggcctccagctgctcagattctagcatttacttaactcctgccttaaatcccactacacatttcctggaagacaagtcatcgttttaaacaaggtctagcaagtcacatttgaagtcttgtaagtggcatgtataagaaagaatcatcagagaattaatggtccttccttaaagtgcccttggagcgacagactcccgaccctgaggaggagctatatcctcttctacactgcctgttctactgtatggttctgctgtgtggttgtcacaccacagctctggctaacacggacaccttattcaattgataggcaaagatgattccaaagaaataatcatgatcacatgaccttggagaaggcatctcagaacaggaatcaggatttcacgggaggtgaaaacggaacaagggtcagagacagtgtagggtaaaatgtcagtacacaggttttatcgaaagacagagctctgggtttcagtcctcagacagttgcttggcttctcaaaggctaatatctccaatctaaaatggagagattctgccataaaaatggaatgaaataatggcttttgcagcaacttggatggagctggaggccattgttctaagtgaagtaactcaggaacggaaaaccaaacatcatatgttctcacttataagtgggagctaagctatgaggatgcaaaggcataagaataatataataaactttggggacttggaaggaacggtggagggggcgaggaataaaagactacatattaggtatagtggacactgctctgatgacaggtggaccaaaatctcagaaatcaccactaaagaacttgttcatgtaatcagaaaacacctgtacccccaaaactattgaaattaaaaaaaagaatatatctggattacagaaagaaaaaattaaaaattttaaaaaataatgaaatgaaatcgagatattaaaatatttagtttgtaaatagttgtgacaatacatttcaagtacctttcaatagtaggtatctagctctatccatgttcctgcaaaggacaccatctcattattttcatggttgcataatattccacggtgtatgtatagcacattatctttacctgggtgacaaaataatctgtacatcaaatgccagtgacacgagtatacctatataacaaactgcacatgtaccatgaacccaaaataaaagtttttttaaaaaatagtaggtatctaatatgtgataacacttagcatcctcaacctcatcatctctgaggaggtgacagtcattcagtttccatatttgctttgaatgctttgcaggttgttgtggaagataacaactagatgcatatgtgaaaggagcaaattatgcacatttatggaattaatttatgtcatcatcgaatgtaatgttcgccccttcttccactccagggtaagcttagttaactaggattatgctaggactagatagagcagagtggaagaaaaatagctaaatgttgctccttggctacccatgaccactctgactctttcccttttcctggcaggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcataggtaagtcagggcagccttattcagcaacgctggggatgacaacatgaggggagaggccatggacttgtgaatctagaggccctctgatgtctgtacagtttgcttctttgctcctgaaagatgtgataatgagtgatggatggaggtgattttttccctcctgaaatccacttaaatctgatgagtttctccttcatgtttctaaatgacatccatcagaagggaaattaagcatccttactatatcctttcttggagatgagctgagacttttcattcccgcaaacctatccctcactctcagagtggccttctagttttctccatccttggattttaacccaggtctgtgctttgaaatgtatgcaacattggttaacttcagccaaaaactgaattgaagaatagtggttggcatgtctgagaacatcttgattcgagagaaagccaaagtagctagcttattttcagagctgtggaacagaaacaggactgacaggctggagcatccatccaggtctttatacagaatcgaattagccagacacacttggccttgcccatatcccttccacagcctctgtcttctcatcctcaactctctcctcaccatggacagctgaatctgaatcagggtcacctctcctggcaactgggcttctggtgactcagtgtatgacataggtgaagttgctggagtatctttctctgcatgccaaaggtgttggtttacagccatagggtgtagccgtgtcaccacagaaagtggcagatgctgagcgcccaggggcagggtgccacgtgcataagagcttctcaggctgcacacaaagcctgctcacagctcctggccccaacaaagagccccaaggctgctgctctgtcagttaagcctgccaaaggcagatctcctggcttaggaagaggccatggtgatgtttgttaaagtttatttgaaacacttgatgcttgtggcttggtttcagggcagctatgagagacctgcccagtttggctgtgccatgttgcaaagcaaacccataaagcaccagctcaatgaagctgactccaaaacagttcccaacacgtatgctgaaactcctcccatttaagagaaaagaaaaggcaaccctgactgtgttggccttgccccttccctcaacataaaccctcccttctcgctcagcactgggggctcccacacttccttcatccccaggcagcaagcatggtatctgccaaagaaggaactggcccagcgcttcccagaccattctcctaagcttgcctgatggcaaaggggcatgactgtgcacccccacagatctggggccctgcctaaggcagaccaatatgagccaacaattgacataaatttttcagcttcttccacactatagctgttcttgtcttaatatggaaaaataagcatttatattccttaccagttgcatttctcaggaatgccctcccaaagtgagaaaactgactctccagggaaaggtgccgtgttcatctggggctttgcagaagtgtagcttgcactctaaaccacagctgtacacgggaactgaggcctgagacccaagcacccctaatttcgagtcatgtctgcttctcacttacctcttgatgaaggatgaagtaatggattgacctcagaaaggcggaaggatatctgttgcccctctgaatctcttgagtacatcttagtgtgttgctaaagtagctttgtgtgcttctgcaggtggctgttcagggggctccgtggaagcaaattgaatgtgccttcggggtcttttcatgatttggttttgtgtcagaaacttcagaaggggttcctgtgctcacttctcaggcttaatgttctgcggggccagtgagcaccacggggccagtgagcaccacggggagcccagatacagaaattgaggtactgcctgcctctgccaataccgtcccagtgcgccttctactctacttccaggagagagacagatggctcctgcctgatttatggggcttgatagttaaagtagaatagcttcctgtaagggcagtcatatacatgggaaaccgtatagtgagagtttaatgttttaatcaggtatgtaacttgtaaatgatagattaggaaatatatttattttcaatctgcaggctgctagaagctggacctgagcatcttagcatcgtttattagttcataatccatcatttcctattatgtattctttaggtaagattatgctttgaccctagagtatcaaaaaatagtttatgacacaaaatgagtgatataatgggccaatttaccctgcagtgatggcagtgagcatgcagctatagggctactctcagccactctcccgaggtgaccgcaggtctgcaagcgtggtaaggggtcaggatctgaagtgctgatcttggccccagttattcctttctccttagccttgacaaacttgtttgccttctgggtcttggtttcctaagtacaacatgggggcaggatggttatttacgtgcagaaactcagaagtatggtgaggattaattaatgtgtataaatcactttgaagatgaaaagcagtatattattacttacagagctgcaggggcataaacagtgcattgcaaacacagagaaaagtgccttttggagaaccaatgattgtgcccacctgggaaacaagccatcagggaagggcagaaagacaacatgaaaaccgaggccctcctgttaaggagaccggcgcttttaagggctgagtccattctggttcacacatgactctgcattccactagaacatgacaggtcctgaaattgatgcatcagccccaggacctttatgggcaggcagtgggttcaggcctgccaggcaccgtgacaaataagtcaaattatcatccttgcgtgttcaaacccgaagaaagaagactttccagaaatgagcagtttggacattgctcggccccctgacaagttcttccatagatccaggcccgtgggcgggtgtaaaagcagaatgccagccctgtgcaaactagatgacccaggtctttacgagctcagcagagatgcccagttcctacccacacagctggggtcagagaacttttatgatctgctcctccatcagaccctctctgtgccaaattctctcagcgtacaaacatcctggaataaattactctggaaagctgaataaaccaccaggggaccactttgtgcatcactcaggccctggcacaaacaattcctagggaatactggtttaggagaatttttctgtgaaatgcaagagactttcctctcaggaaggtgtctttcttcttcaggcagctcaggtactttcattacctgcaccaccagaagtccctaagtttctgaatcatgtaaccaaagtattttattaccaacctcacctattttagacaagatgtattgtgttatcttgatagtatgcataacaatcactagttagaaccttctacctgtttagaactagaagcatttccatttgaatcactttttgtttgtttgtttgtttgtttgtttttgagacagagcctcactccattgtccaggtgcccaggctggagtgcagtagcatgatctcggctcactgcaacctctgcctcccgggttcaagtgattctcgtgcctcagcctcccaagtagctgagattacagacctgcaccaccacacccggctaatttttgtgtttttagtagagacagggttttgccatgttggccaggctgctctcaaactcctggcctcaagtcatctacccacctcagcctcccaaagtgctagaattacagccatgagccaccacacccagcccatttgaagcacttttatacaactattcaatttgaatcatatccccagtcgtcaaccaacactctagcagaaaataaaatctgcatattacaatcatttgacaagcactgacaccgaggcccagagagtctaaagtctcctggcctaggtagatagttgcagggcgagcactaggcccttggtctcttgatgtctccttgaaggtctttctcttcacttctttctcctcaagattgcagttaaccagtttctcacatactgtatgaaactgaaataaatgatcccgttgatagcattaactcaccttatctagctctatcctctttagcaaggtagagtagttggttcctgcttcctgaatcatcttctaacgcagtggatagaaactatagcccctccgcagtattataatcagtcctcatatttctgctttccagttgtcttgtgttatagaggtcagcaaacattttctgcaaaaagttggagactaaatatttttggttcatgtgctacttagtgacagctggttaactctgctgttgtaagttaaaaacagccatagacggtgtgtaaatgaacaggtatggctgtgcacccataaaattttaattatgccccctggttttttagtttaatgtaatttttatgtgttatgaaatattattttctttttaaaaaatttcagccattagaatgtaaacccattgtttagattatgtgccatgcaaaaacaggtggcagcctggatttggtccgcaggccatagtttgtcaacccttgtttgattacattacagcttatttcctaagaatacctttcaggttgtccacatctctattacaaaaaattgcttcccaactggctaagagtccaaccatatgtccactgtcaatgaagcaggtgactgacattttctgatactgcaactccatttcacaatgagtaattgcatctgactttctggcccaaaccaaaaagtagaaaaagcaagtcacttttctctttaaatactttctataggataaatttttccaaggaaaattttaggaattttaggacacttcatcatgaaagcatagcttttaactagactgcttgaaacagtgctccaatccatggatagagtggaattgcctggccattttgcctagtactcatttgtcctcaatctttgattatcccaggttcctctggaaaattatcacctgtttttagaagttactcagtttctgatgccttcgttgttgaggttttccaacagattgtaatgatgctgtgtcatggaatgacatcattgctttcttgtcctaggttaacattggaatagatctagtttccttaaaaggcatcgaagttcttgcagggctaccccacatcaaggaagaaagatgcttctcatgtgtgactctgttgtttaactccagataatcttagaaattctaaggcgagagtcaacacaagagttcggcatgacatgggactcagactgtcacccctgagctaaaacaatacgcaacatacactgagcttctgccaaagacacttcacggggttggtaagggaaggcaggagagagaaagataagagcatttatgtcatcctaaattagttcttagctcttcagatctctgccaaactaaaatacatatatatatattagaaagtcaccttgtcttttttcactacagtaattcctgccaaatgtgaaatactatgtttgaagttagctgctcaacactctgtcttctgccactctgactttgatctggaaagaacgcgggccatcaacatgtcaggatgttaaaagtgtggtaatttggggtgctttcagtttcttttgaaaacaatgagagattattttctatggaaactaaaagcctaccatgtgtttaaagttgctacacttgaaaattgatatgttgagactcacgctgatgaatcttgcgttctctgctgctattttgtgtattctcatctcactgaacagagcaggtttggagaaaacataaagaaaatgacagaaaatgatgagaatggtacacttgcctggcatcttttgtgggggcgcagactaggaaaaatgtcagccctctcattccaactcactgctctttgactatctggagagatgggaaacctcatcctcctgtatgaattccaagttgtgtacttacctcccacatctaaagggcaaaatgctaatgattaaatctgaacagtcaagcaaataacatttccacccaactccctgggcccagatggtcaaactgagaaaaagagagctgcccacaagtaagtcaggggacccagtcatattatctatgccagtgttagtagcagacttcttatctaatagatatgctaatgtgctcttaacctgataataaagtcctgtcagtgcttacacactggtgagtctttggcagggggactgccatttcgtaactgaacatctgatttcagagggcctgtcaatttatgggaagacaattacatcattcattagctaggtctccatcacctagcggccatgtggcaatatttgtacctcgtgtttgacattcagaaaaaatgaatccctctgcttcggaggaggacgtggcctctttaaaaacatatttgtgcaatctgggggacttgaagtgcttcaggagggtcagcagctctcgggagatgcctttgctttcctctccgagattcccatcagaagtcaggatagtcggcccatgcagggctttctcacccttgtgggcagacgctggtgatgagagccaggaaacaggttctggtcctgactttgtagaacatcgtaatacagagccagagaggagtgataggtgccacaaccctgtgcacctcaagaatgccaaggaaacaacaatggtatcgtctgccagcccaggacttcgtgcctccacagagtatacattgagtaaatgaatatggagagttctccacctactatccctgaatcaccattcaagccttgccctagactttctctctataacgatgatctctctagcagtcatccatccagaagcagtaatagaatgctagaacatcagtgttgacttcttcacacaccctacttatttgactggattcctttgggtggtggccaagccaacaggcccttcagcttccacagtgtgcttttaaattctccatttctgacatctttcgttggttcattgatttgtgcttggggtttcctgattgaggattctgacacaacttctaatggactgtaaattagtgttatttcattctatgttttatctggaacacaatttcaagttcttgctttgccttggtagttagacaagaagcagcttgatgtcgtagaaagcacatacatggactttggtgtcagagagggctgtgtttgaagtctggcctgtatacataaagtccatgtgatgatgggcttgctatttaaaatctctgcaccttagtttcctcatcagaaaaatgaggagaattcctactttgtaaacatgcctcaagcattcattgaaatggtagatgcatgcaactcttcttcaaatccaatgtcatcaattatgagaaatgccatcattgtgcatccctaagagggaaagaggttgtcaattaaactatgccatgatttcttagcatttgtaatttttattttatatatttggaaagagataggcacaggcacgatagattgatgtaacaaccatgtgaataggtaggtccgtggtcacaaaggccctgtaatacaacaccaattataaggtgcattctgattccagacttgtggaaatatttaaaaaattctgaatcttatagtcagtggaacatggtggtacctggcacacaatagaagctcaactaaatggagctatggtgatcattgtactagccactgcacaccaggtccaatgagacctgcattggactgcatgccaggtccaatgagaagagtatgcccaaaatagtgacctgcactgcccagcgctttgtaggcaatcagtacatatttgttgaactcatgaatgctgattagggttacatctgagttgtaccagttgtggaaggtgttttccaaatacccagaatccttgatccctagcttcactgttcccctatgtaaggggaggtttttggtttcttgatgtggtaattgcctccgttcccaaattgcacttctgagttagaaagcacttaggcaaaggaatggttagggggccatgtaagcaccacatttaagccctctagcaggaatctgtgattccctgaaatcgagagaactgactgagagaaactgggaagtgtttgtatctggcataaggccatcatttggcactgatattacaaaagtgtagcagaatttacttggagttcaaggtgaagaagcaaataatggcataaatctaaaagtctgttggctatttctctgtaaatgaggatgtactaagaaaagaaagcaatcgctacaaggcaccgagtagagaaaagaactattatatggtaaattaggtctctgtacacaacccacacagaatcttttgtgctctgaaatgccttgcttagctacatggcctcatacaacagaaacctaacccaaagcaaacttctaaaacatacatgtttcttttaaggtcacctaaaaccagacttttttgtgtcccacattgaaaattcttttatagaaaattcatgttttgattgttaagaatagacacccagaatttttgcctgagcccttctcttatcaaacaagtcatttattaaattgatgcctcataataagattctctgcattcagagagcaaatagtccatcaactgtattaacacatttatcattaccataaaaaagaagataatgcattgcatgttctgctaatttcactttttatatcatcagccttctggcattaataagtaaatatcacactgtatcagaaaatataacagcactaagctacatgttggtaagaaaagagttttactaaagaaaatattatcctcccttctgggaaagagaaaaaaattataagatatgtaatatgtgtcatctttcaaaggctttttttgtttgtttgtttctaaaaaccaaagccatggatgagaagagaggagaagctttgcctccaacctttacatttctttcatcatgactttctttgcagttgttagggaaggcccttcccttgggatgggttttcatttgagttaggtcatttgtggggagattcgtgcaaacatgttcggcactcccctagggactctgtctttataaaagaagggcatattaccttgcttttgcctttgcagtcatgatgcaattctctcagtttgcttacttatattacaccatgagcattttaaagtcacgttaatgaagtttatattagacttgcttatattccacagggaagggtcagtggcagtgtgtcaaatgcattctgttcttcaggccgtgataaacaagatggcatctttcaaggaagttcagtgtgcctttgaattagatgcatctttgaaactggttttaaggctgccttatgcaccaaattttacaaacagacttctgggacattagctaaatttggagtagtgtgtttaaactttcttttagtaacaagatttgtagacttcctgaatctcgagagaattatgagttaagactctttttcccgtgaagaaaatatttgttactctgtacattaattttatgttaattaatttacagtttattaaatgtacttgaataggttcatgtatattcattcaatgcttttccactgggcaagaaatttcactttggcatatgattggctggtcgcactgtgtgctgaaatctgcaggccagccttaatatccaggatatttttacttgaaatttttttcctggatccagatcccaaaaagcaacaaatgaaatagtacagttaccaggaaagtttaaaaagcctggggtaagttgtgttttgcatgagcatctcctgtcctggtgttaatcaggcacacacagcagcaatagaaggcatctgagtttcattttcccaggaccatcaggggaacagaagcttttatactaaaaagctttttattacctgattggtataaatcaatgattagccatcctttttgtttcctggatatgtacaagggtctaaccaatgtacaataagaaattgaggacatttgtgtctatttttatccagtctgttttaatcaaatgatgacattatcttttcccgagtttaaaattacaaagtttttaagaaaaaacacacacacacacacacacacacacacacacacacacacccccaaagctggcataactgtgaagagtcaagagccaaggaaagaggaattaataccaaaaagggtgggatgaaattaagtcaagaagtaagaaaaaggcataagatgctgagaatagagtaattagaagcattaactagcaagagaaactaggaaatgccatacatcaattgggataaaatatggaacagttaaaggacacaaataggaggggaaaatggcacccagcataccaaattacaaatatcttctgcacaatttcttgaacctataagtccaaccaaggtaatgagatgaaaagcaatcgttgtgaattgcttggaggtgctgtttcgccacctcatcttacatcattaaacttttggtcccctcatgaactacttagataaacaacagtgggcagctcaacatttatccaaataaaccagaaagctaccacgataaaggaaattgagtttatagacacagcggactcttgcctaatagacgagagtaatgtgtctaatgtcgaacatcaatctatatttcaagtatagtatgaaggagggcctcgagaaacaacttatgctacaaaatcactttgcactagaggtggtttatcttctgttgtgtctaattgatctccacgtaattcagctacaacccttgctactgaaaatgatgtaagagatggaaagactgaatgtggctgttggttctccagagaccatagcaagttgggggttccaaatcgcctttgtcttcaaatgtattgtcgttggaatgatccttgaagccagagagcaagtctatttattttttaatcaagtgagggcattcatgaacgtcttcttttcaatcctgatttgtaaaaaaatctacataagggagaattattttataccagacccttcccatgccttattttgcctaacttcatagtgtgaagaaagatccagtagtgatattttagattaccctgcaatgttagttcccaatcaaattctgtggatttatgaactgcctgcacttgggagagtctcttaatcccagtggaacagggtctggtctagaccaggacatagatatgctgaggccatggctagtggtagtggggacttgggagtggagcagtgaaagagaagggaagggaggtcagcccccatttgggatgcacgcatgcgcgcgcgcgcacacacacacacacacacacacacacacacacacacacaccactatccccgctgaccctgcttcaaaaatgccaatcagaaacctcttttaatatgtgcacatcttaataaagtatctggacggatggatttggtttgactttcaggaaaccaacttctagtcctgcttccaaagatttaatctttcacagtgtttgcatttgcacagatatggatgccaccgtttctttttcctcctctctcctaccctatacactgcacctttaaatcgccttgggggaaatccagatttatcctgctctgtcacggttaattttttttaagtcatatacataatacaaaacaataataaagttaatttcattttaggcttttaaaaaacttaccagtctgtggatctgtgatttttttctgactcttgtccccatcccctcatccccatctccaccctcgcttctttgggtggaaggttgttgggtaaaggtgctgcctaaggtctcatgaactctgccatgtctgggagaaagtgtctgtatttcttttctggggatgtgagtgctgattgcatggtgttgtattcttttcttcaaaactatcaggaattaagcctttcggaaaggtcagctgacccacagtgatatccatattgtagtgaaacaccgatggcttgttttatgccaaaggtaaataggagagtggatacaatgaaatgatctgtgactaaatgcatcttgaaggaagaaaaagagctgtctgtcgtgtttgtatgactaagggatttcttaaacaagctgtggaccccacccagggagaatgctgtcaaaacatgaaaaaaaatacagagatcacacgaaagccaagtctgaactctttaattgcatgtctgaataccttgctaattttgcccacgccctttgtaattctttattcataacacactaccactgtctcacccctccccaaaaactttatcgtacctgtgtctcccacaattccacaaagcaacaaaaccaaaaaaccagctgattgagaagatacccagattggactaaagtggctcttggcttgttatcatgcccttcaaaagtcacttaccagggcagttatacagtaggattttgttggaagagctggtctggaatctctctaggtagaaatgtatagagagacccccaacatgaaaagtaactaggtatgaattgcagaaacatagaaaaaattctttgtgttgtatagataatggtgtcgagtgctgcctaatttgtcattcatatgataggccaagtggggtgcagaccctaatgacagagagtattttttgtgcagaggggaaagtaagtaccataagaaaaagcaagcatgcacaagacagaaaagacaggagaagcattcctttgtgtcactgtagtatatatggtatatattcctgggaatataaaaagaggaggccaaatgcctagctagagagaattatagtttccatcggcttctacagaacaaggaagaaccacatgcccatcactggcttcgtgaaaaaacagaagttcaagcttcatgggcagttaggaaaatcctctgacttagattaagccagttcttatgtttccactggatgatgaggctacagttttagcccatctgttcacagccctgtccccagcatcctaagagactctatccatttatctttaaaagccaaagaaaagagcatgttgtgagagggaggaataaagctggtagcccagaaaagactaccctaaagctgaatgggaagacttaacatcgctaccctgaaccacatgactctggaagggtcctgaggttctagggcgcgagggttgtcatgcggtcttgactgaaggttttccacatgtgcatatagattctccatgtagaaaagaattttgatttggggctttaatgccttcgaatgcacattgagaataacactgccatgctttcaccatagccttggaatcctaaaataaataatagaaaaattgtgatttaaaatataattccaaatactaactggggcccgctgcctagatgagtaataagcttcaataaatgtgtgacaggcacaaggctcttcagtatgaagagtagtgaggcctcagaaatagaaatagctttttcattacatgagggattatgttcagcctgactgtggagcctgttcacggagccacagctgcatcttctgcctgcggtcgtattaaccagtaatagtaaaacagtgacgtgctgcctgaaacagcgatttattttagagaagagagaaaggtcgctttctcctgcttaagtcaggattaccattgtttactacacactttcccttaaacttctatctgtccgtgctaatgagctgcaatttcagctgggttccacctgggtgcctgccagggatgaagaaatcaggatggtttggggtcgtggttacggctgttttatttttactcacctctgctcatcaacaggcccaagcttatctctttttgaagattgtatgaagttttattttttaatttcaagctcactcagctatctgagtttttcccaactcaggaactcacaaatcagcacatgtactccaggccttcctttttctttcttttttttttttgagacgtagtctcactctgtcacccaggctggagtgcagcggcatgatctcggctcactgcaacacctctgcctcccggattcaagcaattctcccgcctcagcctccccagtagctgggattacaggcgcccgccatcacgcccacctaatttttgtatttttagtagagacgtggtttcaccatgttggccaggctcgtctcggactcctgacctcaggttatctgcccaccttggcctcctaaagtgctgggattccaggtgtgagccaccacacccagccaggctttccttcttcaaaggagtgagatgtgtattggagaggctgatgtgacctcggtgctacgccaccctgcaccttggcgaccaaggagactatggggtcttcaaagatgagtttcagtcatgatctgagaaaggttagggggctcagtatagaagggcactcaacatgagagctgattatcaatttgagatgggttctcttttctacaccttgacacagaattcctttcttgacacactgaaacgaacgactcactgaaaatatctacttcaaggatggttgtttacttggctcagaagacctgatttgtagtcttaacagttcctcatttgaagggctagctgggtattcaggtagttcagtgaggaaaccctgaatttagtttagaagttaggttcaactctcaacttcttctaattgagtgcttttgggaaagtcgattaaatttcctaagccttcattttttttcaactgtaagaaatggttgataaccgtaatagcgatgatacctttttcatagtcactctatgtaaagtttaaagtagggcttgatattttaatattattgttctttgttttaatattattattgttctttgtgtattcattcaagagaaactatgcagagatgctaagttacaattcagcaattgagctattggagttcagagaagggagaaactcccaagggctggaatagttgaggataactggatggagaaggttctaggccgacccagacctgggaagatggttagaaactgaactaggaatgggccaagaatcattccagatgggggaactagcaacaggaaaggtaaaaggagaagccagaattaatagggtgttatgaggagagggacgcctgctaagaacagtgaaaaacagtggagcaagaccagatgatagatggccttgaaatctggcaggaggtttaatttgattaatttggcaatagggaggtgcttcaagttcataagcgggagtataatatgataaaattatgacatgatatcatgtcagttacctagtagatgctccataaatatttatttgttgattgattgaggattcaggatagattgggagatgggacaggagacagggagactcctctgaaggccccgtcaataatcagtgggtgtgtgttggtgaggccctgatgaaaggggaagccatggaaatagagcttcagagttaactgcgagagatttctttcaaagaaaagacagatttgtgatacaatttgtcttgtgtcgactatcaagacaaagaagacagaagtacctaatatggccttaaggtttctctgttgtcataatgggagaactgaaaaattaaaaattaacctcatatctttaaatcaccactcacttctctaaaagcatggttggccaaaacattttttattggtatgtaattctaccaaggctggccagaagccattcttttttaatgcactcagtaaatctctgcacggtttctttattatgagagggcctttgatccaataaaacccatcaagaccccttctgaggcattcactttggattttgtatggaagtctatagagaaaaaggagagcagaattgggtaaaaactaaactctaaaaggctaacaaaattcctccataacgtagtgcttacatgtagtgcaaattctgcgaaccaagaagagtcattggaatatacattaagactcagcatacccatttataaacagaaaaccaccctccgggacttgaaggcacttgcctgtacaaatgtggcatgtggtcctgggagtctataccgttgccctttttgatttggggcagtgaagcttacaaatgaaaatcttgaaagaagaaacttgccttttgatcagttggttagaggcaggtttgaaattatgataaatctgctacatattcattctatgagcaggtttaaactctaatgcatctgcctgtatatctgcaaatgaggctgacttaccgtaccaggctgaagggtgagatggatgaagttagttatgggtttatggattgggcagagagggctagacatcagggaatgtgcctttgccctcctccccccgccctctctctccaccacactgaagtctcgatttattttctgtgtgttaacatttgactgaagtgcatgaaataccctctcagatgctaggagcccgaagtaaagcatcaaatagcatgctcacctggggaatttagaattagcctccaaactaaccaaagtaatctaggccccaaagccactttagttcttgctattgggattgcctgtgaggatgagcctaaatgtggtagataattatgtctctttgctttctttttatcttcatcctaactctcatctttcaagtctcctttctgctgcagagtggcaggagctaaggcttggccatgaagccagacatcccatttctgtggagtttttgaccctgtgccatgatactggtctttagggaattctacatcggtaaccatttctaagctcagttaggttaaggccatggtcagacccttgctgtcttcacttcagcccacaagagaggcaataccgtgatactgtgatgaatccacccctgaagcctgcagctccctcctgcttccctgccatgagagataagttactggagaggaatgtcacatcttacggaagaattaattttggagtgcattcccgacaagtctatagttcaacatacatatggggagttattttcaatggcatttaaatgtaattgacttatcagccaggttagaataatcataggatagctatagtgttattgtctaattgtggtcctatagctgacaacgctctgaaagcctctttaaaatataaaggaaacctgcccttgggaatacaaagattgtgtgagagttgtaagacatccaggagaagtttaaagtggagtttggaataaagtgaacaggctcttaaccatgggtaaaattgtaagagaacagcttacacggttcttgcaaaccaacttgtcatttctcaagtgtataatgaaataatgtgtatgaatattttcatgcagagcagcctctccctcaagttctgccctcttcagagcttcataataatatacaacagcatcttttagaacagtgttttacaatctccagactaagggctcccaaaaagatcctgagagaagtgtaaatgagtaacaactctaagactgcatttttgtaagtaaatgatgatgaaggataaggagagatgttcatggggaaaagccctgaaaattattggaagtcgtggagaatgagagtcaaatgcaaacactcctattctgcagctacgctgattagcagatcttttatagtttccgtgtgggagatgagcaggggcttggcaagcactgtccgtgtattaggaacgaatgcccctccgcatattcaatttgggggcgttattaaaaaatggaatgaggctccttctcaggctctgcttccttttcataactgctcttgcagtgatccttttggctgtaatagcactttgtgtgaaaaggatggatgggaacccgctaggtctttttacagaatatcaaacattttgcccattaagctgacttgatttgaagaggtccttggcacagattgatgaaatagtccaaatattatcactccttgttctgcagtccggatagagtaataaccagtcgcctcagcctttgctcattaatgaggtggtcagggtcctaagatgtgcaaagttatttctttttctctcttgctattttgcacgttatgcaggattacaatgctgtgggaatgatgtgcagatggtctccagtgagactcacccagcaagattctcttcttgcatcaggattctgcctttttctctaagtcagtgcgccctcacatcagccctgagaacatttatttggcagtgtctggagatgtttttgtttgtcacgactgggagatgctaccagtatgtagcaagcggagaccagatatgctgctaaacatttttcaatgcacaggacagcccctggttaaagaattatctgatccaaaatgataatagtgccaaggttgaaaattcctgctctaattgatttataattacatcttcagatatattttttcttttttaccacttgaacgaaaataagagcttatattgccctgtatagctcatctttggctctgtgtccctcgttcctcttggtgattctttttatgtccatggccctcagtccccttcacagaaacaagctgtggcattaagttccaaaaatttattgactgaactggtcagctctatgcagcgtaaacagggttcaactgaagaggtataatgaaaagtaccgctgaatgtaaatcttcctaaagcatgacttgctggtttttctctgctttaaaaggataataaagtcaaccatttatgaaaaacctactatgtgcagaaacttcacatttaatatctgacctaaatgtcgcagtgactcagttttcctaattataattagagaaagaggttcagagaggccaaataacttatgcataggcatgcatagtcagtggttaggatttggaattgaaaatataggtctgtttaactgcaaagctcacgttctcaccactatgtgtattgccatcaacttgtaaatatatgcttgagtgactttgactttatgtgttcacatcccccaagccccagtatcctcagaaccgcccctaataacaatgtttctaaaaaaagaaatgtacagtccctctgatcatccaaagactggtcagctccccatcagccttgtcctgagagctgaaagatgacacattccttagctagtactccattgtaaaacaatccatgtcagggcacgtgggaagatgggaaacaggttgaaggaattgggagataaaaagaaatacacttcaaaactgaaggtgaggccaggcacagaggctcacacttgtaatcgctgcgctttgggaggccaaggtgagaagcttgcttgagcccaggcatttgagaccagcctgggcaacataatgagacccctgtctctacaagaaatatttttcttaattagccaggtgtggtggtgcacagctgtaatcccagctacttcagaggctgaggtgggaggatagcttgagcccaggaggttgattctgccatgagccatgatcatgccactgcactccagcctgggtgacagaacaagactctgtctcaaaaaaaaaaaaacaaaaaaaaaaactgaaggtgagggggcaattccaaagtccttctcaggatgctcagccaaggcagtgtttcagttagggatacctttcagctgtaagttatcaagaacaactgaaaaaaaaaaaaaaaaaaaaaaaccctaacagtggtttatattgaggcttgatttcctgaccttactagctagatgtccaaggttggcaaccctggcatcgtttctgctgctcagtgatgccatccaggacactggctcttcccatctccactttgccattcccagcactttggttttatttccttaggtttcctgcctcattgtctaaggatgtctgatgcagctccacatatcacatccaccttcaaaggagggagatagaagtggagaaatattcaaattatttgcccctcttaccagaaaaagtctaaaccattcccagcccccaacacacacttacacacacatacacatcccagcaaaattttacttaaatcttattaatcagaactgtgttatatgtctatcccttgtttcaaaagagtctaggaaaggttttctagaccctttgaagatgataagggaaacgagggttggaattgtctgatgccgccaaaaatcaacagtgtctgattagagtacttgaatattcaaaagccaagtttcagctgggcacggtggctcacacctgtaatcctagcactttgggagactgaagcaggcggatcacctgaggtcaggagttcaagaccagcctggccaacatggtgaaaccccatctctactaaatatacaaaaattagccaggcctggtggcacatgcctgtaatcccagctacccaggaggctgaggcaggagaatcactggaacccagtaagcagagactgcagtgagccgagatcgtgccactgcactcctgcctgggtgacaaagcaagactctgtctcaacaaaacaaaacaaaacaaaacaaaacaaaaagccaagtttctgcttttctggaaatagatgcaacagctacttctgggaaatctctcttacatacttgtccagggtggcactctgaaggagagtgtattagtttgcaagggctgccatatcaagggaccacacactgaggggcttacaacacaagcttattgtctcctatggttctggaggctggaagtccagcatcgctgtgtcagctagtccacgctctccctgaaagcactaggaaagggtctgttctggacctctctcttggcttctaggagttctttggtttgtggcagcacaactccagttttacatgatattctgcctgcctttatatctgtccctgcgtccaagttttccctatttataaggacaccattcatattggattagagctcaccctattgagctcatcttaacttgattatctgcaaagacctgatttccaaataaggtcacattcacagctattggaggttagaacttcaacatttgtgaaggaggggggcaattcagcttattcgtaatacaagatttttctaaattcttctttatatcttaatagtaatggcgatagttaatatttttgagcatttactacatgctaagcagttcacatagatttttctcatttaattcttactaccactacatgggataggtgctattatcttttctatcttacagaataggaaatggaggcacaaaaatattaggtgaccttctccaaattatgtaattagtaagtaagagggccaggtctcagccccaagtgcgctggcctctgagtccttgcatttaattatcatctagactctcttaaccacagctatcttcatctctggtataataggtttcctgctcatcaatgccaaataagggtagacaagttgatttccttaaagcttaaaaaaaaatttttccacaaaggctttctttgctgccttagaaacgcaaataaaacacttcattctgcactaggcgtaatggtttcctcttattcaaatgcagggccatctgtgcaaagtattttatttcatcattcattgaagttcacttaaaagatgaaatcacccttaatggaacaatgaaatggaaggattcccaaactgaaggcaaatgacttgaaaatgagaggctgtggttcctgcccgcaacccctgcccagggtctcatgagtgacagtggttctgttctgacagccccagagatgaagaagggctcttggggagcataatggcgccatttccagccaagcagttcatgaggctgaagtgctgtttccatgctgtcctctggcctggatcagccgctgggagcctggcattgatctgtgtagactggtgaagcttcatctgctttgcaggcattgctttggctaaacaagcctgtaactgatccctcttgctataaaccagcctaagtagcctcttaccatcagccagtactctgctaccatcctccttctatagcaggaccacagatggaaaggaaagctgcttcctctcaagtaaaggaccgaagactgagggaaattttgctttttgtaggcaatagcacagtttccccctttcctcctgactggagacagacagtgcaggaaatgatgggaaaaagcaaatcatgctttatgtttgagaggcacctcatgactctgtggtggacagcaggcattattagctgcattttacaatggcagaaacaggcctgggcaggggaaagaacttgtccacgacacaaggctagcaaacagcaggtctaggcccagtacccgggtagccagactccaaacaatatgctctttccacagtgacattcggcactgcagcagagaacgagaataaagtgcttctgagttgaactgacagaagcttctagaatcggaaagagaaagaatgccgcaaagaagactaaggcacttattccatgtgctgcgcctcaaggagaagtctgtttagtttgggagaccagagtgcctcaaatggcgtctccccagtggctttcttgagtttgggatttgtccacttcatgattgcttcttttctgtggtgggtgtttcccattccttctctgagtcagcaaacagccatgagaaaagtttcctcccgtttttctcatcctcattcctgaggataaaaaaacctctccttcagatcagaagggaaggcagaatgatagtagctaacacatggtgagcattaatgatgcttcaagttgagggctttccttgaatccctcgtttaattctctccgtaagaagaattgtccccatttggcagatgggaaaaccaagtcttagaaagtttcagtaacttgcccaaggttgcaccgctggagagaagcggcacaaacttgaaatcaagaggcctatattcccctccttctgcactgttaacctgagctgcaaccagggacaagcatgcacctttccagagccttggttcctccatcataacatttatgcaacactcactctatgctggtcactaggctttccctgcatcaacacatttaaccctcacaacaaccctatgggattgtactctttttatctccatttcacagatgaggacactgaggcttacggatgttaagtagcttgtccaaggttgtacagataggaactgccctaatgaaacacccgtgcactgaaccataatgctccatcacctcccatggggagtccccaacgcccttcaactctgtcttactatcattccattattttatctgacaaacggtatatattttttcttcctgaaagcagcagcttcatagtgagttcctgcaacatttcaaggagcattcattatcttcattttattcccactttatagatgcagaaactgaagcataaatcaaataacttgctaagagtaaaacaattagtgaagagcaagagtggcttcaaagtcagacctgccgaattccaacacccatgttaacgtaggttctgtggagctggcactcagaaaccacgtctactgcctcttggccttgacctcgtatgagcagtgaaatcataatccccaagcaccttctcagtgggaggtgaaggaggtagcttgcttggtagctaacagcaaaacctctgaaatcggatagaatggcgctggaatccccactcttccacttactgactgcatgactctgagcaagttacttcacctctctgaaatagttttgtcatctataaaatggtaataataaatgcacccatctccaagagtcattgcaaagattatattagatgttgtatgcacagctttttgcaaagtgcatggtacaaagtgctcaatgattgttagaagagattagagttgacctcataggatcaccacactgagccacccaggatgggactcaaccttgcaatgggcttcatctcctagaaggcaccctgctctggtccttatgatctgcactgaccagttagcagcctctcttgcccctcaagatttcttcacttcctttgtactgagtcagctagagggaccactcatcatttcaccaaagtaaaaggaagtagagacaattgatgattgatgttagaagcaggggacaggggtagaaagcatgtgggcttcagatctgttcagacccaggtttgaatttggatatcacttaaacctccctaagtttcagattatcattttagagcagcagcatgaggataataatgttcacctttgcagagttattaagaataaacaagaggaaaattataaagtgttgtgacatgtaataagacaatggctattatttttagattggccaactcgtttgcatggagctcttcgtgacagaccattgagaagtgacctgagttccacaaatgtcctttgctcactttatttggcactgtttgtgtggtgaactttccccactctgggtgtggctggtcagtctcttacagtgtgtggctagcagatcacctttgaataacatctgtggctatttaatttgtactggggaaagaaagaagtattacaaggaaagcaggctgccccgttgggatgctcaaggcccattttcttgcacttagcctaggattggcatctcttggtcaatgtgggtcaccttcctgagaataaaggggcttcattggctcaataattatcccaactgttttttcagttgtggctatttgagaaagaggtttcatatgtcaggagtacaaaatagagactgacttcatcgatctttatgccatttttgcccttcatcgttgatgtcatttgactcttcaggccccccttctcccgtcactttcttcttgacataatagctttcttctgttccgtccccatcttcccatctgctctttctcatagctccctcttctacacctcgtactttccggcctctgcacttccactgttgggcaacagaagagctgtctttgtttaagcttaaactttatcttctggcaaaatggagaaattaactgcctaccagcatctcggagttggttgtggggttcataggttcatacgtgttaattgttttaaaaattctccttactatagcaatgcaagaatcactaatctttctctctttccctttctccctattcctcttctcctctccacattaagtctgatttttttctctctctgaatttatccagcttacataatttgccttttcattttgtgaatggagataatttgtgaatagaaattacttccaaatgtttcaaaaatattttctaagcatttgctttaacatggtgttgtgagctcttttttttttttcctctttctttttttttcataaggaaataagtatttccagggaaatgagctttagggggagaaaaggattgcatttcactctcttcttgggtctcttttgttgatgacaattttgagctggagtaactgcagatattgacttgtcgaccacctggggtggagggggacagttttattcagactcctgcccaggaagtcccaggaaggaataggataggagggaggagagaggagagggtaaatgaattcagaaaatagagctagcctggaaactgatgactttttaggtgagagattccctacatcaatattttaattttaagacacattcttatacttgggttgattctggggtgcctcctaaggacagactttgtcctttattcattaattcagcaagcattcactaaaaacttccttctctctaagaccttagtgatgcagaaatgggtgactgaggtccctgtccccgaggagatctccatcacacacagagaaaatagatgtgcacactatcacttataacacaagaccaaggagaccacgcctgtgctagcatggaagtgagcacggggagaagaaaaggagtcgtctgtctgttggtatcagagagtactttagaggggagatggcatttgatatgtagctagaagggtgcataggattttggcagaagggaaagaggggagaaatacctttcaggaataagaacaccaagtgcagtgattaaagcctgggaaatcatggtgagtagaatgccacgtatcattaacactggagcaaaaagtatacaaggatctagggtattgatggaaaaggtattggggagaaggacagcatgacaacaagcctttcatgccataagaatgtgtatttggatttgattcttaagtgactcaaaacccgccaacaattctgagtggaagagggcatggagccgtctggcagccccatgcagaatgaagtgatggggtgaaaactagatgagagccaaggaggccattccaaagcccagaaagaggagactgtgaataaaacaagaacaatggcagggcaggcagagaggagaggagacatgagggagacatcatagaggttgaatgtcctggtttgatcattgactgaatctggtgggaggggaaaggagacatcaggcataattcagtccattgatcagccttttgctcgatactggacagagtaacctggagccagcccctgggaaaaaggggtagagggtaaaagaaagtttcctgttcctataatgtacaatgaataatcagctgcaatttcagtggatgtcagctgggctagatgatgctggagtttctgggacaaaagatgcacttcctaagttattttcatgcatgtaatgaaaaaattagaagacagcagaattgggtttaataaactttcctatttttaattgccactgaatgatgttttaaggacaataagtccttagaggaaagaaaaggctttaaaagcacccacttcttctcttccattgaaatgacatgtttcacctatgtgatgacttaattgcctaagagcaaggaacagtggaactacagataaccttagttgggctttagagcagggaatggatttctacctatatggcaattatataccatgttctctgagggttaggatccacactgggcttcagaattgtgcttagaggggccagggtttagattgttaggatttacaatcagcatcaaattgggaagagaatgtcgaggatgtaggtcaatatcagtcaagttcatttagacctcccccgacccaaatatatacttgccactttgctacaaaagacaaggttaggggctacaaggtgacacccgagacttctttagtggatatttagagttcgcccattctccagagataagaaagaaggattctccaaaacccagacccttagacctcaagcgaaggtcttggaatagacagtacccacattcctgctgtcctttgcttcttgtggaagttaattttgtgcttgtttaacatttttaattggcccaacatgctcctgcaaggcatttttcagtcattctgtgtttgacttcacctggttatgattgtttcctgttttgggtttttgacgtcgtcattttatcttgttttcatgagagtatcattccctgctcactgagagccatttgatttttcagcagcttaggtggcagatcttgaagacggttgcgtcttcaccttggggagtgtctttcagtgattcgtggttgggtagggtggaacctccacccgccggcttcccaaactgatatgttggcttttctgaacctccaaagttgctaagatacagtgtgtctttggaccccttccaggctgtttccttccacactcacagctttgacggaatatttcctctgcctgatatcgttagaaaggtgacatgccaaaccaaagttagagccgttacaagacatttctttgagtgcagtttccttggttcacccgttcatctgctgtgctggaagaaaaaagtgaaatcaaaaaagctctattaaatagatgtgccaaggaacgaggaaaaaaaagaaaagtttcttcaacttttatatgctcagaattgtctcacaagcatatttttgttcctttcctctatttaaaaattgataacctagaaagtcaggagcaggctaggaatcgtttgtggcacaaaagtggcacctactggtaagccttggcttaaatttgaagtttagatttgtgcatgaccttgaccaaagttatatcctcctgagaatgcttcctaatgattttctatgtctggaagggcaaaccctctttagatgtataaatattaaaaagcacttcttaggcatgagggcactggtttcagggctacagaatgactttttcagcttgtaattaaaaacatgtactggataactaaccagcagcagtatttgcttaaaggagcaaatgatttaaaactgattgggttgcacaccaaagtggagtgacccatggtggctgttcttacctctggtttctcgaggcatccacccagctccccgaggttcctcaagtcactgggttcttgaaacccacagccttcctttccttgcgtgtttggagtttttgctttatcctggtatccacgttttgtttttcatatctttactctgtatctgaatatttattccacgttttggttttcatgtctttactctgtatctgaatctacagaactcacactcaagaaaaaccatggctccccctgttacagtgcacactcaagtttcataagagaccccaacactggctgcactcagcaggtcaaacaatcattttcaaaggaccataagattttttaagaaacagactgtcctacatatttgaaatcttttttttttttttttctattttaaaggcagattccactgaatgctgcaaaagtaacagaaatgattaggaacagagttgtgacctatccaatttcaaaaaagaaagggaaggggtgagatctaccccctcctaagtggtaacaggccctttctgttcatcttctcatctaattgtctaaacaatcctacatcacaagatactgtcatcaactgcattttgcagatgggaacactgagacctagagattgtctagtgtgatataacaattaagtgatcattttaggaatctttctcattttaaaatcaatattgtactcctggtggtataaataaagatgacctttgtttattcatttactcatccattcattccaaatattcattaagcaccatgcatgagcaggcaccgtgccgggggctggggatgcagcgcagagaagagcagccgggagctccgctcctctggagttttctctctggtatcactccgagagtctccacatcccaatttgctctctgctctgagggtctttttttaacccctaggggagaagttgacagattgtgaacatcaatagttattgaattggttttgtcccaaggcttcttaaaaacagttttcaacgagtgccaagccctaactgtctcccaaatcctactgaaagaaatcagagcaggttatgttttcattgtctagccacccttggccatgaggcgctgcatccggctttttctctggggcccatttttcgccacaactcttcagccttctaccactcgggttaagttttgctttgtgcatttacaataagtgcctgccaagcatgagtgttgcaggattagaataaaatagtgggggtgaaggaaagcagattttttggaaaccggtagaaacactccatgaaatggagcattgtaccaaactcagcttagttatacaaaagcatgtatagtgtttctttttatttcccatcttaacgggaggaggcagagaacagtggttacagaacaactttagaatcgttcctgattgtccaaatggtttttttacccctctgagattggggactcaggggcagccgtgtctctcacgcctgcccattctgccccgctcgaagccacactgcagtgttccatgtccatctcgcctgcgctatctaggcaagggtgcgtgtgccaggctattaaacaccccacaccccactcccctgtcgttctctaagcaatggaagaagtttgcttggccaccacagctcgggcaggagggacttggattagcccaacagcttttgctactgtcagcatgcagcctaatagagttggaagacagggttctttagaggcactggttctgacaaggaaagcttctgtaatcttgcctttgtttagaaatatgaacttcgaaaccctgctgcagagagtgtcggcagccacgctgatgcgaggccttgggcaaattcatttgaattgctttgaaattggatattcaaaattcaataaaaataagccagcctgatggtacagctgcagcattccccccatccagctgggtaagccgtgatgatttccaggccgcggactagcaaagcccgagtgtgatgggaagatgagcgcctgagctgccagagaactctctctctggcagcctggcccgccgacggctgcctgccagctgacttgcagagcagggctggctttggcactaagtggctcctctcactggcctgcccaggcggggatgcggggcctgcctcagtcatggccggggtccagggggaggggatgcctcaagggcaaatggatggggtgtcggaaaaacaataaaatcacaacactccagttgtttagagagcagctggacgtcccaaacactctgccacagatccagagccatcagacacgtaggtgggtttaattaaattgtatgcagatgcaagcaaacctcataatttgcccttgagcacacactactgcatttgcctggaaagggggacatgacatcccggagggtgctctcttgccacctgccctgggagctccctcttcatcattgtttatgtggaaaggcgattctgctagggattttaagagaagaccattctcactttcctctaagtctcaagcagtttgatctctctgctttgtgatggtgtgtcacaatcatgcataaaaactgtgacgtatatataagatgtatacatatatagagagagatatttatacacatatataaacatacatatgcatttatagatggatagagagatgaatagatagaccgacatatacagatagactccaaattcaagaagtatgtcttattacccctaagcaacctcaattttaataattgggctcatcataccccatgcatgagttcaggcacttttctttgttggaatttgtgcatatgtgaactgtcttgagtcagattccaggagaaatatatccattagccttccgattgtcgcacctatgccacctacagtaccatacctaaagaggggtaattggagctcctgcgtgcagggacattgtgagcagcccactccattggcctgtgttacgtatcgccagccactcaagggccagccatgaaatttaatttggagttttacagacacgttctgaatccgaaatctcaataataactttccctttgctcagccttttaactgtgaaattcagttggggagtttcgaagcagcaggtaatgtcacagcactccagagggattttgccagaattctactaaagtgcttgcaagtgtcatttccatatttaactaatttcagtttttaattagctccatgtgaaaaatgagagttcacgctgagctcctctgtcagcacagacgcttgtttcctttctaggatctcaggacaattaagaaaaaaatagttgatgctacagtaagtgtgatcatgcatagctctctcaagccataacattgttccctgacagtaagaaagggccactgccagggcccactcgccaggctgggaaagagcagtttggaagagggttttacgtgcggatttgtgagtccttggttctgaatgattccttagctgcaaaaagtatattcttgtccctaaattctccaagatgacctgagattaggttttgaaagaatgctatatgaaatgcaaagatgatgttactctaggaaaacaggcttcctccgtgttatctctgtgctaaactccagcatccaggtgcttatcaggtcatttgatttcagattcgtaaggcccttggcatacaaaagtaacttctctatgatttaagtttcaaaatgcagtacacacatggaaatttattaatcctacattcaaagtgtaaatttaccacttgggactcacatgcaaatggaaaactacatggtcttcaaaaaaaatgtattgggaggttctgttttgcataaactgaaaaatatttgatgtgatcaggtttctgaaacaattttgaggaagccaaacaaatacaggccctgcatttcatttgcatagcatccatgctaatggcatgatttgtttaaaagaaaagattcattaaaagttttgagaatggttaaagtggaaaagtgtttgacacttccctatagtagcaattcttggaaattggtttggaaagtagaatctttttttttcttcatatatgttagtgttgggtaattgttctctgttgacaatagacattaataaatgatgtgatagcaagaacacttggtatctccaacagagactgaaaattgaaatccaagtagcaagaagaagtttaagtattaggtttatgtggctacattgggaaatagggtaggatacaggtagggtttccttccatgttctcttgactaccatatgtgcttgggttccaaagagcaaacacaactgtgtggttcaggtatgagattagaggagcaggtgtcctgtggggttgccagaaatgccgccattgaagatgtgttggtataagtggaacatgaaaagatggaggcaaattcttgaacatgaagagaccacccacaagttgtttaaactaaaataacttccacctgagctgcaatggctagcaataaaggcttcattggccagtgcgtcctgaggttggaattaagtctctctgtgtgggagagggcctatttgagctccaaaggcggaactcctatctccctggctatgaagggggctcacttgcgatggggaactgggaaaaacacaacttctattaataataagttgtctgtacaactctctggggaagatcatagttgggagtgcttatatttctttgctcttctcaaggtatgatgtaatttctttgctcttctcaaggtatgatgtcaggtgggcctcttcttggcctcccaggaacagcagctccagccacaagaagcctgtccttccctgaggagatttgacccaccattcctctgagagttggggacccctctcacagtgcaaataacaggcagaagcagtgtccacctaaacatttattcactgacgtgaggattagcaattagccctctcatgatggggattagctcaatagaactgtgggaacagcacacactctggagggtgaagttaggatgagcagcagaagagatgccgacttatggaggcagagagaaatcctgaaagtgatagtatttttagggcttattatgtgaattttgagcctgatagctgagaatggaaaccatggatttgtcatcagaggcacttaaatcatatgtggtaaattatccacatagctattaatttatacaacaaatgtttcctggtacaaggaaagagaacaggctctagaatacaggctgctgggtttacatcccagcttttctacttaccagtgacaggagcacagctatgttacttaacctcactgcgactcagtttcctccctgtaaaatggatacaataatagcacttatctcataggggaggttataaagactaaacaagataattcttgaatagcccttagcacagtgcttggccaaaggtaagcactaaataaaatagatttttactgtgacaggttctgcttacaccacagtgaaccaaacaaacctaggttttccccttccagaatacataccagcatacacagataaaaccaaggaaaattaatcacttcacaaccattccagggtctatcagcctcccaatttctacatgaaataagaatatcaaattaggaggaatgggaccatgtcagcaagaataaactaattagctaaaactacttattaaaatgataatccctccacatggactaggcgcttgcatgtgcacctgtcaggaaataagctacagacacacacacacacgtgcatgtgaaatgacacagaagcacactccccacgctgtggagagccaaggtaccgtcacccactgagacttgactcccgaccgaggtactgatcatggggctgtggggcaaggactctgaaggtcaactctgagatcattggcacttcattaaggagtctgttctaagtgcacagggctttcccagaagaggaaatgcagcctcccccttacatccaaacatactgcccagaagcccctagaatggctttttgtttctctaacactgtcagataattcacacaggatttttcaggcatcatagcttctgctagcagactggagtacacaaagaaaaaagtgctcagctccaaatcttgcctggaactgacctcagccctggactgccttttgtgtatcccaaatttgagctccgtgtttttgcctctagctttctggtgccatgttctgggccatgtgagtgctcagggttcttttatggatgcttggtactgaaaacatcactcctcgtggccagaatgaaaggtgttgtctaaagaaaagtcaagttgaactgtctggttcctctactttcggaaatataatggaacctcagctttgcgtggccctatcttgtgttaaagattctaacagagaatacatctctatatatgttttgtttactgttttgcttttgtttctagctttattgttttcccctgtgtggaatgttccagtagcaactgtttgttcttcctgtctaagaagtgtagcacataggtactacggcagatttatgtggtagtaagaagacgtccacctattgctttgtgtaataaacttccttccagaaagaagagaaaaaaatggctgtgccctaactgcagagcaagtttagtgaggatttacgagaatcaacaccactggcacaaatggagcttgcagagatctttgggttccaagttttctgcccattctagagaggagcagaccttagaagggtggctatggtatgccttctatggagggcactagcactcagcctgagagacagggttggaccagccagtcagccttctgccgcctctctcaatatcacatgtctctaaggagctttggcaagagtagaatcacaatttgatcctagctgaagttcctgataaatcctcaggttccacccgggaatcactgtggttgataaaaagaggagtccatatgctttacacacgagacagccaggcagttttgacactttgtggaaagtgtagaggcttgatatggattctcttctaggcagagacccatcccagcgtgacacagagaaggtgctcaggggcgattctaggcatgggcagtgcttttctccccaaagaactctacttcttcaagctttaaacaaggtgtagtggacaccaaatgaagaggagtctgcctggctcacaccagttcccttggtgacaggttgccaagtgtaggatgcccagttaaatttgagtttcagaataataatgaaaatgcttttaatataatatatcccaaatattgtgtgggaaattcaaatgtaactggcttcctgagtttttatttgctaagtttggcaagtttacttggtggctgtgtctgtatccaacaccctttttgggtccctaaatcgagcagggttgatgttattatcttactttcctcaccatagcaactgtcaaaaaaaaaaaaaaaaaaatgggcttgtgacctcagctgagccaattagagtccttaactagggtccctaaaagtgaaactgggaaagtggagctctcttttctcctggtagcccaagggcatgggaatattactttctgtgcccatggtcctccccttagggataaaccctctcttaatttggccaggctgctataacaaaatgccagaggctgactagcttttaaagaacagaaacttatttcttgggtctggaggctgggaagtccaagatcaaggcacctgcagattcagtgagggctcgatttctggttcctagatggcaccttctagctatgtcctcacatggtggaagagactatctagctgttttatagggacaccaaccccactcataacctaatcacttcccaagggctttactgcctaataccatcaccttggttaggatctcaacatacgaattctggggagggatagacattcaagccatagcaaaaaccattggtcagctactctttcactttcacaacctgccttcatagccttcaaaacaaaattcctctctcctgcttaaggtagaacaagctgaaccctaaggatcctatgctagtatgtagctacccagcccaaactcccaagtttggcatgatggactaaagaaagaggaattcaccctaggaatgcttatagacagatgtttacaatcagatgctccagccacaatatatccttggtggatccgctggctttgggcagccctgtgcctgatagtggggaaggggtggcaattgctctgccaaactgtgcacctgcttcaggtcagtacctccacagtcagggctgaccagaacatagagaagggagccttcctgtcatgccactttgagccactgtctaaaatatcttctgtctgaaaatatctgtcatccttaactggcaccgtgcctaaaatttccacctttagagtttatatgtttggcttaaatcgttagtcttccctataattgcacatccattaatgatagaatgtgtgatgttgtggggaggatgtggatgaattaataattaatatcaagatccaacggattttttaaagttccattgatgtggctgatagtttggaaagcagagttctgacagagttggatgggagtcctggaaacctctgatgtgatgggaaagcattcatacaagaggcactgctgagtttggaggggggcactgagtctctctgatcatgggtcacctggagcaggcagaatggacacagggcaggtactggatggagaggaggcatgctgagaaagaatgtccctgttttaccatgttactttggcccaagtctggttctggctctttttttttttttttttttttttttttttcatctttccaccctggcttgaatatctcttttccatattgcgtcctcccagctgcttctgacacactacctgtatgggcagagacctagtgcctagacctggagggagatgtctgggctctctcacctcctccaccttcatagaaacagacaagaggagcttgttccttcccttcatgttctctttcattaattgctgtcagccaagccttgtgcaatacctgtggttctcaaacttgagcattcatccgaatcacctggaaggctcattaacacacagatacctggaccccacccctgagtttctgatttgcaggtctggagtatggcccagtaatttccatttctaataagttctcaggggatgctgattctgctggtctgggaactacagcccgaaaccatcggcccagacagtgagctttttgagggcaggagtggtctcttcagaatcattgtatccccagaacctagcacaacaccaggcacagggttgaaggttaggaaatgcttgttaatggagctctatgaagctacacaaggctttaccctgttgcagcatcaaggctaatcatgtaaataccctgaattttcagatatcggattaaaagaagaaaatactattgccatctaatgtgttttttacacagtggcatctccagaatacatacaggaggggattaaaggtgccagtctgggtggaaaatgggaggttgggggctcgtcttaaaactccacttgcataggaaagaccctgtttttactgagactctttttgtggtaacttcagagaaggttggtggaaatcatttagaattttcctactcaccttccttttccaccccaactgcaccccccgaccactgcttagtgtcaccactgatttcacatgtgcatgaggtatgtgtaccaggtcagctgatctgaggttcctctgtcaagcttcaccacaaaagtgcagcttcaagagtcagtgcagtgaggtggaagtgaatgggatcggggatctgtgcttttcaatagagatgaatgtcctctctgccaaggtattaatctttccaggtctccataacctcttttgtaaaatgagtctggagaaggtgaccactaagtattttcctatatttcataatttctattattttaattcaaaaggcaagccatctcaaatttaggaatgggctatttgcttgtaacctagctatttggaatttcagagatttttctccagacagaccatattccttctggacagttcacacaataattgctctttgtcgggttcttaactgtgtgtcaagcactgagataaatgttttgcatactttatttcattgaatgtggcaacccccctgggaggtaggaagttttatgattcccattttgcagatgaggaaaatgagggtctgggaggaaagaaagaaagacagagggatcgagtaagggagagagagagggaggaaaaactgaaggaaaagaaagagggaaagagggaggaagggagcaagggagggagggaggggagggaggaagggagcaagggaaggaaggagtgagggaggaagggaggaaaggaggaagggaaggagggagggaaggagggaaggaggaagggagggagagagggaggaagggaaggaggaagggaaagaaagaaaaaagctttcccaaagcctcacagctactaaaaaccaagactgggacctggacctgaagccaggtctgctgcttccaaagctactctaatcaccatagtctattattcctacaaaagcctagtttacccacaatgcacctgaaatgtagagtctggctttggagggaagtaggctttcttttttctgccactttcagtataagagacagaaagcattgtagtcaagtgttctgagccagagtccccaagttcaaagcccagctctgccactactggcagactaatcttggacaacatacttaatctctctctcccatagttcccatagttaagctaaaccatgtgaaactggtgatattctaccatatttaatctccaaaaaggggaatttcatgtctaaatatttaaagtgcttattataacagtgcatggcaaacagtaagcactatattcgtgttagctatgattcttactgaaaattgccttgagagtttgccatatctggagtatagtaggggctcaatagttgctggtgaatttattgaatgaagtagaaactgggatgcccaggaaacatctggggtagtctgggctatgaagaccctctagggctgggagaaaggcaagtagggcaggggaggaggttaggactcttagatttgaatagctttgagactctgttagtattgccctggaataaggcaggaaacctcaaagcgagaaggaccgatcccataggtccagccaccctgaagcagtttttgtcctctggcttctaaagaagcaaagaaaaaccctcaaggcagaggcagtggggagttaggtcttatggtttgcttgtgtcttgctttttttacagctagaaataatgagaaaaggcaggcaagggagagcctcccttccagcctttcctcagccgctggtgtttttccttcctagaccactgtgtgagaggaaggggaaaatgcagaaataatggtggatctttagaaacagaaagaccaatgttagaggttaggtgtaactgagcagagagtaatatttacccaggtatggtagtcatatcaccatatggctatgtgtagcatgtggacacacttctgtattacaatagttatgttcatttcaatgtgtcacaaaaatcttaacacattaagctttttatttcacagatattactttgggatgaggctaaattgattaaagtttttaaaaaatagattgctattttttctttcttttttcataatattccttcttgcatgtataacaactcatgggttgcaaaagaggatttattttttcgtgcctgtctactataagtctttgtccacaagtcaaacaaaagcaaacacaagtgctaaaaaggagactgattttaaaatgtagttaagaaataacagtctaagtggagcttagatttcatgaaaaccatgaacacagtaaatgatgactatggttaaggaagcactagaaatgcagttaggacacatctatgtattcctggctctggcttttagtagctaggtggcagtgggcaggttatttaatctctctaagtctcagttttcttatgtgtaaagtgaggatacttgctacctcaaaggtgatttttttttaatgatcaatgagaaatgtcttaaaagcaggtataagaattcagtagacactgtttatgactattatcattattattagcctggcacactcccagacctcagttaattgtagttttttagacagaagttttcaagccattctttcattcaaataaatagttcttaaacactactgtgttctaaagcttatgctagctgtggggacaaatttgaaagaggggaaggaagacctactctcacctctcaatgtgttcatgcctcaaaatttggagggggaggtcaggcatggtagctgtaatcacacctgtaatcccagcactttgggattctgaggtgggcagatcacttgaggtcaggagttcgagaccagcctgaccaacatggtgaaaccccgtctctactaaaaatacaaaaattagccaggtgtggttgtgggcacctatagtcccagctactctggaggctgaggcaggagaatggcgtgaacctgggaggcagagcttacagtgagccaagatcgccccactgcactccagcctgagcaacagagcgagactccgtctcaaatatatatatatatgtgtgtgtatatatatatatatgtgtatatatatgtatacatatatatgtgtatatatatatgtatacatatatatgtgtatatatatatatgtatacatatatatgtgtatatatatatgtatatatatacacacacacacacacaaaaattaatcaagagttgtggcacgtgcctgtaataccagctacttgggaggctgaggcaggagaatgaatcacttgaacctgggagggtgcagtgagccaagatggcgccactccactccagcctgggtgaaagagtgagactccgtctaaaaaaaaaaaaaaaaaattggagggggaacaggatggtcaataaataggtaattaccagtgtaaagccataaactctgtaagtggtgtggttataaaatatccagggaaggccaagcgtggtggctcatacttgtaatcccaggacttttgaaggctgtgatggaaggatcacttgagctcaggagttcaagaccagcctggcaacatagtgagaccccccaccccccgccatctctactaaaaaattaaaaataaaaataataaaaaataataactttaactgaccaggaatggtgacgcatacctgtagtcccagctacttgggaggctaaggtgggaggatcacttgagccaaggagacagacagctgcagtgagctatgactgcaccactaccctccaacctggatgacagagggagaccctatctcaaagaaaataaataaaaaataaataaatagtatgataaaatgtccagagagcatgcaggaggagatcagcttagaaaaatcctgtcagccacagtggtctaggacctcctctgtgaaatgtgttcagtataattgaagaactgaattaatttacatttaaaaactcaaatgatataaaatactttcattcagcacatttttattgtttttgcaagatgatgtttcactttaactgttgaaaatttagcatctgaattgagatgtgctgttaactataaaatacaaaccagattttgaagacttagtgcaaaaaaaatctttttactgtctcattaaagatttttatgttgattttatgttgataatattttggatatattgagtaaaaagcatagtattaaaatttttttacttatttcatgtggttactagaaaattttacatttcataagtgggccaggtgcagtggctcacgcctgtaatcccagtactgtgggagcagatgacctgaggtcaggagtttgagaccagcctggccaacatggcgaaaccctgtctctactacaaatacaaaaattggctagacatggtgatgcatgcctgtaatcccagctactcgggaggctgaggcatgagaatcccttgaacctgggaggcgcagtttgcagtgaactgagatagagctgctgcaatacagcctgggcgacagagggagaccctgtctcaaaaaaaaaaaaaaaaaaaagtcataagtggcttgtgttttatttctattggacagtgctgattacagcagaatgcaaatgacattcacagtagagaactccagaagatgtggacatttcagaagagacccaacttcggtcaccttggacaattctttctgacagatctagagcaaagcttaaaggatctgagggcaccgattcaaaggctgtttctggggctgcaggagaagagaagtgcctctgaggtttcgtcctaactacaggaccttgctagagttgccagatttagcaaacttataaattaaaacccggcaaccctagaccttgggtatgtcatagaactgcaacaagcctcggtctcttcatctttaaaattgggataaaaaagtaactgcctcgtgagtgtcctgtaaagcttaaatgaatcaaataagactagtaggagatgcattgagaaagtttggcctaaaagagctaagcaatgaaaacaaattggggaactttccaaacgtgcctatctttctttagctctgagcatgcaggtcagggagagctctcccaggccagtgttaagggagacaccagcccctacctgggagatgtattaggttaggcctggcttggggatttccatggagttaggatccggcatgggatcataagccataaggaggagggggacacataatgaccatgtcgaatgtcactctgctgtcattgcaatgccttgtataagccagaaatgccacaacagtctgcagtgctgttgccggttgacagaatcatgtgcctttagcaccaaagaaatgtgtgtgacttgagtgtcacataaaacccttaaaattagctctcttgggatgggcgtggtggctcacgcctgtaatcccagcactttgggaggccgaggcaggcggatcacctgaggtcaggagtttgagaccagcctggccaaatggtgaaaccccatctctactaaaaatacaaaaattagctgggcatggtggtgggtgcctgtaatcccagctacttgggaggctgaggctagataatcgcttgaacatgggaggtggaggttgcagtgagccgagatcgcaccattgcactctagcctgggcaacaagagcgaaactccatcaaaaaaaaaatatatatatatatatatataatatatgtatgtgtatatatatatatatatatatatgtatgtgtatatatatgtatgtgtatatatatacgtatgtgtatatatatatgtatgtgtatatatatacgtatgtgtatatatatataaattgtcacaaattcaaaataagtctacttgtatcacttatctaattgcagatgaaaatgtagttcttttttatagatgcaagtagcttacattccaaaaagaaattatcctcccccaccccaccccagattagctctttcctcataagaagctgaccatactgacattaagcatatcagaggctgaggaggactaccccttgcctgtgttttcattccctgctacctaatcaggccctgggagatagaactaatttttttaacgtgatgtttctttccatcagaatcaagttttaaatgtttcaggttagctatgtgaaatccacttaacttaaaaccatttgcaagagagatcaaatccaatttgctaatacaggacttttttttatttctgagtttgaaaaaatcttgagctaaccatgtcagaaattaaaaattgaaaaggactctggcagcctccccatgtgcctaatttggctttgctgaacaaatgaccaaattggaatgagaattacatacaggatttgctcaacatccttacttcttcaactcatttctcactcctgaaaaagtaccaagtttgcatgcaggagggaacatatctatattgaccacaatggcgtcaaaccaggtagaaatagaaaaatggtgattttagattctagctgtgaataaacttctacagtagaagatatttgtcatagaaactcaatttaatgaatttaggatcagaaaggaccataatggtctttttttttttttttggctaattttattaacaggttattttgttcatgccctaccttgcaaagagtagtaataaaaatattaagcgggtaagaggaggaggcttctctgaagtccacctcattttgtctttaataaggcattacattgcacacagacaccagaattctctgtctttctttaaggagatggaagaggacagtagagagagcaccagagagtccaaagatcaaggttcaaatcctggctcagtcagccattagctgtcatgaccctaggcaagtcatttcacttaagtagggctcagggtcaccatctgtctatacagcaaaagtctggaccagatggcctttgaggcccatcttaacagtacctctgccattctaatgtgacacagaaaaggaaaccacagaggtttctctgaaggagggggttcaggcaaatgagagaataatacctaggtgaatagaaccccattcttcactgatgcttagtgttgagctgatggttgtcagtggatggagtgatactcaagagcttcaggtgtcacacagctcaggttcaaatcccacctctaacacttaccagctgcgtgttacttcagcactctgagcctcaatttcttcatctgcaagatgggaaagcattatatatctcataaaattcgtaacaattgcttatcacagagcctggcacatgcaaaggactcaataagagttagccatgatcaccattgttacaaaacaacccaagacccagcaggaggtgagatgtttcttgagtgcctcctgtgtgccggttacccccacccagatcctcaccacttttgcaccttctccaccctataaggtcagtgtgagcaagaaaatgtggctaagagcacacacttggctctaaaaccagctgccccacctaccaaccctgtcaacacctttatgcctccactccttcctccgtaaaatgggaatcatagttcttacctctaggtttactgtaaagagcaaatgaggtgagcatatagagggcttagaacagtggttgacactgagtcagtacgttacaaaaatgttagttgttatcatagctaaggagagtgaagctcagagaggtaaatctgtttgcccaaggtatccgcttatgcatagttgtgcagaaatgtgaaccctgattgacatgaacctggcatatatatcccagagatctgggatagggagatccttcctcccttatacctggttcctaaggcccctcctggcctgttcccccagtttcaggatggagatccaggatagggagatccttcctcccttatacctggttcctaaggcccctcctggcatgttcccccagtttcaggatggctgcctgtgggctccagagttcagatcagagggctcactgggagcagtttgttgagggctgctggggacttgggaagggaaataaatcccaaccctctcctcccttgcctgcagccactgaggggagaaagtgccctaggaatggagtatctcgggtgtcctaattggcacactctgacccccttgcctctcctccttgcagaaggctatttttcacgagagagttctttctctttgttccagtgctcattgcacatctacggatcgatatgacatcttatcctctaaaacattcataatgtctgcttcctaggattctggtggccgcgtgccacgtgcagcctgcgtcttctttcctttgtagtcagtggtctcaccgatctgcccctctttaacggggctgctggttgccgttctttgaagaaagacaaatattgtttgggttgtcaacagtgaatgacaagctcggaggggagaaagatccatttaggtgtagatgtgtgtattgtggggatgtgtttcgttatcagaaaagctcttaaaatcccagaccatgatttatttggtgaataaaacctaccgatattatcattctctaaaggtattttgatcacatgggtcctttcttggagaaagaaaagcttttatttcttaaccaggaaaaaaattgcagcaggaacggggtggtctgcggtgggaaacgacactctgtgcggctaatggctccaggcttgtgtttatctgcatgaggctgagctgacttggtggacaataggatgcctgactagcattgccagtcaggtgcattcctggccaccccgcacaaggaaaagaaagtggctgtgagcacatgtgtctttcttatgtattgatctttccagtgatgctgagagctagggggtgtggttagaggtcacctcggcacaccagatgccacacactcgcagtgtcaacagcacccacctgcagtgcacctgcagcagcgggttccaggagacaaggggagggacgctgccagtcggggagccccacgcatcctgaagctgacaggagccccatttgttttctgcaaacacagcaattgattaatctcgtaccacctcccactcactgtaccatcctgagcctgtcatgagaatagattaattctctggtctttccctgtggattcttcttgtctcaagaacacactgctccctgatcccagagctgcctcacgcaactatcaccttgttctcatggcagacacaaaggaggggacagaaagccttgctacttttgtgagggactagaagtaggaaggcagcagacaaaatccctgctgaggacagttttgggactgtagctggaagatttgagttcctctagagaggtgaatgcaggtgagtttctccaatgccccctctcattttgatgatcttgccacgattctgggattgtatctgcctctcatctttcctcttctttgtaattcctgagccataagccttgcaaccatttggagctgcaagctggaagtcggacagaggctagtaagctttcagaacattctcgggagataggtgcacaaatcccattaccgttaaagggatttgtgggtgtaacttccatgcagtgctttgaaaattcattccactcagtgtattgcaacactgtctgggaaaaataggagaaatcacttcaccaaggtggttagaaaaggatttttggtaaccctttaagatttaaatttttaaactccttttaagacttaaggcatttccaagaatgttatcccacatagttttgtttgcattacttctttcaggctgaaggtaattttggcactgacagcattcctaaaaataataatacattgcagtgggccccctcctctttgaggaagaggcactgcactcaactgcatccccaaaggatgacaagcaaactgacaagggaaaaaacaccaaacatgttgttgactggcctgactggcaattgaagttgccgagcagatttattttacgttgacaatggtggttcaagttaaatagcaaactagttgccaaccaaggacatattcgtagagactaatggctgcttacaaagggaagtgtgtattcatgagtgagccttgacaatatttagtaagtaagtgattctatagcctacctgtcctgttcggtcttgtctaagtagtggttcacttggaaacctcagagggccgatgtcctccagtgagaactctgaatggagtctctaggaggacagtatgggaatttagaactctgactctgaagttgcatgtgtctgggtctaaatcccagatttcccacttactggctgaattgtcttgggcaagtctcttaacctctctaagctcctatttctttatctataaaatgtagattatattaccacctaatccagtgagaatgaaggggaaaaagtaaacgttcatcttcttcaaaatccagtgtcatcccttctcttccaaacaaaaggcaaagctcctcaaaggcaactactccttcaccctgcccgtcccttcacccaccactcctccttctcactaactccactccccttcggcgtgctcttccccagacgtcagcataaactgctttctcaattcctttatgtctttgctcaaatgttacctatcacaaatgccatccttgaccagactacattaaatgaaaaaaggaagaaattttcaatgcatcccccacctgcgagtgcctctgaaccctaaacctggcttttcacttatgtgtttagtttctacacctgcctctagaatgtaggttccatgacagcaaggattttgtcttgttaaaactgctttactcctggtgcctaggacacatctgacacccagtgggtgtttagtaaatatgtgctgactggcaaattatgaatatatgctgcatgcaaataatgagcccaatacctggcacatggtcaaaatgaacgttaattgtcaccatcaccattgagtagacttattcacatgtgttaattttcactgctgattgcaaaggggcctttgcaggttgcctatgcaagttcagggtaagcagttgtgcatgttagccctgattattccactgtggttctctcctcccagcagtggcacttttggaattggtatatttcccccaggagccccgacattgttgacttaattggctggtgcagaggcacggagacccagccctaaccctttctgtcatcctacctggtctctgaatgagctctgccatcatctctaaggcccttgtgtatctgatggcatgctgagccccaagacccagcaggcatggctctctcctcctgctccctgagctctgcttggcctgcagtcttccattttcaaagggaaagcccaatctcctcctcgcgttatgtatcgacaagtctgatctttaaagacaccccctgctcctgggggcctgctcggcaaacacagagcatccgtggcctccatgtttgccctctttgacaagcaggggctgagcagctctctgggaagtattgctgacatattgattgactctcttgtcaggttgatcctctgccagccaatgaacacagaaggttctaagtggcacccagcagggcccacacattccctaattactatttcatacaacccccattccaagctgccacttttctggccctataatctccctgtcctgtggttgctggagaatcctcagttactcgcaacgaaccctgctccctttctcgggtgtcactcccttgcagtattgcctttggaacccacctggcacaaaaacacagcaacttcaataagaaaatatcacaccctcactccacgtaggtctgtttattatccttactgaaatcggggatctgtgtgtggtcccaccatcctgtcttggttcccttcagaatgccaagaaagttttctccaattagccggagggatactctcagagtttggctgcctattgtgttttaagtggctggcttcccagctgccacctggatttcatgagtttccgctcagagcccttccccatcccatccttagtgacccatggagcccgagggtctctctgaagcggagcctgtcagatcatgatgaattgtacattttggctgtcagtgagagggaggaatgttagggagagggcctcccaaactcatttcacttttgacccccagatgatttggaccaggccttttgggatgaactgctagagcattcaaggtggggcgggagagggaaccaccccagtgcatccaggatctcttgaggagaccagcatttatttgaaatcttgagatgaagcagcaataactctggctactctgaggtttctcagctttctttttttttttttaactaattaaatttttggtagagatagggtcttcctatgttacacaggctggtcttgaacacctggcctcaggcaatcctcttgcctcaatctcccaaagcactgggattataggcgtgagccaccccatccagctcagctttctaagtctggttctgagagtaaattaaaattggaggtatgatgatatcacatttacagtgctgttttttgttgttgttcatagaagcaaatatagtggcccaaagtatgtgctaattctctctggctgagtttcagaaaggaccttaacccaataaaacctaaagggatgcacagagatttgctgtataaaaatgccatttcctagtttccttataggtgaaagtatcagtcaagctagcctcagacaggctgctgtaacaaacaatcccaaactctcagtggcttataacagtaacagttcatgtcttcatacatgctgtattctatcactggtcagccatggctgtagcccacgtcatcttcactgaagacccagaatggctatgtgataaagtatgtgctgaattcaacagtataaagaaatctaacccctctcgggaaggggtgtggtcattcaccaaccccaatgagattattatgagttttgaaacaaagaagaggtttgctgagactccattacccatagaatctgtaaccagatcactatgaaatatgaagcagatagccacctcccacagtaatttccttctgattctgaaatccctgttctcaaacttcacagtcaatagtttcctcatctgtgaaatggggttgataatagtacctacctgtgagtcttaagataatgcctttagaatgtctactatggtacctggctatagaaaaggttcaatgatggtggggcgcggtggctcacgcctgtaatcccagcactttgggaggccgaggtgggtggatcacgaggtcaggagatcaaaaccatcctggctaacacggtgaaaccccgtctctactaaaaatacaaaaacaaaattagccaagcatgcgggcgcctgtagtcccagatactcgggagggtgaggcaagagaatggcctgaacccaggaggcagagcttgcagtgagcctagatagcgccactgcactaaaagaaaaggttcaatgattggcagcaggtgttgatatgctgatgattaaaatatccttccctttgcaaactagtccatattgctaccagcactgttttatcccatcttctatgcctctgattatgtgttttttaatttataagcatataacatcctacaatccaaccccccaaatctgccccccgtgtatcattatctattctaataaatattgatggagtgccatttatattcaagacactgtcagatcttttgggggttgcagatgtgtaacctctctgtggcccttaaggagccattattctacctgtacagggaaacctttatgaaaggtaaagggagagattgattgagagactgatttctcagcccaagccatagagcaaatcagtagcagaataagaaatagggctctcattagtcaggaaactcatttacttcacagctccctggggtctttatcctaaggacactttagtccctccccaccggccagagagagcatctcgttttcttactcaagtgagagagaaagaatggctgattaaaaaaaaaaaaaagtgccaacaaaaacctatttcagacgctcccaaaaaacaagagaaggtggttataccccagatataattctcacttatttacttaatgttcagttcaacaacagaaaatatgcccaaacttgagtttcatttttgttgcattgcttcttttggaaggacaggtctcatgttcagcagatttggcttttccccttctccacctccatctcactttcttatttttcttctcactcctgggagttgtctgagaagttactggtgtactctgaccctaaccctttccacctcatctgtagttttcttattttcaggatacttttaaaaaataaaaataaaaagatgccatggaacccaaaacaaagaaaaaggtgggaaggggaggcaagagggaaggcatccttggaaacagaggaaacacagttgcagggatgtctcttcctgttcagtaacattaggggattgtttgcttccttttctcccaaagctgatggttgcaatatgttctgcaccttacagtggcaagattgagtgctataagagcagagcagttttgacaagagtttgagatgggatgttggggaggttgtcatctttgcctgatgggacccaccactccttccatagacgtgaaatcaaagctttgttaggcctgggttccagcggcacctgcagtacctgccagtgtctgtcttaagaccctccttgaaagaaccgcacctccagtgcagctgcagctggcccaaggcgagcttcaataacccaatagtatcatttttttaaaaaattattttaaaatagctaattccttggctcccttcacctggtaattacaaatcagaagctatcgttatcttgaagccaccatgattagttctcatttcctgacctctgtatagtgaaaatatgtcattatttgaggcaatggaatctggtctcttcaagtgagtgacctacatataacggacaaactgcaggagaaaattaggtgttaccttgatggaaagtgtacagtaaatgtcacttactcttattactatttatcatctcaagaagttgtaacagtgggcctttcactttagaggaaagaaaacatggttctaagatggagaagagtgtaagtgaaaagcagacacacccacacacacacggacaccttgccaccttcatctgtggccatcaatctgagctgtattgtttgaagataggtttttaaccttaatagaatgcagtctgactttacgtggtggtaggcatgcagaattaattgctgtgtgaacaatttcctaagcattgttaattgtgttccctgcagataattgtttctcccatccccacatcagactccaaacgtctccctgtcaacagccctttctctcctgcggtggtaggaatgtagcaacagtgtcaacctgtgtccagtggaaatgccagacatcgtttggatgagagacatgcaggggaataaattccttacttattctcaaaggaagcatctcttagataagggctttgaaagaatacaggtgtttagggtttgcttttcattccactcagtagaaaaaactcaccaagaaccatcagggatagggttgtgttaagtttgctaaactcatggtggggagttgacacaggcaggatgacaaggaagaccagaagtttgtttggaggcctggggtgcccatgggagtcaagacttcttcagacgtgctcagttccttagcaaagaacaggcagtatttcagaactctgtttcattccatactctgctaaagtgagagcgacagagacagaaagaatagtaatgttttcagaaaaggaccccattccaccatcaaccccccaagctttttctacaatgtgctgaaaggtatccactcatcatgaagaggagtggaaaggaaaaatattctaaaagtttgaaatagttagggaggtgggccagtaccactatagatgctgctggctgcactgatagttcagagcaggtaccagcaaacaggtaccagcaaacaggtactattcgggtagcctcctttgaagctgatttacttgtgagtgtatagtttggggaaacaatccttgtcaatgcccctagactaacagtctaaaagcaactgtgtccagagtgtagaaaaggatggatgtggtagagcagcactctttacagtgattcgaaagggccattttcccctccatggtggcaccgtttggaagatctgggctgtgttttctcctccctcctccgctcactgtaagggatcctctccccctgagactgtgagcagcagcgccagaaggggagacctaaccacccaggtctctgctttctgtatttagctaatccctgtggcctggggcaagccatttttgacgcagcttcctcaaaaggcaatcgcttggaaaagggcacctggccctcccccttgacatttgcattgctgaattatctattcatattttcattactttgtctctcctgcagcaatgcatctgctcggactcaattggcaactccagcctgcagatgggcacacctttaacaatgggataaggaccggcttaccaggaaacgatgatgtggcaacaatgccatctggaggcaaaggtgaggttacagctgctgcttgccctcttgaggtcacaggaaaattctgagctctcgccagctggttcaggttttctaatccaaatcttggaaggtatgccaaaagaaaaagaaacggggggaaaaatcattgcctttcataggtgcccccattaaaagctgtttgctgttcctgtctgttagctgtgtttggctggatcactcagagctggcacagtgcctgctcagagcaatgtgcatacctatgctatctgcagcaactggcatggtccagagctacttgaaagcatcccagggcctgtgcagaaacagcagccacagcagcagctggagtggcagcagcagcagcagcagcagcaggagaaagtcctgcctaatcagaaggcagagagcagcaggcagcacatgccatcagactgggtccctctcccaggagacatgcagcctccctggggaggaagctgcctggcttggcatgaaagagaaaggctcagagctgctgtgctttgggggagaatagaaaggagttttgacaactcggcaacaaagcttctcttctcagaacagtgaaggggacaatagaaatgtttattgaagcaatcaggcaactgtatccttgaagggaaaaaaaaaggtgctaacaaggtgctaagaaggaggagagaaaacagaaccatagggtgggggtgggggagactggagcaattaagacagagcagccaatggaatggttagccaggctggcacgcagtgagatatgcttaattcgggatggaaatcgcaagggagagattgtattaaaggatttctccaacatgcaaatttccattctgccttttagcatctatagccacttcacccccacatttcggaaacaccctacagggatatttcaaagaagggaaaggaagcagcatttattaggcacctattgcatgccaggcttagcattgtataactttaacaactttaaaggaaggaaaaatctctctgagaaactcaggaccagaaggtatagaaacttactcaaataggtacaaatttggactcagagttgtgccctgtgcatctttgggcaggaggttggagctttccttcaagcagtcattttccacaaagaagattccagaattcatctgcccccagaggtgcacattagtcatcctgagatgctaatgctgcttcaattatcctccccagagctgtcctaatgctttgaggatgacttttttgtctttttatccagtctttaagaatcgctgtactcatctgtcataatcataacactaaattacctttaagtaagcatgaaaaagttttatctgaggatgaaattatatgctttccataatcgggtaagttaaactagacctaaaactgaaaagtatattttgccttaactgaccatgttctgccttaactgaccaaaaagcccagagccaaatgtattgacctcagatttgaaacctggtcacctccagtacttgacactgtctgctccttcagttttatctagggcaatggttcttagtcatagcatttttgcacccctagaggacatttggcaatgtctaaagactattttgattgtcacagttggaaggggcatggcaggcatctagtggataggggtcagagatgctgttaaacaacctataatacacaggacagccccctgtgatgaagaattatctcctttcaagatgacaatagtgctgcccttggaaactccactttatggggtctccgtcacgttttatccataaatgtcctttaatctacaagtcagcacctcatcccttcagaagaatgcataacacacatgtgaaatgaatatgcatattctatcattgggcacagagaaattgtttatatgtgtatacattctgaaattatatgccaatgcttttcgagtagtgtccttcataaatgggaattagtgatctctactggcctccgtaaattaaggtcaagatcaagcactcctcccatttgtgataagcctctatttctacctctgctccccaccagcttttgcatcccacacccatagaacaaatcttaagagtacaagagtatgcgtctctaaattaacaaatgaagaaacactttccattgtgtctttggaaagaccagaatttttcccctcctgtgcaacatgcttttgaaaatgttgttgtagaagtcatataacattactagttcagatattttccaaataagttatgtgacagacaaaatgttattttgtttttttgttttgttttgtttgagacagagtctcactctgtcacctaggctggagtgcagtgatgcaatctcggctcactgcaacctccacctccccggttcaagcaattctcctgcctcagcctccagagtggctgggactacaggcatgtgccaccacgcctggctaattttttgtattttagtggagacggagtttcaccatgttgcccaggctggttgcaaactcctgagctcaggcaatcctcccatctcggccccccaaagtgctgggattacaggcatgagccactgtgcccagcagagacagacaaaatgtttgccaaatcattgtccagtgaattttgtcaatagaatactcaagaaaaaagtgtgagaatttaaaattgcttagagatgaaataaaatttgaaacttaaaaagagatcagatctcttcttaagtggttttaaggtttggcttataaaatgactaaaatgttttcagttctctcacccatgcctatttcttttatcaaaagtgaccttgggtttgaatttgtatacccagtgacctccgcgctccccattccccaattctatacatttagataacctgaatcaattccaatcgacttcttttccagtgtttcaaagagacaatcaagatatattggcaataagttaattaaataacaccgcctcctttttttggtgtaggatattccttcactccaatgttttaaccaagatacaccacacattgccaaggaggataatctcattaagcaattactggataagtatccagcagaagcaaattaaatgtaagcaaaacacaggcatgtgagtcccatctaagatggcacatcgatagagatttcattacctggtctttaggagtatttacattcctcaggtttgggaacaagtctaatagacagggcagcctacacactctgatatgttggtggaaacaaagcacttgattaattagttgggagagtacattctttggtctttgcctttccgttttccatttgttgttgttcgagtcttatttttctttcttccactctccttcaattaaaccttaacatgaattgttgctggctttcacatcaagaagagggaacacacagtctgccagaatcactcaccatcttgtgtgtatttctatgttaaaaggaatgaactcatacatcttcattacaagggcatggagaactttctctgtagatctgggattagataagccttgagaaagacgattcaatacagtattctgacctggtcagataacataagggaattcagtttgattggccaggcccagggaaagcatacaagagattttaaagggcgcatcatacgtacccaatttgtgcacagattttaagaaagaataaactatcaagtatagaattgcatggatcattctcaaaacctatcactcattttagattcaagttgtcctctatatcaggggtcagcaaactacatctcatggaccaaatctggccagctgcctgtttttataaatcaagttttaatggaacaccaccatgactattacctgttgtctatggctactttcagaataaaatggtggaattgagtgggtgcaacagagactatatggcccaaaaagcctaaaatattcaccatctgaccctttaaaaaaaataaaaagtttgatggccactctgtatcattgccaatcccatttccacttttctagaacttttcctataactatccaagttataggagtccagaagaggaagatcaaactcccaatacatcacttcttcctacttgaccaagccctagttataatatattcttggtaactttgcattggaagatgcactataatataggattttggagttggtctggtggatacaaacaccagctccatcacttagcaactgtatgactgtaagtgggtcatttgttctctcccaacctccagttcctcatctgtgaaatgcaactccctcataagcttgctgtccatcataaatgagatgacccttgtaaaacattgcatgtggcatcaggcatgtaataaatgatccacgagtcttagttgttgaaactgatgtcatctttacatctctcagctggtccatttaacaagtttccatggcctgtcacatcttttgagaggctatattttccaaaggtgaagaccaaccaggtgcagtggctcacgcctgtaatcccaacactttgggatgcgaaagtgagaggatcacttaaggccaggaggtcgagaccagcctgggcaacaaagtgagacctcatccctatttttaaaaatataaaaataggccaggtgcagtggctcatgcctgtaatcccagcactttgggaagccgatcacgagctcaggagatcaagaccatcctggctaacatggtgagaccccgtctctactaaaaatacaaaaaaaaagttagccaggcggggtggtgggtgcctgtagtcccagctactcgggaggctgaggcaggagaatggcgtgaacccaggaggcggagcttgcagtgagctgagatcatgccactgcactccagcctgggcaacagagcgagactctgtgtccatatatacacacacccacacacacacacatatatatgtgtatgtatgtgtatatatatatatacacacacacatatacacacatatatatgtatatatataaaataaaacaaaggtgaagacggccttcagaatatgaagatagacaataccacttcacctttttcctttaccttctaagaattaaccaaaccccagatgaggatttcttcccaacattggcttgatgaggtcagtaggaagcaggtcttcctattccaaagggccaatgtgtacaccaagttggcccctccacactgcattatttgtctcactggagcttgagttccatcattgccagcctgtctgttttaagccctaccattctcggtttataactcagctgtaaacatttatttgtgcctggagcacatttccttcctaccctttgaaaaaaaaaattagaatttccagatggtatgcaagttggaaaaaaatggcaaagactgttattctgtttagaaacatgtttttctacacttgccctttcagcagaaacttcataatgatttttactagttggcttaatgcgtggtactaggagccagattagcagggaggttcgtaaattcttccgctggctctcatcagcctctcaatgaacacagcccagggttttaaaatgatcacttccctatatggggcttttccaaagtcggtgaagttcccagaagggcaaagggtcattatgtttgagccaaacacccctttactgcacgtctactggcaaatataccaacatcctaactaccaacccaacaactcccctcatttaggaggccatgctgttctacattgttgcagatgggtactacttacatgcacttatactggtggacttttgcttttgattgccacccatagccccattctaaattgcatagtttctgttgtacatagcatcatggtggcttgacatgggcattaataatgagatccaatttccctttctgtgcatttgcccatatcctcactggccacacttctctttcagaattgacttgtacacccagatatctggtctatgatctctaaatatgtacctgtggtatacctctgatatgttggcccttcatacccacgggtatccacagattcaaccaacctcagattgaaaatatttggaataataataatacacaaaatgcaaataaaaatgatagtataacaactatttacatagcatctacattgtattaggtattataagtaatctagagataatgtgaattatagaggaggacatacatgggttatgtgaaaatactacaccattttatataaagagcttgagcatttacagattttggtatccacaggggtcctggaatccataccctgtggataccaagggatgactgtgggcctgaatgcagtcagcataggggttagccacatgggttttagtgtctgtcagacgtgggttttgatcatagatctaccagtaaaaagctgggtgaccctaagcaagtcacttatcttccatgaacctcagttctctcatctgaaaaacaggaaaaattgtaagagtatcaggagattacatggtgattagcagccactcaataaattttagctactatcaataatagtaaactaaactaaatattaatgcaggagcaagttcatctgaagagtcataggtataaatacttgttaacgttcctagcggcaaagagttgactatttttatctaaagcaacaaattgaaatttcaaaagatgtaaaagccacatgtagtcccaagagctgaaacattttctaaaagtcattattgtgtgatgttgtgaacaccatcacagaagcagtgactttcaggatgtaattgcattcctaaagtatagccagccagcagcagggtgaaggctgatgggttgctgatgtctcagctgagctgtattcttgggcagtcaatctaaggtccttggaagaatcttttcacttatctgttggttaaacagaaccctcagatggttgtcctgattcccaaataaatggaaacgaggtgtaatgactgtagcaatattctgaattcaattttatttgcaatagataaaaatatgtgaggcagaataatctgcaaggcagatttatgctgaggtgcctccagagttcggttaagttaggaagtattaatatgaggcttcatttccctggtatgactatgagtccattccctttatcacttgtttggggaatagtttcactgtttctgtaaatgaattatggcaacattttctgaaatgattagctcctaatgtagctatggaaggctgtcattttgctcaacatcagtcgtgtttaactggttgaaattttaggtacatatttcagaaataggtaatagtttcacatttacatgagcaatcttccgtggagttatagagttggactatcctgtaaaattgatcattagaatgttgcctctaaaaacccagaaatctcatctctaagctaaagatgaactagccagaacaattgtatcttaagcacgtgcttcttagggcaaaatgatcatcatgacacttttcattgtgcagctcttggatagactgaaaggtttgccatggaagccccaactctgggagacatgaactggactggttcctgcatgccagggtgccaggcctagtcattgcctagaacccaaggataccagtgagatcctcacagaatgattacaggatgctgtttaatgcctcttctcttgatgcccctaattcaatctcaaagtgaattcataggacgctggacaacaggctgcctagataagagataatgggaatacaacatacaccccaactctgatgttgaccaaagaatacctactgttatagtcaatgcttgataaatatttattgcatggaagtatgaatgaatggcccacccaacattgcttaggacatttcttaatcattgttaaataaataaaatctggctgcttttcaataacgcagactgcacagagttgcccatgtgagaagcagctagaccacacaccaacaccagcaatttgcagagaatgaactggtgatgcagttttctctgaccatcgtatcttaatacatgtgacctgttgtctgcccctcccagtctgcagatgtactggtcactcactgtatattgatttcagctgctctggaaaatgactgccagttttattaagggctactccacccattggccctctttcattaatagtgcctacagcaggcagcctgtattttttattaggccatcacaaattcaccccccgcaactgaaaaaaagtacttacagctgattttaggtagcatcacaacagacaggacagaaggacgtagagcacctacaatttaggtacaacatgcagaagcaccccaaaatacagatgagtagacagactcagagagggcttttgattagcccaaaggcacacagctggtagctatcagagctgggattcaaacccaggctgactagctccactgggcaacattgcctccttaaggtctcagaacttctcaataggatattcagctagaccttaaaatgtctagctaggcattagacattttaagataaagataaaaatcttaactactttgtttccttgctgtctgcctctcagtgatgtcttgtgagggactcaccatattggtggtcctggaacagctggcatggctcagggaagcccagcttcaagtccttcttcatggaactcagcctggctttgatgctgttctttttgaccttagagaacaacagagatctgtcctcctggacatcggcccagaaatttgacctccaggaatagagtcactgagatggttccccatgctggctgcagcaatttacagaaaaacaccttttctttttatctctttggaggcagtatttgtacatttttctctttttcattgtttttaaaattacaaaagttatacacactcattttcaagatttttaaaaagtatataaaaaacttttcttttgctatcatgaatatttctctaacaattgacaaatttgaataaggcctatagattacagtcatgcatggcaaaacagtgtttcagccaatgattggccagatattcagtactggtctcataagattataatggagctgaaaaattcctatcacctagtgacatcttagctgtccaaatgttatagtatagttactttttttattaagttagtgtagcctaagtctacagtatttacaaggtcaaaagtagcatacagtaatgtcctagcccttcactttcactcaccactcactcactgacttaaacaaagcaacttccagtcctgcaaattccattcatggtacgtgtcctatacaggtgtaccattcattttttatctcttataccatatttttttactgtgtcttttctatgtttagatacacaagtaccactgagttacagttgcctacagtattcaatatagtaacatgctgtacatgtttgtaacctaggagcaatagggtataccatatagcctaggtatgtagtaagctacaccatctagatttgtgtgagtatactcacaccactatgaaattgcctaagagtacatttctcagaatgtatccctgttgttaagtgactcatgactgtatatatatagagagaaagaatgtgtgtaaaaaaatctatatatgtacatatatatgagtaaaaagtgaaaacccctctttccaaaagtgtaattcagttacacacctgaagaacttaatttgaaagcaaacactagcttgtttaacaatatggatatcttctgttaaataaatcgagcttgtgaaagtgaagtcacctgttaacaagcctaaaagctttctaataactcctcctccctcctgctgaccccctacccctgtcgcctcgcccaacacacacacacacacacacactcactcacactcacacttcttcatagcatatacccagcaatgatcctcctgacccactctgagaccacaataggctaataaggaatgccatttaagatatctttgggtctgagacactctaatatagatatggacattgagactttgagaaatacacctgcctaaaactagctagctgcttagtaacaaggatggaaattcaacataatcattcatttacacctgttccttccacaaacatttcgaagtcattaagtcatgactaggactcttgacttttggttcttaatctaaggattttctcaccatatcacacctctcccagtttgtttgtttgtttgtttattgttaagattttacacaaaaggcaaattaagcatttgctcatgactcttcaaaaggatccacaagaaaagttatttcaatagtaaatttcatatagagcttctaaaattttattttatttaataaataaaattcagtttacatgttgtcaggttctaactgaggtctgaggggagtcggtgggagagtggtgggtagctggaaaaaccctcaaagaatcatagacagtttcaatatggctttactctctctctctctctgggcatgagtgagcctgggtgcgagcctggttgcaagctggatgtacagcatcagcagggtagttataccttttacagacaatagtggctcccagccaagcacaagctcacatgagtggttacctaatgcgcctcacatggcataattacataatgagcggagttgtgcgcctgtgctccaaacttgctgagttatgcgtgacaggatgtctccctcggcctagaccgcagcacatccattttccttacacatgtagattttcaaagtaaatctttgttaaggctctcactttaccctgtcatcacaggggttttgttacaataccccaccagatggatttgtagagtttgatccagttcaataagcatttatagatcacttacatttgccaggtgcaaagcttagagaacctagagatgaatctgcatctctgcctgacctcagggagcacagtgtccagagacagagacttaggaaggcatgcaaaatcaagtacaatacctaacaacatctgctgtgggctgcagaaaagcataattgctatagaaacacagagaaaacaattttgtctggctgaggacagtggttggggtggtattgtaaaggaaagtagaactttagtgtgaaggtgcacttgacctgaaccaggccctgactcccagttttaagcttgtccccataaatgaatctattccagaaaaataagactcttgatagagagctagatatatacaaatagacatttagacattcatgtatattgcatgtgcccacactattttttgtctcttagagaattccttactctgcaaagaaagccagatgctttcccacatagtttttcatcctttttttcattccatgtaagaacttagcaattatttcatgattatttcatgttaggcactatactaatctctcttttgtgtgcttctacttgttacaccctccaaggcagttagaactattgttcccattttacaaaaaaaaaggactggaaatccagagaggttaagcaaattgctagaggtcacacagcataaaagaagcagagccaggattcaaacacagttctatctgacttctgtacttcatcccccaggtgcactcccttatttagtgaatgggatgaggaagcgaggatctaaaaccctaaggggcactgtgactactgaggaagtagcctgtgctggctggtagtgggagctaatttagtcagtgtcctgaggccagggtgtaataaggaagaggacctcactgctataagaagcactggggctccttgtctgaatttctccagaacagctgctccctggagacaagttcccttgcacatctccagcatctgcatctggcttgatatcacaatccattcaggtttccacagtagattagaacactcgtgggtgctgatttcctgcctctttttcatatcctgtcattaacccagcaatgccggaaagcccaacagacataaaggaaagccaagcttattaagttaaagatgaatcatgtttttaaagttttctttttttatttataatgcatttctttaacttgttgccatgctgattgctggggtttcttttggtacctatcagaggcccacacactcttcttccccaggcggctctcttactatgtcccttccttactcctttttatattattatattccttctttttatttatatcctttttattatatcccttccccaaggaaggggtatcaaatgcagcattttaaagtaaaatttagtttccagtttatagtaatgagagctcctgatcaacttgttgtgataacaagtgtttccccctggacatgccattgttttagcaaaacccccaaataaacaacacctaatttagggttagggccttacaggtaataatacttattttgtgccagaaattattctaagagctttacacagcctaacctcagtaaaaccttataacaatcctgtgaaataaatagtgtcccatctatacacatgaggacactgaagcagagcaagatacatttagccagtatcaaagttaggatttgagccatggcaatttcagcccagggtctctgctcttaaacatgatgccgtattcctccccctgcaggtaagtaatcagtatccattagaaaagttagccaacatttaaaagttcatgctgggtgtggtggctcacagaggtaatcccagcattttgggaggccaaagctggagaatcacttgagaacaagagtttgagaccagtgcctgggcaacatagtgacaccttgtctctacgaaaaaaaaaaaaaaagaaaaaagaaaaaaactttaagcagacagggatggtggtccatgcctatcgtcccagctaatttggggggctgaggcaggaggatcacttgagcccaggaggtcagggctgcagtgagctgagatcgtgccactgcactctagcctaggcaacagagtgagaccctgtctcaaaaaaacaaacaaaacaaaacaaaagttcagaatgtttgctaaataaaccgtctagtccccatctgaaggtctgaaccactcaggacttctggctgtttattttatttttaaagatgagatgtgaaggaggcttccaaacttcctttcggacctcattccctacttttattatcctagaagtcaaagggttattcttaagatcgaaaccagtgtttctcttgctttattttaagtccctgctggcttcgtattgagctgcataaaaatcaatcacctcatattttaaagaaaataagagggaaaaactttatatcttcaaatcactctgtggttttcttttataatttagacatgaaagaccttcagagaccaaaagtgtcatctctccattttacacatagagaaactgggaccaagagacagtgtcagacaggctcgctcaccgtttaggccagtctttagcaattttctcatttctcaggatcatctgaaacctttgcaatatctggtggccaaatgatagataaatatttttagaagagttagtccttcacagaatgtcgaggggagcatcctggccccatcaggctgaagaaatttttggatctacaaggtcacaaaagtgatcgggggttccagaaatgaaaagactcccctcaaaacaagaatgacctcagttctttctgttttatttcagttggctcagcagttcttaggaatatagaagaataatattttatatttcttagcaagttcagaatcgatttgaaggaatcacaaatggcctttatactgagactttttttccccattttagagataaggaaaatgaagctctcagagattgattaacttgcttttcttgggcaactgctagtcacgctcagcttttccttaattctgtggttgcaagggaaaccacacttggaagtatagggggtgctgactggttcattgtttttaagaactccactttaaaaatagatatttttggaattcctattattaaagttctgaaggatactgagtgtgggcaaccaatattttcaacataagcaattttaaataatgcaacagagatgcattaatataaatgaaggagagatgttgtttctctgcggctcttagacttctccctctaactcaagatctgcttgagtttcaagtcttcattttctactgagttgttttatttattctgggctgatttttgttgaaaatgtcagagtatatttgtgtctagaaagaataatgaaaggctacaagaattaaatttggtgccaaattaacatcaccctcccctcccctgctgataagttttacatcccagtcacatttgggatagttggaagctttacatgtatttatcaggctccagatctgattatatttgatcagtaaagagtaataacataattttagaaagcattgtgccaagatttcggatgccctggggtgtgcatttatagctttgttatttgaaacctaaatgttttagctgtaacttaaaaagaaacttgccatgagtttaatcttaatattaaaacaacaacaaaaaaaaacctggcatgtaattaaacaaatatagagccaactaatctatacacgtcattgactgctgtttattccttttttttttttcagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccaggtatgaccatgtttgatgtaatcaagcatttaaaaaaatatatacgtatatatgtgtgtgtgtatatatgccacttcacatccactacaatgcctataattaaaagatggacaataaaaatgttggcgagaatttggagaaataagaacccttgtacattgctggtgggaatgtgaaatggtgcagctgttgtggaaaagagacagtttttcacaaagttaaatgtagacttaccatgtgattgagcaattccacttctaggtatatacccagagaaaattgaaaacaccattttcttacaaaaacgtatgtatcagtgttcatcatagccttatttatgatagccaaacagtagaaccaacccaaatgtccaactggtgagtggctaaacaaaatccgatatagccgtaccattagtcagatatagaaaggaatggagtattgttacatgctacaacatggatgaactttaaaaacactatgcaaagtgaaagaagccagataccaaaggccacatattgcatgattccgtttatgtgttttgtccagaataagcaaatacatagaaacagaaaggaggttagtggttgccaggaactgggaattggggctaactgccacggggtttttggggggtagtgatagtaatggcctgaaatgaggtgatggtttacccaacatagtgaatacactcaagccacagcattgtaaaatcacaaaagctacccaccttacagttattcacagtgtcgtatgaattttatctccaaaaaataaatgctaatatcccaacctgatgaaaacagctttactaggtttaggggttaatcactgggtactttctgttcagatgttctggttattggattaatttgttaaaatatcactaggagacatctcagtatatatgaaaagaataatgtaacataaactaaaattcagcagatgtttctctgtggctcccctgtactaagttccttgggaagtccttggcactatgaaagtgagattattcacagcattggaagtgaagagattggattacattatggatttcattattttttctctcattcttcccttagtttgtcgtggtggaagttctattattatacataacacctggggtaaattaacacctacctagtttggttttcttttccaataagaattgtatatcctgtgaaaaaaccagtgggtttttcctgccttgtatgccctcaaatccaggaagaacataaggtacattaggaaaaaacccaaaacatgcatatatccagtcaaagctgactttgaaatgtgttggaaaggcaattcatctagaaaattcaattggaagaacttaaagctataaaaaaacccattggcaaatgcaaggtagtcaggctacaatttctttacctttagctcatggcagacattgctaatcaatgacagcacttttccttactgagcccagtgcacacatacctcccatataactcttaaggcagccactatcaatcgaccattgttggctctcaagatgaaactgatttgcaatcccatctttacagcctaaaatgatcaatataagaactaaaaggactatttcttttttgagcagggagagctgagctgtgtaggtttttatgatcatacacagcccgtgctatagggaccaatatgtaatgtggtaatcagtgagtcctccatccatccatccatccatccatccatccagaaaaaatatttatagggctagacactgattatctggagatgagttaacacagcccctgaccaagcagaactcttgataacagaaatcatatctgcttgtcaaagagattctcatcaagacaagaagaggagttcagctgaaaggaatccctggtgcatttctgtagcttctggacaggctgcaaggtgctgttctaagaagttatgcaaattgttaagtggtgtccttgaccttcaggctccactgattctcttgtagcaaaatgaaggatttacagtagtgaaatccactgatcggcattattgaggtaactgtgagcatgaatctgggcatcgctgagcataacttgcctctcaaccagttgcatgcaaggagctttgctaagaaaactacttcttccccacattacccccaaagctctgcttgcccccttctcttgcatgctccaggaaaccagaatcatggaaaagccaatgatcatggcaagtcaagttggtaactctctgtaactgagtggtagtggacagcaggcagaagcatactctacctggcttccctgctgttctgacattcaggactcaaatcctcaatgacaatgtcttttcttcctttgtggctacgccacactgtccatctcctgcctagactgtgattgttctagtgattgtcctctcaaaatagctccactccagagacagccccatcgcacatttcaagggaagggaaatgaataggcatgggctgatgtgtgctgaggtttcagtccagctgccagtttgaaagttcactgtgtgttgaggggtcaagtaagcaagccaccgtgccgatgcttagaaattcgcaagacaggtacaatataggggcactgttttccaaaaagaaagaaagaaagaaaaagactccgtatgtattctcacattcattcgctgtcattacatgcattcatgtccatttgatgaactacatttcctcaaggagacagtgcttagctctttgcggggataggcgactgacgtctcgaactattatagaatttctcatttttattggtatatcctatcaaggaacataagttctatggggattggcagtctagccaaggtgactcatttgagctggaaaaagagaaagtgaaagaggtggggtgggggtagaatatgaaattctattggctgtgctacgtgaaatagttgtttaaattttattgagtaccatgctctgaccaagagcctacaaggtttagtatccttgtccaaggatattacatacctgcttaaatttcccaagaatcagagtctgtcccagctgactttttgaaactggctttttatagagatacagagacaacattgcataggagaaaatgtccagaatgtagactctgccacacattaaccaggggaccttgagcacgtcccttaacttctcttaacttcagtttccttttctacctatgtaacctgcttcacaatacttggttgtaattacacaataacaacaaaggtaagatgggaaaaccctttgtaaacgaaagcgcaatagaaagctatgatatatgagtgttctattatacttagaatttatgtgtagccctggcaaatcctgtatgtagataggcaattatacaaatatagatttttttaataaattaatttctagtttcttcttctttctaaagaaaaaactacatttcattgcagaaaagttttacaaacagagaaacaaaagaaaaaagtaaaaacactcctaatagaaagcagtccccttttgctaaatgtttatatattatttttgttataataaaatgtatccatttcagtgaaaaaaaaaagaacctagaataatggtagcctcaaagaacaaaggtttttttttttttcttgtttatgctacaccattagtggctttcaaacaggggtgattttgccctccccgactcccaccctggaaacattttacaacgcctggaaatagttctggttgtcacactgtgaggaggttgctactagtacctagtggatagaggccaaggatgctgctaaacaccctgcagtgcacagggaagccccagcacaaagaattaacattagcttaagtgctaatagtgctgaggttagaaaactctgcttcgcatgtccctcttaggttaacaagaactttgctcaatgtcaacctcattcaaggacacagacctatgaaacttctactatgaggaacaagaaaaggagtagatggagaattgtgtaccaattcctacagaactctgcttggaagtcacacatatcatttaagcacttcttatatcaaccaaagcagtcacatcataactttagtggaggaggacataccatcagatggtgtcccctggaaggagcaccagaaatatcaatgaagatccctaatgacttaaacataaaacgttatgagacctgtcctagtggcctttgtgtgcatcctcaatccttttcttgaaaataaacccttaaggattttatttatattcccaaattgtcctgaaaatgtgtaccaattacactgctactcaccagcagcattgtggaaacgcccattttatttacttgaacacttgcataaatgtaatattattgtttctaaagctttgccaattttaaaggtaggtattatatattgagctttaaatgcagcagttttgacttcatgcattgcatttttaaagacacagacagaaaaaaaaagtcaatctgagtcattcttagcctactaactcaaattcttatggggatggtatgtgtacagtggaagcctaatgtgccttgccagatatctgaaatcctacaaactgtgtcagatttgctcagccctggttctagaaaggtaacagacagaagaaaaagaataatctgacctggctacagtgctaggtgtcaaaggaaatctcagaggcagttgcagcaagtcagaatcttgggcggttaaggcagtgagcaagtttgcttgacagttcatcactgattgctactgatatgtcaagccaagtaaaatcctttgcaagaacaagtcaataattggcagattaggtacatgattaaccggagacaacaagatgcagttaccacttgggagccctgctgggacttcaccttctccacaatcctgtttagcaaatattaaaaatgcctatttcatcactcagaccgatggagccaggaggcaacttaaaagtatacgatgggcttacagctccagcaagttgattaaaagagattctagggattgaatggcggtaagacaggagcagatgctggtaccccctaatgctttatgctgagaggtatctatgggatgggaagtaaaattatccacacattaaactcattagccaatagggaggaacagtttaagagaccacaaattgtcccatgatcataccaaataaatgcaaatatggcagattgggcatatgtggaccaagataaaatgagttgagccaacatttctatttgtccttatcagcggaattcccctaatgacattttttaaaagcagatttatagatggtgattagtggtattagtctttgccagttcaggtttattccttttcatttcagatcctcatttgaaaatgaactctgtctttccttgtccccttctttcttgcctaagtaagcaaacctgcacatggtttcaattagatgtgggactaactgtgttcctgggatgctggggtgcctggctgtttggagctccttggctctgtcatcttgccactctctctttaccctctcagtgcccattgactagtcacataggctccactgggcctcacctttcacatggagctgaaatgtggaggcaatgccagggtttggctgtcagcttgcatagcacatcaaatcgcgctttgcagaagcccctgatacgaagtttcatttcattttggaggaagccagatctttacaggcatgtttttcagaaccttcctttccaaaggagctcgagctgtagagaacgattgtgtgaaaccaagagaaccttggtttcttctgaactggactgaaagtgcttttggaaaggactttctggacagaccccttctggttagctggtggcatcctaacaggagacaggaactgaaactgccatctgagtcagtgggcaccctcctggacagctactgagcagagcaaggagaaatctcatggcatgcttgagtctggaaagagaaccggtgtgaagggtgcacaggagggcaccatggatgttttacaagaaggacaaggcttgagttcatggaactgagagagaaggcagcaacagagaaaacaggaatgagttcagacgggcagcaccaaatcacatatttagacagaggagagtcttggaggtgctgtaattcaggagtttgcaaactttctaagcaaaggacctttatcctcaagtgaaatcttatatagaaccctgtatataaaaagacgaaagtgatagttttgttaccatagagtttacagttcaaatccatgtttagtattatcatgttaatctctgtatatgtatgtttgtgtattaataaatcacatgtataaatatatatgtgtggatatatatccagagggagagagagagactaaacccatgagagtggtcacctctaggaacagtcaagaagaataggactgggaattaggttttaggagtacttacttttatcgaaaaaaacatactaaaggaaaggcaagtcccccatcccccaatctccaacatacacacacacagactggatataattccacaaaatcttaacatttattcatttgagtggttgtaatatgggtatcttttatacttctcttaatttctgtaatctctgtgtgtttgtgtgtgtgtgtgtgtgtgtgtgtaataagtgaatctgtaacaatgttgagtctattttcagtaaaacaaagagaggatacagatgacacctgtaattccaatcactttctcaagattccatttatatactttgtgtttttgtgcaattttgagaggcacgtcccttgccttagatataaaaaaaggggatttgcacccaagctttgaaactctccttatttgaaaaaaaatcaccattatgggacatattacacattcatttggaattccactcctgattttacatcctgaatcaaacatgtgcctctgctctgcctggcatttcgttgaacagtatccatcagtgcaattgcttgtatgactttatctgagcagacacacatcggcctggattcaaagaaagcctagtacagatctttaagcttcctgataaacgacagttacagaagttcaatgtatgctcagagatgttaggaaaagctttattccaagatctttgcaaaaattaatggcttctaaaatgttcattgaagcccctctcagtaaggatgctttgtagggaagctaaagttgttctgagacaacaatattcattaatcattcatccgagctcttataaaaatgtcctgcactcagagatccctctccatttaacatgatgtctaaacccacttggaataatagccagcactatctgagggccacaatgtaacagggactgattgttccatgtgcattatcttgttttatcttcacaacaccatatgagctaggtagcattagtggcagtccccttttacagatggaagaactgagacagaggttatgggctcaaagctgggatgtgcatctagcagccagacaccttcatcttctttctctctggtgctcagtcatttctaggagcatctacagtacaacgtaaacacaatagtttacggagtaaaattacacctgctgccaaaaacaggaattttatcaagtcaaggagaatggtggtggggatcttcttgaacgtgtcagaggaaagccttggtaaatatggatctggctgagggtagcacagttaaacacggaggcagagaaaattaacaaagaaggtgataagatcggcacatcaaagagggtgattataaaaaacgtaaagagagatcctgggaaatttgatgaagatatcccatctgcttacagaaatgctctttttgattatgttgcacttgtcaaactaagtgatgctgcactgtcctgtgtgtttcattgattctaagatgcataaaatgctcctcttttgacatctctaaaaacagcatgtgttttgctatcgatgaagctgatagaacgaaatgtgtgcttacatgtttttgtgtacgtatgaaaattcagtgttcattctcacaactagagcatagttgcaaatataacctgaatttccctaaatatgatataaaataaactttttggcagggtttccttttccaagataaagttctaatcaaacatttttccattcgttaagtgtattcattataagtggcctcttacgaattccagtgattcccagataactagatcctaccatataaatcaagtcagtgtggggttgaattataatttttaaaatatctaaatacttatttagaaagtaaactttaggccagctgtggtggcacatgcctataatcctggcacttgggaaatcaaggcaggaggaacacttgagcccaggatatcaagaccgccctggacagcaaagtgagacttcatctctaccaaaaaaaaaaaaaaaaattaattatccatgtatggtggtatctgcccatagtcccagctacttgggaggctgagatgggaggattgcttgagcccaggaggtcaaggctgcagtgtgccctgattgtgccactccagcctgggcaaaagagtgagatcctgtcagaaagaaagaaagagagagagagagagagagagagagaaaaaaagaaagaagaaaaagaaaaagagaggaaggaaggaaggacgggagggaagaaagaaaggaagaagagaaaagaaaaagaaaaagaaaccactgtggaagtgctgctgttacagaaagaaggaaaggaaaggaaaggaagggaaagggaaagggaaaggaaaagagaaagagaaagaaactgctgtggaactgctgttgttccagacaggaacagctggagagcctgggcagaaggagtgtagaccagtccaaactatctgactctgaactccagcctccaatacttccaagctgtatgaccttgggcaagtcattcagcctttctgtgcctcagttacctcatctataaaccagaggtgatattatgtgctcagagcaatcaatattggatgtaaatgaaataatctttataaagcacttagattcatgctggcacatagaaatggtgtaagctattattattatggtttcaaagcattcatgacacacaaccccaaacaaacaaaacagatttcaatttttttaaagataacttttatttttgtttttctcattataaagtaagacatggtgatgataggaaaaacagaaaacattaacattttttagtatattttccagactgttttctgttcacatatagtcatcatttttataaacacaggatcataccacacacaaactatttttaccctgagtctttgcttaataatagatggaggacatctttccaagtctgaatatttttctataaactcattttaaatgcctcaaaatagtccattgtcttgaataaaatttttttcaagcaatcctcctttttcaatatgataaatcattctacagtaaacattctttcaggtctatgttcttatattttttaataatttccttgtgatgaattcttggagtggaattgccagctcaaaggatttacaatacatcaaggtgttataataacaataataaccatgagagcagctcacattaattgagtgcttactatgagccgagccgaactcacagtgcccctcaggggtggggacttttattattcccactttgggtatgagagagcagaactcagagctgaaaacttgtgcaaagttacattccagcctggtgaaaggtgcagctcatgcttcaagagaagctgcgcagtgcctgtgtttctgttcctcgttagggcttgggaagtcattttgtgactggacacacccccagtttgctccctcttcttggtgatatgtttgatatattttcacagccagcccacattgggccctcctattgatcttgggaggacaaggagccaaatgtgacatttgataaaccattgctaaagacaattagatgggaatgtgcagtaaataagaaatcacatcagcaaggcactgagaggtaaaacattcattcttctggccctatggtgcagcctttgtgcaccttggaatagccttgaaatgctcatcaatttcgctgaccttgaccccaaggctctgtgaggtcaacattatggctcgcttggtcttcagagcaataccttctacccttctcttgggttggatcaaaaggcagcatgatgagggcatgacctcgtgagaagatgaaatataaaatcaatccattcatgccctcaacaaatactcattgaatgtctgtactggggatacagtgattaaaagcatcggctctgcctttaaggagatggagacctgacaagttaagaaatgatggcaacatcaagtagggagggtcgtgagatgcagtccagagtggaggataagagctgacactctacgatcatcctggtctgggtttgaatcttatctctcctatgaagtgtttccggatgagtctctagatttagtttcaacatccagaaaatgaggactatacctcatcaggctgttgtaagaataaatgagataatgcccaggaaatggtaagcaccccatggagatgaatcaatcaatctaactggcctacaacacttatagcgcactctcaggtagcctagcaacaaggcggctctgcagggggaacagcaaggatgctggccgacaccaatactgatatgcaaactgcgcttcagctggttgtcgagactctagtatagactgcagagctcagagtcttcctcctcagtcaagtgattcctgtctcctccccatccttctatgaatatgagaggtagcagaggtttggggtgcctctccaggggacacagtgcacactgcatctacctgtgtgcagcccaagcacagctcttcatgggatgggagatttggaataacatttaccctgctagcactatgctcttgtatgtttcctggagccactaccgtatgtcatttacatgatctgttcctgtccctcacataacatgttcaacaaatatcagctattgttattactagagggttggatacaggaggcttgggagcataaaagttggccaccacttttaacctgtgagggattttagggcagcctcctggaggagaggctacacaaggtgaatctttgagggtgagttaagcaggcaaggagaaagacaagagagggcctttctaagcagagggcaaaccaagacatgccttgttgtgtgggctgtgttgaagcttcatttaacaattgaccgaaactctgctttgctttagtcactcttcgctaatggggacataccttttccttttagaacacgctccgacagagcaagagtgacctaggggggcagcccctctggaagtttaatggctgtccctgtgttgagttgttgcatatttgcagctgtgtacacaactccagctaggaacacatgttacataaaagccctcaagctatgggttacccttctaactgggaatgcacactttcacgtacctggggaaaatcttgttgaaaataacagatcgagacttacggtttctaactgtttcccctgttctcagaaatttcatgtgagaagggtcaacattccctgaaggagaccctgtgttcagacagatgcacattctgccagaggcaggccatcacgttgtattcagccaacatttactgagcacctatatgcgacatgccaaggggctgcagccagggacagggcagagctagccctgccctcatgtggctagtggacactagcaccaatgcctgtcctggaatttccagggaactcgttcacctatcaggaaatgaattgtctctgcctttgtttggcccagcctcgttactgtttctgttgggaatcccattctgaaacagctctgagaagggctgctggaatgtgccaaatattcatagtgatcatattaccttatccttccgttgagacactttacccttttctattcatttttcatttcccctacatcacccccctcccataccagagacattcaaaatatactcctttggaacttgaaaaccacaattttaggcttgatatatggagggaggaaatttggcagaacccataatctgcttatcttcaaccagcaaaccaccaaagcccctgccaaccccagagggccttcataggaaccaggaaacacaccaggcaagatgctttcctattatgacaaaaacaggctctggtctcatcttttcagcctctgaaaccctccactggcctcccgtcatgcaaagggaaaaatctgaagttgttctagaatatcagctccagaaggacagcagctgttctattctctgctgtgtctccatcactcacagctttggccgtccaccgtaggtgttcagtaaacagctgacagaagatcatctctgtggctggccagtccctctgcagtctggttaaccaccagtctcctcctcactccctggactccaccacatcagctcacttgctctccctcagccctgtcaagctcattctgcctccgaacattttgcaccggatgtcttctcttcctggaatcatcccccagatatttcaggtggctccccctgacgtttttactcctcatgcctccataagccctttcctgacaagcgaatctacaacagaatcctccttcatgctttatgctttatttttcttaaatcaacttaatttaggtataatgttaaaactacccaatgtacacttttaaaaatttatttcaacagattttggctaacaggtggtgtttggttccgtgaataagttctttagtggtgatttctgagattttggtgcacccatcacccaagcagtgtacactgtacccaatgtgtagtttttttatccctcaccccgcttccaccctttcccctgaggccccaaagtccattgtatcattcttatgcctttgtgtcctcaaagctcagctcccacttatgagtgagaacatacaatgtttggttttccattcctgagttacttcacttagaataatggtctccatttccattcaggttgctgtgaatgtcgttatttcattccttttaatgtctgagtagtattccatggtatatatataccacattttctttatccacttgttgattgatggggatttgggctggttccatatttttgcaattgctaattgtgctgctaaaacatgcaccaatgcacacattttctaagtgtccacttggatccctaaaatctgaaaactgtatccacctcagtaagcaccaccacagccataatagaggacaatgccaccacccaacagatcccctgtgccccacaccaacctcacctccaggcccaagcaaccactgatctgctttctgtcactggagattagatttgtctccactagagtttcatatgcaaggaatcacgtgctcttgtgtctgccttctttcactcgcagaatgtcagtgagattcacccatggtgttgtttgtatctgtattagtctgttctcatgctgctaataaagacatactcgagactgggtaatttataaaggaaaggaggtttaatggactcatagttccacatggctggggaggcctcacaatcatggcagaagccaaaggagaagtaaaggcacatctacatggtggcggcaggcaagagagcatttgcaagggaacttccctttataaaaccatcagatctcaggtgacctattcactatcatgagaacagcacaggaaagacccacccccatgattcaaatacctcccaccgtctccctcccacgacacatgggaattatgggagctacaattcaagatgagatttgggtgaggacacagccaaaccatatcagtttctgtggcttattccttttattagtgagtagattttcaattgtatgtatattccacaatgcgtgtgaccattcacctgttgatggacatttgggttgtctggtttgctttatttttattttattttattttattttattttattttattttattttattttattttattttattttatttttgagacagagtctcaatctgtcacccaggctggaatgcagtggtgtgatctcggctcactgcaacctctgcctcccaggttcaagcaattctcctgcctcagcctcctgcatagctgggactacaggtgcaccccaccacacccgactaattttggtatttttagcagagacggggtttcacaatgttggccaggctggtctcgaactcctgacctcgtaatccacccacctcggcttcccaaagtgctgggattaccggcgtgagccactacacctggctggtttgctttattttttactcacagctctcctccctccctgacattatattcccccttgaaaatgtcagctccaggaggacaggaaccttgtctgtatcattcactgctgtatccccagtacacagagcagtgccaggcacatggtggttgctcaatatttgttgaaggaacaaatagttttacattcatttgcccttgcaacataacaagcttgagagccatgcttcagatttttctatgaactccaatttagggacccttaggccttctaagtgaaaccagatgttggctggggctcccctgcccatcagagactgggctgaggttgactgtaccctgtggtcctgtgaatacacacacacgtgcaaatgagagaggcgggccagcaccccctactggctgcctgttcattaggcttattgagaagactaatacactggattaagagtgtcctctttgaagctggctgcttgggtgtgaatctcagccccaccacttactaactgttgggtgagctatgtaacctctctgtgtctcagtttcctcatatgcaaaacaggaataatttgtattcagtagggttattatgagcatgaatcacttagagcgtgcctggcctcattaaatgttaactcatagtagcatctgagcagttagcaagcaaaaataagagaaaactacagtgttcactaaaatttccaaaaggcatttcctgaagagattatgtcctttaagtagctgtgtcaccttgtaggtatacccctcactctagatattatttccttttggcctaaatctttttcattcatgcaataaagatctttagtgagtacccactatgggccaagcactgttctaggcatgggggatgctgagttcagtgaaacagacaagtctcccactctttttttttttaattatactttaaattctagggtacatgtgcacaaagtgcaggtttgttacataagtatacatgtgccatgttggtgtgctgcacccattaactagtcatttacattaggtatctctcctaatgctatccctccctgctacccccaccccatgacaggccccggtatgtgatgttccccaccctgtgtccaagtgttctcattgttcaattcccatctatgagtgagaacatatggtgtttggttttctgtccttgcgatagtttgctcagaatgatggtttccagcttcatccatgtccctacaaaggacatgaactcatcattttttatggctgcatagtattccatggtgtatatgtgccatattttcttaaaccagtctatcattgatggacatttggcttggttgcaagtctttgctattgtgaatagtgctgcagtagtcatacatgtgcatgtgtctttatagcagcatgatttataatcctttgggtatatacccagtaacaggatggctggcacaaatggtatttctagttctagatccttgaggaattgccacactgtcttccacaatggttgaactagtttacgctcccacaaacagcgtaaaaatgttcctatttctccacagcctctccagcacccgttgtttcctgattttttaatgatcgccattctaactggtatgagatggtatctcattgtggttttgatttgcatttctctgatggccagtgatgatgagcattttttcatgtgtctgttggctgcataaatgtcttcttttgagaagtgtctgttcatatcctttgcccactttttgatggggttgtttgatttttttcttgtacatttgtttaagttccttgtagattctggatattagccctttttcagatgggtagactgtaaaaattttctcccattctgtaggttgccagttcactctgatggtagtttcttttgctgtgcagaagctctttaatttaattagatcccatttgtcaattttggcttttgttgccattgtttttggtgtttcagtcgtgaagcccttgcccatgcctatggcctgaatggtattgcctaggttttcttctagggtttttatggttttaggtctaatatttaagtctttaatccattttgaattaatttttttataaggtgtaaggaagggatccagtttcagctttctacttatggctagccagttttcccagcaccatttattaaatagggaatcctttccccatttcttgtttttgtcaggtttgtcaaagatcagatggttgtagatgtgtggtattatttctgagggctctattctgttccattgatctatatctctgttttggtaccagtaccatgctgttttgattactgtagccttgtagtatagtttgaagtcaggtagcatgatgcctccagttttgttcttttggtttaggattgtcttggcaatgtgggctcttttttggttccatatgaactttaaagtagttttttccaattctatgaggaaagtcattggtagcttgatgggaatggcattgaatctataaattaccttcagcagtatggccattttcacaatattgattcttcctatccatgagcatggaatgttcttccatttgtttgtgtcctcttttattttgttgagcagtggtttgtagttctccttgaagaggtccttcacatcccttgtaagttggattcctaggtattttattctctttgaagcaattgtgaatgggagttcactcatgatttggctctctgtttgtctgttattggtgtataggaattcttgtgatttttgcacattgattttgtatcctgagactttgctgaagttgcttatcagcttaaggagattttgggctgagacaatggggttttctaaatatacaatcatgtcatctgcaaacagggacaatttgacttcctcttttcctaattgaatgccctttatttccttctcctgcctgattgccctggccagaacttccaacactatgttgaataggagtggtgagagagggcatccctgtcgtgtgccagttttcagaggaatgcttccagtttttgcccattcagtatgatattggctgtgggtttgtcataaatagctcttattattttgagatacatcccatcaatacctagtttattgagagtttttagcatgaagggctgttgaattttgtcaaaggccttttctgcatctattgagataatcatgtggtttttgtctttggttctgtttatgtgatggattgcatttattgatttgcatatgttgaaccagccttgcatcccagggatgaagcccacttgatcatagtggataagctttttgatgtgctgctggattcggtttgccagtattttattgaggatttttgtatcagtgttcatcagggatgttggtctaaaattctctttttttgttgtgtctctgccaggctttggtatcaggatgatcctggccccataaaatgagttagggaggattccctctttttctattaattggaatagtttcagaaggaatggcaccagctcctctttgtacctctgttagaatttggctgtgaatctatctggtcctagactttttttggttggtaagctattaattattgcctcaatttcagagcctgttattgttctattcagggaatcaacttcttcctggtttagtcttgggagggtgtgtgtgtcgaggaatttatccatttcttctagattttctagtttatttgcgtagaggtgtttatagtattctctgatggtagtttgtatttctgtgggatcgatggtgatatcccctttatcattttgtattgcatctatttgattcttctctcttttcttctttattagtcttgctagtggtctatcaattttgttgatcttttcaaaaaaccagctcctggattcactgattttttgaaggattttttgtgtgtctatctccttcagttctgctctgatcttagttatttcttgcctcctgctagcttttgaatgtgtttgctcttgcttctctagttcttttaattgtgatgttagggcgtcaattttagatttttcctgctttctcttgtgggcatttagtgctataaatttccctctacacacggttttaagtgtgtcccagagattctggtatgttgtgtctttgttctcgttggtttcaaagaacatctttatttctgccttcatttcgttatgtacccagtagtcattcaggagcaggttgttcagtttccatgtagttgagcgattctgagtgagtttcttaatcctgaattctagtttgattgcactgtggtctgagaaatagtttgttatcatttctgttcttttacatttgctgaggagtgctttaattccaactatgcggtcaattttggaataagtgtgatgtgatgctgagaagaatgtatattttgttgatttgggatggagagttctgtagatgtctattaggtctacttggtgcagagctgagttcaattcctggatatccttgttaactttctgtcttgttgatccgtctaatgttgacagtggggtgttaaagtctcccattattattgtgtgggagtctaagtctctttgtaggtccctaagcacttgcattatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgctatttttttgttttccattttcttggtagatcttcctccctccctttattttgagcctgtgtgtgtctctgcatgtgggatgggtctcctgaatacagcacactgatgggtcttgactctatccaattagccagtctgtgtcttttaattggagcatttagcccatttacatttaagtttaatattgttatgtgtgaatttgatcctgtcattatgatgttaggtggttattttgctcattaattgatgtgatttcttcctagcatcgatggtgtttacaatttggcatgtttttgcagtggcttgtactggttgttcctttccatgtttagtgcttccttcaggagctcttgtaaggcaggcctggtggtgacaaaatctctcagcatttgcttgtctgtaaaggattttatttcttcttcacttatgaagcttagtttggctggatatgaaattctgggttgaaaattcttttctttaagaatgttgaatattggcccccactctcttctggcttgtagagtttctgccgagagatccactgttagtctgatgggcttctctttgtgggtaaccagacctttctctctggctgcccttaatattttttctttcatttcaactttggtgaatctgacaattatgtgtcttggagttgctcttctggaggagtatctttgtggcattctcttcatttcctgaatttgaatgttggcctgccttgctaggttgggaaagttctcctggataatatcctgcagagtgttttccaacttggttccattctgcctgtcactttcaggcacaccaatcagacgtagatttggtcttttcacatagtcccatatttcttggaggctttgtttgtttctttttactcttttttctctaaacttctcttctcgcttcatttcattcatttgatcttaaatcactgatactcttttttccacttgatcgaatcagctactgaagcttgtgcatgcgtcacgtagttctcgtgccatggtttcagctccatcaggttatttaaggtcttctctatgctgtttattctagttagccattcgtctaatcttttttcaaggtttttagcttctttgcgatgggttcgaacatcctcctttaggtctgagaagtttgttattaccgatcatctgaagccttcttctctcaacccgtcaaagccattctccgtccagctttgttgcgttgctggcaaggagctgcgttcctttggagaagaagtggcactctgatttttagaattttcagcttttctgttctggtttctccccatctttgtggtttttggtctttgatgatggtgacatgcagatggggttttggtgtggatgtcctttctgtttgttagttttccttctttctgtttgttagttttccctctaacagtcaggaccctcagctgcaggtctgttggagtttgctggagatccactccagaccctgtttgcctgggtatcaccagcggaggctgcagaacagcaaatattgaagaacaacaaatgttgctgcctgatccttcctctggaagcttcgtctcagatgggcatctggctgtatgaggtgtcagtcggcccctactgggaggtgtctcccagttagtctactagggggtcagggacccacttgaggaggcagtctgtctgttctcagatctcaaactccatgctgggagaagcactactctcttcatagctgtcagacagggatgtttaagtctgcagaagtttctactgccttttgttcagctatgccctgcccccgaggtggagtctacagaggcaggaaggcctccttgagctgcagtgggctccacccagttcgagcttcccggccactttgtttacctgctcaagcctcagcaatggtggatgcccctcccccagcctcgctgccaccttgctgttggatatcagactgctgtgccagcaataaccgaggatccgttggtgtgggaccctctgagccatgtgcaggatataatctcctggtgtgccgtttgctaagaccattggaaaagcgcagtattagggtgggagtgtcctgattttccaggtaccatctgtcatggcttcccttggctaggaaagggaattccctgaccccttgcacttcccagatgaggtgatgcccaccctgctttggcgtacactctgtgggctgcacccactgtctgacaagccccagtgagatgaacccggtacctcagttggaaatgcagaaatcacccgtcttctgcaatgctcacactgggagctgtagactggagctcttcctatttggccatcttggaactccagtgacaagtctcccactcttaagtgttggagaaagttcatatccaaaagggggaagattaattctaaattagtaaatcagtagcaagtttttttttcaaagaatcatgagtttttgctgaggttggaaacaagaagaagtaatagacgttttttaaaaaaataatttcagctttttttttagactcagaggtacatgagcaagtttgttacctgggtatgttgcatgatgctaaggtttggtctacaaatgaccccatctctcaggtagtgagcctagcacccagtggttaaccaacagtaaaaatcccagtagttttttaacccttgccccctccctctccgccctctctaatagtccccagtgtctattgttccatctttatttccgtgcatacccaatgcttagctcccacttataagtgagaacatgtagtgtttggtcttctgttcctatatttatttccttagaatgatggcctccagctacatccatattgctgaaaaaaatatgatttcattctttatgactgcatagtattccgtggtgtatatgtaccacattttctttttccactcttggtaggcacctaggttgatcccatctttactattgtgaatagtgctgcaatgaacatatgagtgcatgtgtcattttggtagaaggatttgttttcttttggatatatatccagtaacaggattactgagttgaatggtagttctgttttaagttacttgagaaatttccaaactgttttccacagtggctgaattaattcacattcccatcaacagtgtgtaagtgttcacttttcttcacagccatgccagcatgttgtttttgactttttaatggtagacattttgacttgtgtgagatagtatctcattgtggttttgatttacattttgatagaggtatttcagttgggtagtcagggaagccctctcttaggtcatgatatttatgcaaaggcaggattaacaagaagcaagcagctgtgagatcaggagaaagaataggccaggcagagggaaaggctggtgcaaaggccctatggctgggatgagcttggcatcttccaggaacagagagaagagcagtatggctggaaaacatacaggtagagtggcgtttagggaattgggaaggggccagctcccaaagccacttacagaccaagtacagccaacacccagcaaagccatccagacctttccaggcacccttttttctctgccccagtgtgatgtctccctgtcctcaggccagcctgctctgcccaggtctgaccctagcactgctaagttcttccttcctccttcttatccgctcagtggcattgtgaggggccttaacaaaccaggccagccaccagatatgctggcagctacaactaggttcttggaaaagatggatgtgtcccccaaaattgttaaaactcatgcaaatccaacttcaaatccttgcttggccaccaaccaagctcaatggcactggatccattccttaacttctctagaaaccactgttctcttctgagatgagactagggttttggggaggatgaaatgtgataacacacatcagcatttgctattatgcctggcatgtagcaagtgcccaggcaaaaataggctcttattttttattacttttgctgctgctgcaagaggacatgtaatgaaagaatcaagaattccacccttgtaagataaattctccccagctgctgatttcagggaaccctgtttgtttcctctgtagcttccatctgcttgattcttgcctgtggagcctggcatgatgagctgctacagtctggaaatgcagatgctgtttcctgtccggaagctcaggggctggttcttatagtggcccgagcagtggtgcctgcagctgggccgattgcatttagttaagtgactcagatactgtaagtaggaactgagcagggagtcctgaaaaagacaggcaaggccacactcagggaagccagcccccactggagctgtcattcctcccccttccctgagcactcagcccctttgaaggagagcaaagaaattgtgctgagctttaatgaggaatcagctgggcgcactttgccacaggcctggctggaggcagaaagaaatgaacaggcccccaggagtgagcgacccactgcagctaagtcattcccaccatctctggatgtgaccagagaccctgtggtcatgtggcttcaagcagccctagctcacatgtgccacttccctgcaatcccaccaactgctgagcgtgccctgccatctgaggtagaatcaacatcagacatcgtcaggaggccagcaatgctgccagtgcagagtgaggggagtggcaggcttccccgggaaatgtcagcatttattgcttttcccattcgtgttgaccctcagcaagaaaatgttccaaatagcatgaagtcatcccccctttttggggggtcctggacccagtaataacatcttcccgaagggcaatgagtctgtctttaaccttgccctctctggcaggtgtgtatcaatgtggtttctagaagcatctctgggctgcccggtccctgcctgtggccaccttcccttctgggaaagtaacagcccccgctccacggtctaggctctgctgctctcctcccgctcctctggaaacccactaagttatcttaattaccattcctcctcagtctctgccaagaagtggggagatttataattggatcagtcaaatatttgctatggtttatttctttgcctctcgagctctcgtaaaagttgcattttcatgccactttggggtatgactgatgactcaaaggcacagccttcacattgcatgccaacgtgggttatttttcagaggccagggaaaaggagagaactgggcggggagaggtggtgtttactttgggttattgtgctatcatcctctgggtggctgcaagagacacaagcggctttgggaggcaaacttcctcccgcagccagccggtgcacagacacatccttctattgggatttggtcatgtgcctcctaaaccccttccagagcttctgcagacctaatgggtaggaccactacagagtaacctctttagtcaacgaggcacagtttggtctcccaaagcatccccatgtcccgaattgatcacagtgaggtcctagaacagaggagccagatgtccccaatactaagcctgagttatcaattcccagtgttgagggatgaaaaggaaactctggccagggcctgagcttttggaaaatgctctccttctagtgtcagccagtctgccaagcaagctggccaggctacagcttaggaaccctagagagcagaggctcccctacaccagatggcctccttgcaagccagcttctcactggcccccagtctccctatcctggaaggcagtctccatggctggctcagtttatcctccctgcatttctagcctctagcccttgcccaagttatagcagcagtgaatgatgctgtgtgatgctgcttgacacgtgttaatctatgcatagtgaccctatgtgcactctagagcactttgagatagaaaggaggaacaagaggtataaactgggacactcctgggtaattgtgataaacaaacaccctacacataatagagtggaatttgaccaacagaagatgctaccatcttttcctgggtgatcctgtcctgttgtcctataagaaattatcttgaccgggcacggtggctcacgcctatagttccagcacttcaggaggccaaggcgggcggatcacgaggtcaggagttcgagaccagtctggccaacatagtgaaatcccatctctgctaaagatacaaaaaattacccgggtgtggtagcaggtgcctgtaatcccagctactcgggaggctgaggctggagaattgcttgaacccgagaggtggaggtttcagtgagccaagatcaagccattgcattccagcctgggtgacagagcgagactccatctcaaaaaaaaaaaaaagaaagaaagaaatgatcttgaggaccatttggcctgacctgggaaggaagaagggcagtagttctgaagtccttactcttcaccaccctaccctgcagatgaaacccctgtcttcctggagtttatgttcttagtagaaagacaacacacataaaaataaattatatcattttagggggtaataagtgctttgaagataataaagcacaataaagggctacaggattgagacacatcagacaccatatcatatcagagtcaagatcttctcccagagcccctggctagccgattcttccttaaatgaaaactgccctctgtgcttctgtgcagggggactctgaggagccagccaaaatagatgtcttctctttcccctgaaaaatgcctcttcttagagtaatttactgggctggacggtgagcactgccactagtcctaagccatttctgtttcccttggctggtcaggcggttcggcaagagatgactgatgcccaaattagtaatgagcaatggccccacacaagtaatcaccttccccaaactcttcctcatggggatgattacttggacccgaaatgaagtagatccttctcacctcggcaccaaggaagttacagccattcctctggctgacagcaatttgtagacatgggtctttgcagttggacattttcgaggttgctaaggaacaaatgctttgattagaaaggtctccaaaagcagcatcagtttgtcatatcactttaaatcatttattttatcccacaaagacagctgtgaccaatgggatatggggtagagagaagctaaacactcatttccttgagaaatggagaaaatttcaacttctaagcagcggccgtcaccagcgccccacgtgtgaaactagaaccacgcactgctcgtccgtaatcattatgatttgcaagtaggtgactcatagtccctaggtacttaataaaatggttgttatcttcctggccctgccctaagcattatctcatgtcatccttataacctccctgaatgttaggtgtgattattccctggtatgaaaaccaagaagaaggtaaaagtagatttgcccaacatcaaagaacagtaagtgacagagtcagaattcaaacccaggtttgtctgatggcaaagcctttgtgtttaagattatagagtcttttgttttcagtgatcacatttcaggtggaaaaactagcgattctgacgacgggaaaggcacattaggagattcctggagtttcattctgtgaagttcgtaaaaggggttatagttgatgtctgtaacccataaaaacctttttatggaagggaaagtggagagattgcttaatcctacagtggtggttttcatcggctaaaacctacactttgaatgttctctggaagtcagcatgcaagtgacttttctatgcagtgattttgcaagagttcacaagattagtccagttctactggggttttatcgattttcttgtcaacaagtaagaaacactggtgtcctctttgccttctccttcatcatctctgtccagcccatggtcaagccctgtcacctcttccttagaaatgttcctccaaagttgtcccccgcttctcattcactgtcctgatcaaacccttttcacctcacccctgggtttctgcaatcacttcctaattggtcctcctactttcattttttctccctttagaatatctcatatccttcctacaaactaattccttaaaacatccctttcatcacatcagtcactgctcaagagtcttcaatagctcccacttgcctgctacagcatttcatctattatttagaacaggcctctcttgggtcccgtttgacctccccatccccttatcctggtaggcttagttgaccactctgtctctcattaatcacttccatttctgaacctggtttccactgaaacaaagttaaactttaattgctggtttatccaaggctaggcactataagggcatgaacataaacaccaagccaatctatgtctaaatttttgcttggccacttaggagctgtgtgactttagaaaagttgcttgacttctctgagcctcagctttcttatctgtaaaatatgaatgtaaataacaccaagataggtaccaaatcagggtttcttcaagaattgaataaaatgataataacgatcatgacggctaacatgtattttgtgtttgctgggtgccaggcactgtctaaatattatctgaatcctcacaacaaccccataacatagatactcttattttcagtttgccaatgggaaaaccaaggcacagacaggagaagctagtaagcacctcattcaggattttctcaggctccatagccctcatcatagcccttctgctgtgccatttctcctagtaaatgatcaataaaatggtagctggtaacatgggttcataattccttatctgaaactctcaggaaaccaattacattttggaattcagaatttggaggattatggaaaagttatactttgcatatcctctgtattacataatgcagagggggactggagcaacagcatataccactccccccaccacacacacacacacacacacacacacacacacacacacacacacgatgcacacatacaaacaaaaagaaaaaaactttgggttaaagctctttggatttcaggataacagacaagagattgtggcctagagtaataaaagtattaatagtagcaataattataaagcataataaataatgactgttattattgttacacattttgcggctcttgttttcctggataagttcatagcaaaatgtgctacaaaaaaggtctttctccattaacaaatgggttcggggggaaggtaccaggtatgggaccacatccacaccttgtctcatgcatggtactctctctccttttcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctaggtaggtgtggggtctctgagatggtacgccatgaagggaagatggaaatgttctgggcttctctgcagaagacacatcttctaaggtagtttctactacagatgacaaccaaccaggatcctttgtttaggccttatagtgtcacccacctgaaactagctctgattaaatggaaatgctgcttaaaccatgaaaaattcaccaaggatgaaattgaggttaagagtttgggtcagactgcctgggttgagtcctgaccacactacctaagcaaatcacttgactttgataagcctcagtttcctcatagtaaaataggaactaacgtgaatgcccacctcatagggccattgtggggattaaataaaacaaatatataaatctctaagcatatagtagagaaactactggcgattcacatcagctcagaatttttcttaaaaattaagggaacctcaaaatactaataaaaagtgatttttaaaaaaactttaaatcagagaaattatatagacatttaaaaatcatgtttttattcttgagtaggtaaatctcaaagtgttttaattaagtacttatcattttggcatagggtagccctgctttctattagctatcaagagaaaagcgaagtttcaaccaaaatgtccttatacatgcaatacaaagctctaaaagggtcattcacttgaggaagatttcataaagtttttctaccacaaaccttaagtatgttaacaagcaaagaagctgcagatattttcattaaagttatgttattgggatttttaatcttctcctgacaataataattgatcctgggtagaacctctgtgaatcagggaagattattagacccatttcacagaagaataaattgagattcagaaagctgaatctctcgaagacccaggttgtggaaacagtggaaatggcatgggcttctgggtcttgtccactgcccttgtacaacaccatgtgtcccaaaaacttttagctgtagatctcaagattcactggggaagcccccacagggtggcttcttgaagaaagacctggtagctccagcattaaatccaagattttcttccccacatcttaactgggcaattcacttatctctctgagcctcagtttcatcagctgtgaaaaggtaatgaccacgtccaggaagtagagggtgatgtgagtatcatgacaaataaaacgtgtgtggcatgtgttggtggtcactaagtgacatccgattattttttttccttaggaatatgtctagtatcgctctttttctattgattacattttaagaacttttctattggtcccatggattttcctgaggggctccctgactcttcaaagagctatgtaatccaacctgaaattcaggtggcaattcttcatcagtggccacaacttcagaaaggtgtaaaatcatatagagttttggtactgaccatgggattcaagtcaatccttattccttctgctaagcaaagactgaccctatcaaagctggccaaatggtccaaagcaggagttggctccactgtagcccatgggcctaatctggcccactgcctgtttttatgaataaagttttattggagcagccccatacatctgtttacatattgtctatggcagctttcccactgtcatggcagagttgagtcattgcagcagagaccatatggcccacaaagcctaaatccttactctctgtccctttacagacaaagtttgccaacccctactctaaagtcatgtcataaactttgtataatgaaagtcagtggagaagcgttccacagagggaaaatacccagaattaggttaggtaccaacggggaagaaaagtaatagggtagagactagctcacaaaaggaaaaaactagaaacaaatttggaaccagcttgagatgttgagatttttaaaaatctttagtttaagaacatgatgagaaacgacttcctttgtgtcactctgtgtttgaactcaagaggcttgacacgtacgtgacagcacacaccctgcacagcagctggctcagctggggtctacaagaattcagagaagtggttcataacaacaagaacagctatgcatttatagagcatcaacggtatgctagccccagtattatgccttcgtgtctgttgcttcctcaacccatggagtagccacatgaggtagcactatcacaattctctgcattttccaactgaggaagccaagactaaatgcagttaaaaaacttgcccaaggtcacacacagccaggaaaaggtgaaatcaggattcatactttccagagcctgtgcttttaaccactggatttctttggattctagccaactaaatccttttccctctaaacttagcaccttttctggggttcggattatttcccaacaacttctgtcctccttttcctttatccacatggacacaggcattgtggtagtgaaattcccttcccccaggccatcactcaccctggcctgttggagctgggaatagcaattctcccaagaggatctctcttgtctggactgtagctcaaagagcaagtcaaaggtaattggcctaatagttgggcagacatcttgatggagcaatgatagtaattggcctgaaatgcagggaaaagaacagtgttttatttggttcagaggttctcccacacattcctatcatcagaacattctccatcaagagcagccaggagtgctgtaaacccccgtgatgtgaaacagaaggaaaatgttagacaggtgcctaccagcgatcacactaaatatatctttgactcagggaagtcttttgatgtgttttggagagaagcagcctgctttcagaaacaagtttcttctcgagacaacagagcagctttctggaagcacgatgccagcctccacttggataaaatcccatttcctgggcttgatctcacatctggaggccacttcttcctcaagaaaatgtaaacaaaaaggaaaactgataatatcttaaaaataatatttaactgagtgctggagaaaggggattgaaatgtgagctcctttatattttagctttgccacgtcattgtttttccctcagaaactgtgaaaatactttaaatatgagttgttgggaaagttaaatgaaaaatactctttattataatttttgtttattttggattctcctaccctcccacacatgcacacacacagacacacatacacatagacatacacatacacacaggcacacacacacataagcacacttcagcaactatttaccaaggacctattgtataccaagcattgagaatacctcgatgaacagttcagatcgagagcttggtgagagaagatagatgtatataagaattacaggagcaaagaggaagtggtacaaagcccagattgaggaaagtgaggaaaacacccaggagctgagacacaatggtaaatacctcaagtgaagccctccagccaagcaaagagactgtgcaaagatctcgggccttttccatgggactgtggtggcaaagagcttcctggacctttgctgcttgatcgccaaagatgtaagttttgagaacagggagccttgacctcaagaatgtcaatttccaccaaaccatccccagacccagatgctcagtgagaagcaatctctacctagctgtaggaatgacttcaaaaaatgcaagctggagaatgatgttcctctgtttaaatgtttcatttgtacccagaagttccagaatagaacccaagtcatccacatgttctacagcaggggtcctcaaccctagggccgcagatcagtattcaccataatgtcaaatcagtggaagccctcagcttgttttcctgcaactagatgatcccatctgggggtcatgggggacagtaatagatcatcaggcattagattctcataaggagcatgcaacccagatccctccatgtgcagatcacaatgaggtctgtggcccattaggaactgggccgcagagcaagagatgagcagtaggtgagcaagtgaagctttatctttatttacagttgctcttcattgcttgcattactgactgagctccgccccctgtcagatcagcagcagcattagattatcataggagggcaaaccctattgtgaactgtgcatgcgagggatctaggttgtatgctccttgtgagaatctaacgcctgatgatctgtcactgtctcccatcacccctagatgggaccatctagttgcagaaaaacaagctcagggcgcccactgatttgacattatggtgagttgtatagttatttcattatatgttacaatgtaataataatagaaataaaatgcacagtaaatgtgtgtgcttgaatcattccgaaaccatccccaagccccagtctgtagaacaattgtcttccatggaaccagtccctggtggcaaaaaggttggggaccgctggtctacatgtccctggatgatccatctctctgcctggatctctccaaactcaactaatgtcacaccctcccttgtttgctaccctgcatccacattggattcagttcctctctttcccaccccagagcctttgcataagctattcctctgacctggaatacccttccctcagctctttgcttgctggtttcagcttatccttcagagtcacctgcatagagtagagaggccctccctgaacattctctttaagtagcttcctttcgttactccatctcagtatcttattctgttcaaagcacttattgtaatttttgcttatttaatttgtttgtttttttagcttgtattctctattattgtgcaaagctttatgagggctttgcatatgaggggactatatctgtctttgtcaccatggtatctccaatgccttgttatatagtgttttgcatataataagtgctcagttagtagactgaatcatatgtaagaatgtgacagatctgagatcttaccctaattgcaagctagcatgttagcctgacacagtttcatggatgccatcagaagacatgagactcatgggtcagagacaagggactttattactcagagcaatgcaatatccagagtgtcagcacatgttctgttccccaagccccagttccctcagagtaacacctcagggcctccctcaggtcgggtgatgccagtgcatatgtcatgggttgcactgcaggagaaaaatcctgagcttactgaacccgagcctcttagaatgggaagtaagcttgcttattctttgttccagagggagatattgtctttactatactgggtaataagtaaacctgccctttactcaggagagagacactatcgctgtctcccaaggctgttcccaatacagacagccttgaaaagatagttcagaactaaggcagtcaatgcctgtgctctcaagacattcagaaacatgacagacccagggagaatgatctcccagcaccgtgtgaaattgctgatttgctgatctacaaaagcacctaacgctttttgaatgagtgatgaattcaaaaaataaatgaataaatgaaacaaacaggtagccacctggatgcttctcagccgacatttacacagccaacctcaaggagtttcagtctgaaatgttaattgttgttacacattaaggaaactggcttgatggggcctatggtcttttgtctgattttgaaaaagcaaatatactcattgagttttcctcagagtgccagaaaccaactacagtgtggttctggaagatgagagctgagaaaggaaacactgtagaaagaaaacaaaactgtgtgattcgaagtttcaatccagagtgggagtaaatgggaaatcaggtttaaaggcaacacatcctttatcactctcaggtacctccattaggaacaattagacttcacagcctttcataccatgtcaccaggtcaaagtccccaactctccaagggtgatataacatcacattttgagaatagtggcttatactttccttttcatcttagtaatttggaacctgaaagtctaaatgtattttgttttaagacaaaaattaggattatggtaataatttttaaagaatatgactatttctgtgcagacccaaatcaacattaaatagttccaaaatcattcctttgaaggtattacttgagagtacacatagaaaggtaaatcacaagataagacggtgatgcaggttagagccaaatgtgaactaattcattttcatgaaaaataacatccttaaaagctaagcataaaaggacatttgtataaccgcaaacctcctatttaaagaattccaaaatcctgcctaatttaagcagtctatgcatttgggtttttcttttattagaattccttaaagcaaggaatatttttactctacaaatctgaggttaggaataactactcctattttgaagaatcactctctatacctaaggctaaaaactgataccctgcacatcagaccaaatcttaactgagtgggatgatgaaggttggggggtggttgtgggtacagtgtttaaaaacttgtcaacatttaaacgtgggagctttcatagtttttaaatccagactgatagtttattttttctattgttttgttttgtttgtttgttttgtttttgaaattgagtctcgctctgtcacccaggctggagtgcaatggcgcaatctcagctcactgcaacctctgcctcctgggttcaagctattttcctgcctcagcctcccaagtaactgggattacaggcatgcatcaccacgtccagctaattgtgtgtgtgcgtgtgtgtgtgtgtgtgtgtgtatttttagtagtgatgggtttttaccatgttggccaggctagtctcagactcctgacctcatgtgatccacttgcctcagcctcccaaagtgctgagattacagctgtgagccactgtgattgatgagactggtagtttattcttaaaaagtgaaagttacagcactactagccctgcattcctgcctggggccatcacctggagagcactgttcaagctgtcccagtccccaccactccctattctcttccttcactcattcatattgctgaccgatcccctatgacaggcatctgagattactaccactggtctttaaaagtggcaagttactgacggttaaattactgcaccagtagacagaggaaaaggtaaacactacatttatctctttttcagattcagtgcaggactgtccacgtaactgccatgggaatggtgaatgtgtgtccggggtgtgtcactgtttcccaggatttctaggagcagactgtgctaaaggtatgtgccgccacttccctgctatggttggaaaacagaccctccctaggcttctctgagcgggtaacagaagggacatccaagtagccttcccatcaaatcccccgagacatcttgcaagcccatgcatgccagaaggcataagccttcgtaaagagtaggctttgatttatgaccattggccaacgtacctataggagcagggcagttatccttggcactgaggtgtgctgagaagaaagatgtgctaaaaatgagatggtcggatttcctgtaaaagcagaagtgaattaccatcactcctttcttataatcattaacttctatgtaatggaagattaagcatctcagggttagtaaatttcattcattctggccagctacactcttaatctaggaagcgctatttatcttggtggaatcggttttaaattgtattattaatttatctacactgctgtgcacagaatagctggagccctgagattcttgggggaaaggtaatataagaaagaaaatgcttctcacaagaacagagaatttagaggctgcacaccttgcttgcaaaacaccttcagtgtgaccttcaaatggctctatcagaggcaggtatagtgaagagcagagcgtctcacacttttacccacaggcacacacacagacacagacacagatacacagacacatagacacacaagggtatatgtctaaatacaagtaggaaattgaaacaaaactcacaaaatgatattttactccatgtttcttttctatttcattttttattttattttatttttttgagacagagtctcactgtcgcccaaactggaatgcagcggcacgatcttggctcactgcaatctccctgtcctggtttcaagcaattatcctacctcagcctcccaagtagctggaattacaggcatgtgccaccacacccggctaatttttgtatttttagtaaagacagggtttcactatgttggccaggctggtctcgaactcctgacctcaagtcatccgcccaccttatcctcccaaagtgctaggattacaggcatgagccactgtgcccggcctcgtttttttttaataccagttattacccattacactgattttccacccaccaataggccatatcacagtttgaaaaatagtgaaggggcagttgagtgcacttgctgcagagtcaggcaatcctgagttccaatcccagctctgccattgggtatctgacattaagtgactgatttaacatttctgaaccttggtttcctcatctggaaaagtggggagttacttcctaggtttattgtgaggatagtgtaagataacacacacaaagctcttagcagggcacaataaggcctcaaagggcttgactttcttatttaattatgcatacgattttatttatttatatgtttaactaatcttcccgttattttcatgtgtgctttattaaaagaccttcctgccttgactttctgcaagacaatcattaataaagctgctctgtaaatactaaatagtgcctctcctttcccaccctcaccgcaattgctctgaaaaatactatttcaaatagtctcaatatttcaaagatgtgagggttccaggcttacgaatgctgataagtgaagggggctttctgtacttaaagttctgggtctgatggcacgtgcgtgagacttaattcctaaatgacaccgcttacaggcatctcttctgtcacacagtatggtgaaagcttcgataaacttaaaaagaaggcaaggtttgtagttctccttgaagaggtccttcacatcccttgtaagttggattcctaggtattttattctcttcgtagcaattgtgaatgggagttcactcatgatttggctctctgtttgtctattgttggtatataggaatgcttgtgatttttgcacattgattttgtatcctgagactttgctgaagttgcttatcaggttaaggagattttgggctgagacgatggggttttccaaatatacaatcacgtcatctgcaaaccacaatgagataccgtctcatgccagttagaatggtgatcattaaaaagtcaggaaacaacagatgctggagaggatctggagaaataggaatgcctttacactgttggtgggagtataaattagttcaaccattgtggaagatagtgtggcgattcctcaaggatctagaaccagaaataccatttgccccagcaatcccattactgggtatatacccaaaggattataaatcattctactataaagacatatgcacacgtatgttttattgcagcactattcacaatagcaaagacttggaaccaacccaaatgcccatcaataatagactggataaagtaaatgtggcacatatacaccacgaaatactatgcagccataaaaaaggatgagttcatatcctttgcagggacatggatgaagctggaaaccattattctcaacaaactaacacaggaacagaaaaccaaacactgcatgttctcactcataagtgagagttgaacaatgagaacacatggacacagggaggggaacatcacacagtgaggcctgtcagggggttgggggctaggggagagatagcattagaagaaatacctaatgtagatgatgggttgatgggtgcagcaaactattatgggtgcagcaaaccagatgacaggttgatgggtgcagcaaaccatatgtatacctatgtaacaaacctgcacattctgcacatgtattccaaaacttcaagtataattaaaaaaaaaaaaaaaaagacaagatgctgcccgacagctctcagggctctgtgtcaggccagaagccacccgacagctctctgggctgtgccaggcttagtgcactctgtcaatggcagggggcacatcagcaaagtgaactgtggagactggacctcctcctagcgcctccctcaggctctgagggtcactgatggagcaaggagaacagagaacagcttttcctagcggaggctttaaaggaaggaaaatctcagtgtcatttgaatggctttccttgcataatctaattttcctgggagtgaagacattaatgagaagaaggacagagtcggccttttatatgtggctgcaaatgggctgaaccctcagccgcacggcccgtgagctgtaaatgtatattaacactgacacacatcgatgtattattaatcctaaaaaccatgtgtgctccgactgcacatccagtgactggccttttaaacctaagtaccccggccgtttaagaaccctttgctctaaatccatttgcagatgaacgtccattctacattatggatctgtaatggggtgtccatttagctgcttaaaaggactctcggtgtgtgttttgcattcaccacctgcagtgtggcagggcgcacactgcaagtgtgcattagccatggtatataattgatccttgtgaaacaaatattgagtggatgttaagagtagttattcctccatactcagtcgctgctcctgaaatcgggctttgaacttgtatactttaatttagctgttgcacacagtggacaaaattgaagtgtttaaagaataaaattgcttttccccgatttctccatttattctgggtgaagttggttgaagagtgttaggagtaggattctaccttttagccctatagatgtttttcccttagtatttttttaaatggccacagtttaagctacttcattgttaacagagtgaaatttcccctcattctaaagccttctttcccagtctttgatctttcatgtaccacctttattatttctggcaatttcatgggacagaagtattattaattacttaacatgtttcttcaagtcaattcattatagttccatagtttttttgtttttgtgtgtgtgtgtgtgcgttttgttgttgttttttttgagatagaattttgcttttgttgcccaggctggagtgtaatggtgcaatctcggctcaccgcaacctccgcctcctgggttcaagtgattcacctgcctcagcctcctgagtagctgggattacaggcatgtgccaccatgaatggctaattttgtatgtttagtaaagacggggtttctccatgttggtcaggctggtcttgaactcccgacctcaggtgatccacccgcctcagcctcccaaagtgctgggattacaggcgtgagccacctcgcccagcgataaatttattttaaaaagaacaatgtcaaaaccagaaaattgaaaaaggaaaaactataggaaatgttagcgcccccattaaccctatctagagagtaatattttcactttgattagcatccaagccaagtcagcttcttacacacttatttcacatcaagaatgccaaaaggggacttgagcacacataagcctggcgtctggagagactcaagccttgaacacctcaactcataactattggctcctaaaataacaaaattccttgaccacacctgtgggatgaaatgagaaacaagtaaacacaagcacacaggtttaactgtaccaggttcaagtgcaaaaatccaatgattagcactgaatttatttctgaaatgttaagcctatacttccagttgtttttaaataacaatagcttttaagtactcaatatgcatcagatattgtgcaaagtacttaatagatactcttatttgtcttcatatcaatgatatgaggtaaattctattttttttaattatacttcaagttttagggtacatgtgcacaacgtgcatgtttgttacatatgtatacatgtgccatgttggtgtgctgcacccattaactcatcatttaacattaggtatgtctcctaatgctatccctccccgcctccccccaccccacaacaggccccagtgtgtgctgttccccttcctgtgtccatgtgttctcattgttcaattcccacctatgagcgagaacatgcggtgtttggttttttgtccttgcgatagtttgctgagaatgacagtttccagctttaaccaatcctccccactacaattttgtaaacattttgtattgaaatcatttgggacttgcagacaagctgcacagatagaacacagagtttccatacagagcgcacccagcttcccctatgtccacattttaaatttccgtaactcaaagatcaaaaccaagacattaacatccatacaaagccattagctaatttacagacttttcctaactttgccctttctttctcatccaggatcccacattgcatttaatcgtcacgcccccttcatccctttaacctgaccagtctgtgacagttcctcgttactccttgtcttttatgaccttgaccctttagaagagcattagtcaggtattttgtggagtgtctctcggtatgggtctgtctgatattttccggtgattggattgacgttatgcatttttagcaagatgctatgccctcctcagtgcattacatcagagatgcacttctgattttaatcagaaaaaaagtaaaatgtggttgtataagtgagtatgtgtgtgtgtgagtgtgtgtgcctttgttccccctcacacataaggcagagacgtgggaagcctcgatcccattggtcctgcacaatttagcagtggctatgacaagttgtcactcacaaacaacttttgggcttaagaagcagctgactgttggcagggagtaaccctgagccaacagaatgaggtaattggctagcaagtgccgagacaggtgcacctgagtctcctgctccccagaacagggcaccccatctcccggctgtgggccatgatcggtgtccttctttcttttctggtttgtttgtttgtttgtttgtttgtttgtttgtttgttttttgagacagagatttgctctgtcacccaggctggagtacagtggtgcaatctcagctcactgcaacctccttctcccaggttctaagcgattctactgcctcagcctccagagtagctgggattaccagtgcataccaccacacccagctaattttggatttttcatagagacgaggtttcaccatgtcagccaggctggtctcaaactcctgatctcaagtgatccacctgcctcggcctcccaaagtgctgggattacaggtgtgagccaccaagccaggcctgtccttctttcttgataaaaactcttaaaaggccccaagcataaggtcctccctcatcacaaattcgcattcacctttgttccttcactgacagctgtgcccggaattccctggctctgccagtttctgtgactgcaggcagccggcagactcaggccctcctgccagggggagaatttgccacgttagcaagagagactcccatcacatccaagcgaccgggtatgtgtccaagtgacagaaatgcggatttactctcttgacctcacactgcgcctcccgtgccctcagatgtgcagtgcaaatggcagctccttgtcttcttataaacctgccagtctgcatcaggcatctgaagacatccttgcagtgaatggaggaatcagtcagcatgcgtttgcaagagcgtttattccgcagccctcacaatctcgggggccctgagaggatccaatggcaaaatgaaactgacctgccatggaaataacatggaatggatctaacacattgtcctgagtcagtcgaggggacagaacttattcgtacattcagtgaatgtgtgtgatctgcccactgtgagacaggtactgcactaagagccagactagagggaggagcgagggaaccacaggctctgccttctgagagcttctggtctgaccagtttgtattaaaagcaagggggtaacataaatgggagtccaaaatactgtgatacggactttgaatgccatagacattccaaaggagaaaataaggaagtttataaagcaataaaatgtgcgtgttataaatgggggagtaagttcccctggtggtgtctttaaggatcactccaactgtggaactcacgctgggagaggcatgtgaaattcagggacttattatactcacagattctagagagggagccacagcacacatgcagagggctgtgtaggaccagctccaagggattgggttcagccaggcaggtgggagctgagagaaagtgagagctggtggccaagtgcctttattgctgagtcagggtggagcaaaaggcatgggggtattttactggtgcatttgaatgtcagtagatcacagtcagggaaggcaggaaggggaacctggggcagaggccggccttatcacacaggtgcacctggtctcctgggccgtgagagaccgggtcatgaggatgcctgtaaggcatcatgaacatttgaagttttcaaagtttttaaaaaattcacagtgttgtgaatcaatgaacatagccaattagcatcagggaatacggagaaaattccaccaagaagactgaatagtatagaattgcattaattgagcaacttaataggcaagctgttcagatccagggcctcaggaaaaatggcatttctttcctggcaatttgtaacattttccatcaggcacctctcctgtccagcaataattgtgtttactattcaagttattgtttattctacggttttttgttattactatttcccttgcatggttttctcattactttaatgctatttgttgtgggctagaggttttttaattattattcctttcccttgtatttgcttttatgtgaaggctttaacttcaggtgcttcctcggattgtttgtaaagcagccttgcatttcagaagagcgctgaggtgtctgggtttttttctgttttgacactggcttctcagatggcttatttgggctgagcttgaggcctcaacctgcagcagaaaacacaccagagccgtagttgttaggtaatgcgtatttaatagctattagaaatgacaactcctgctgctgaacagctgtcactggaggcccagaaatgccacaaccacgggaacataaagtcttctctctgggggttggtttcagctcctacccagcttctgtggagctttaaaaaagaaaaaaacaggaatcttgccatttttctcccgttaactggcaaatgttcccaccaccaaattcctcatggctacatgccagcactaaaaacaaatcatcatcatcatcatcatcatcagagctggcatttattgagttcttactatatacgccaaccaccgtgctgaacaactacataattatgtcattgaatcatcagtagccctcatttatagacgattatcatccccttttatagatgtggaaaatgaggcacacagagtttaagtaacttgctcaaaatcactgagcaagtaagtggaattgttgggattccaaccaggcagtctggcctggactttcaacactagactagccatgagactgacctcagaggtgaggcataaaggaattttgtctttgcaggcagcttgtgcgatggttacacactagaattctgagtttgaacccaagtaaacttttcaggagaggaaacaggagtttcccaggtagaaagtgggagagccagagtttgaaacaaaagcccctggccaggtgcagtggctcacgcctgtaatcccagcactctgggaggccaagacaggcagatcacttgagcccagcagttcatgaccagcctgggcaacgtggtgcaatcacatctttacaaaaactatgaaaattagctgggcatggtagtgaagactgtaatcccagctactgaggtgggtgagtttggagaattgcttgaaccaaggaggtggaggttgcaatgagcagagattttgccactgcactccagcctgtgcagtggtgagagaaagagacagagagagaaagagagagagaaatcttctgacctcagagcctgatgctgttaccctctctcttcccagccgccaggcacgttccatcaccttcctcttcccaccacctgccaactcctgttccgatgacctccaacaatttctgctccatttttcctctctatccttacagctggatttttctatataaatattaagttgtgggagccactgccctgctcactcggctaccaacctctccatgatggtatttctcctccccacctccagagttctccagagttctcccaaagctcttaggggcatgtcactactgtcctcaaacaccttcagtggctcccagtcacctcccacaatggttataaaagctttggtttaaagacatggatctgaagagattgttaccaatgtgtatttccaggtttctcccccatgccagccaatctgacttgtaggactggtgtgcagctcaggaagacccctttttagcaagcctcctggggggggggtctgatgcaggtggtcaggggccacattccgagaatgaagatcacatttcttagaatgatgtccaaggtcatccacgatctaaactgctctcgcactgtcacctcccactgaggcctgaacactcactctaagttcccagtagtcacccctcataaagtgtgaggccctgcttcttcctctttgctcaggctgatttttcagctggaatgttctcatcaatcccagcctttcctatcaaactgctgctcatcatggaaagccatgctcacaggtcaccacctccctgaagcaccctcagatatgaccctgcagtcacctgggcttggcaacatcgcagcagtggcccctgccacatgccggccatctcctatccaggtggttctcctgctgatgacaagcttccagcagtcccctttgtacctccctgtatttagtttggtacctaggacaaaatatgtgcctgctaaatgtctggttacttgaatagaggaagcaaggcttataaagatgaaatatggcttgaaaatgtcacaagaaccaaagcaagtgctaaagaacaaggttctaatttgtcggatcaatcatgcagcaataaatcagccacctttgaggcatggagggagggcatgagcaaaggaaggaaagaaggaggaatgaaaaaagaatgaaagaaaagtttacagaaaagaaatgccatttattccacaatttacgtgcattatgtcataatagccaagtgattaagaaggaaagctgtagagtttgaatttgctaggtttgaattattgctgctctagttaactgaacccattttagaaaattacttaacccctctgagcctcggttttctcatctgtaaaatggagacaacagccatattacctattacattgctgtgaggtccaaaaagtaaatacatggaaactttgtagaaccatgcttggcacgtattaaatgttagctagtatccaccttcacaacaagcctttgcaatcattcattgttattattcctattttacagtaaaagaaacaaagacttagagaaagtaagctacttccccaaggttacatagcagggccacgtctgcctggttctgaagcttgtggccctgatagccatccaaaagagagatgtggcaggaagaccccccaaatccagggcagtgtgaccactcctgaagtccccaacaataagtactgccagcagctggggctctctgagccccctctggctctgtctcacaatatgctctcctgtctccctttaatagacatcttcctctgcaccgcggagaacaatgacaaagctcttagtcccctccctgagggtagctggtcctccccgtcaccaggaatacttccctcagagcttccttctctctccatgaaggaggctcgggtctcagctgtccttcctgagacagccagggctgcatcctagctccttcaaaccttccatcattcatacccatctccttctaccaccccatcttgccctgaaatcctcattaatgcagacaggccatggaccatgactgctgcccaaaagaacgtccctcagcacactgcagctggatggccagatcccacctctctttcctcccacccctgacctaaagaaacatacagggattctttggcagcaaaggcccagaagcaggagcttgaagcaggtgcacttggtatatgctttgcagacagcaactgagcagacacccttggcaaagtcacttttgataaaatagcgtaagaagaatcgccaccgcctattgaagatcaactacatgctgggcactgtgcaaagggttttaagtgaatcctctcatttcatccttgtgtcatacgtcatgatcgtctccgtttcacagctaaagaaactgaatctcagagagattcaagacccttgcccaggtatggtttttgaactatgttcttacccactggattagtgatacccacactggagcccttgttggaatcatctgttaacacacagattgctgggctccacccggaatttctgattcagtaggtctggggtactagcatcaggattttgttaaatatccaaatgctcaggcctcacgccagacgttctgagtcagaagctgcattctaacagggtccccagatgactcccatgcacattcaagtttgagtctagataaattgcccttgaactttgcttggactgcccaaagagaacagagatcgaggcagtcgcatcacttttgacctctcatccccctagcttgccaggcaggcatggaggagccctttcctccccagtttggaagttgcagtgcacattatttggtggccacgtgcaagtccatgcctgcaagctccaaaacgcggcagctcctgatgtttctcatggcagttgcgttaccaaacagaaatcacttcgcggggcttcagtccgtcagccctcccccaagttaaattgcttctgagattaagaacccttcttttttttttttttttttttcctttttaaactactagataagtagcagagcagccctggaaggcagaatgtctaaccctagggaaacttgtacatgtgatgcacacagagctaggggaatcctgtggtttatgggaaaaactttcgtgctgggaaataaaccagtctttagaaagaggtcagctgggatgggggacagggaaagggtgctttaccctgtcttgtctctctacaaagtgaccagttggaatagttttctcccagtgaaaacagtgataataaaatcctatctagtgatgactatgtgccaggctctgtgcacagcactttacatcattatctcatttcctccctttggaaacactatggggtaagtcctgcagaattcttatcccacttcaaagataaagcaatcgaggctgaaagcaaagtgtccatagtcacacagctggcaaaaacaagggaaggaagaaaggaaattcaggctgtctaactcccgtaagcctacaccatgcccagaaccattctgcctgctgagagacagcattggatgaaacagaccccccatgccttcaagaagcttccatgcttgcgggtaataggacaccaacaacttgcaaattcatcttgatgctccaattacaacaaaagcgtaaacctccttcagtctggacttgagctgcagaaaagcttactgtgtactccgaagaatttaaatattcattatgtaattaatgctgttcagtctcacacacacatacacacacaaaaactgagacttttttaaagaacagcttaagtacttatcgattgagaacttttataactctcaaaatggaggcatccccatatctctacaggtattttaaatgaattgaattaatcataggcttaaaagtctcttgcgatcttcgttaacttccctgggtttaattaaaacatctgtgcacttttaatttatcgattcatccaactcatatgtcatgtttttaacacaccccagcatgctctgcatcatttttaacccgatttccacttaactaaagcaattaaattcaccccggattaattaaagcatccatactttcgtgcttaagtcagcgtgtgcttctttccccacatggctcctgaatgtcagagatttgacacacctgatgagttttttgtccttctggaaattcttccctgaatcactttcttgcttattaatgtgccatttgacagaatgggaatgaggaagttggtgcagctgaactttggccctctgagccggggactctgaccccatctgtcagaatgcaccatctggtttcctctcttcacgggggtcctgccggctcttgcccccactgaaaccaactaaagcgtctgagtactctgggcaggacggtggcaggggttgggggagggctgttcaggtcagagatgagcatcacagtcaggatggctggtgatctttgcatttgtatttcataatcactcctagctctctttccaacttcctctctctctctccttccctacatacacagtcctttattgctctgcccatttaataggtcaggaaaactgagatgccaaggtcaacagacttcctgcttgggcacggtgagccagggagctgtccacagagtgacaaatcatctccctgaaaactagatttgatttgctgccatccactgggatggagagagcccatcccctcagccatggcagcattgggtgtaagcagccttatttttttccccgatcagataagccaaaaatatttctcattatcatttttatctgtacttacttaattttgaaggaagctgagtatcttgtcttacctttattggcaacttatattatttctgatatgtgctttgcctaggttttcattcatctgtttattaatttgctagagttctttgcgtatttcagatatcaaacgttatgctgtaaaacatgagaaaaaaatatttcttcccagagttgcttgtcccttaattttgcttagggtatcctttgtcacagagaagatattaattctttataatcaaatctgatcctctgttccttcatggtttctagaatttatgtcttacatatctccctcccaggaaaataaaattagtctccagtattttttcaaatactttggtagtttttgtttttctgtttaggtcattaatctgtatggaattttttttaactttaagttcaggggtgcaagtgtgggttcgttacataggtaaacttgtgtcatggggggttgttgtacagattattccatcactcaggtattaagcctagcgcccactagttatttttcctgatcctctctctcctcccaccctctaccctccagaaggtcccagtatgtgttttttccctgtatgtgtccatgtgttctcatcatttagctcctacttatgagaatatacaatatttggttttctgttcgttagtttgctaaggataatggcctccagctccatccatgtccctgcaaaggacatgatcccattcctttttattgctgcatagtatggaatttatttttgaatacagtgtgcagtgggcggggggggggtcaaactttattacttttctaccagatggattgccaattgcagggatcttgctagaagggaaactcacctttctgacactggtttgctcagcaccaagctaagtccacaacctcaaaagccagtggggttgccttttgagttttggtttgaggggtcaccgagctttgtttgcctggcctccatgacctaaatattacatcctcaattgcttcaggaggatcaatgcatcttcttttctccatcacttatcctctaccacctaaccaagctactaacccatgtgagttactcatcactattgctgactaactgggatataaggcaaccaactattagtgctattttgacgatttgcctggagtactagcttcaagtattttcacctctcttttccaaagaaattttcaaacagacttcagctgggtgtagtggctcatgcctataatcccagcactttgggaggctgaggcaggaggatcacctgagttgaggacttcgagtccagacagggcaacataaagagaccccgtctctaccgaattttttttttaaattagctgggcatggtggtgcacacctgtggtcccagatgctctggaggctgaggcaggagaattgcttgagtcagggaggtagagtctgcagtgaatggtgatcctgccactgcactccagcctgggtgacagagcaagaccatgtctccaaataataataataataatagtaataaaatgaaataagtataaaacagacttcaaataattttttaaatacattatttgaaattccctctacacatctagtccagcccacaaattatttgtgcagatgtaggcattttccctctgcttttatgactgagcctctccaatatccttaacttttctccacgtattctctttactgcaagctccaagtggacaggtggcttatcctgttacttcccactgagtaaataacactgataattcatctcatcccttacagagaactttgtgggggctgggagggcgggggagcttcagctggatcattaaaatgagctttataccatttaggtgaatctaaattctgtcatttttttgtcatcagcctgttaacttgtcagttattagtggttgtggtaatttatttttcttctgtgggagtcttagagcttccatttactagatttagtaaaacaggaatagtcaatttgtacaaacattttaattaattttacatagaagcttgaatgcacaatgttctgctcccgtaagccttaggaagaagagagacatgcggagacagaaaacgctccactttcatacctgaccaatcacaaccaactccctcccacaccagaaaagactggaagaagaaaaaatgaaatctttccattagtatgatttgacatacgtctggtgattgctagtgtttgtgtgtgcgtgtttgagacctatggcatttctttattttattagcccttgaagtcagattagagattcagtttgaaattttgtaagggagcatctcttaatttgcctaccaagtgtcagccactcctgtgagccatacatgttacctcactgaacccttccatcaatgctgaaaggccattttttgaaggggaaattgggtctttgagaggtgcagtaatcttgccaaaatccacagctggtaaggtacaggtttggtttcgaatccaggtctttctggcatcaaaacccttgctacttccacttctgctccgtaatacttcttggcacagagtaggcagtcagtgtcatttttctataacctgtcataaaaaataatgcagcttgcatgatagtaaaaatataagacttattaatacaggaggttccccatttcacatccagcctcttgaacaaaacatcagcctgacctcagatactgggatgctctgggttgagttatgtctgagaatgaatcagttgccccagagggaaggtgctctccaatgcaggacaccccagccaccactggagggagctcatctggtgtttctgcactctgccccatggcaactggattactataaagtctcgctcctgtgatgagccgccttccacttctttgtatggcataagcaaagcccattgagtgtcctgctttccagtgaacatcacagtgtttttgcattttttaccacactcccagtgagcacgcggcaaaccctgaaggaaggctgcgtttggaaggtggagaactctgtgacctattttttatatttttcactgagtaatttaagtaggtcaaattttaaatttgatttcccaagcacctggttttaaataaaacccattcttaccttctagacaatcctgtttttttctacttgaagtttatgcagaagaggaacagtgtcactatgaataaagaaaataattcggtcaggcacggtggctcacacctgtaatcccagcactttgggaggccaaggcgggtggatcacctgaggtcaggagttcgagaccagcctagccaacatggtgaaatcccatctctactaaaaatacaaaaattagccgggcatggtagcaggcacctgtagtcccgctactcaggaggctgaggcaggagaatcgcttgaacccgggaggcagaggttgcagtgagccaagatcatgccactgcactccagcctgagtgacagagcaaggctctgtctcaaaaaaagaaagaaggaaggaagggaaggaagggaaggaagggaaggaaggaaaggagggaaggaagggaaggaaggaaggaaggaaggaaggaaggaaggaaggaaggaaggaagggaaaggaaaggaaggaaagaaaaaaaaagaaaaaaattttatctatattttttattgattaaaaaagacaaaaattttgcaccttactttctaccatcctccaccttttgggaggaaggaggatgtaataggagaccagtgttggtgatttgatgtaactttctctgccatccgtgacagcccatccaatctataacccttaggtcagagagtcagaaacagcccttggaagctcatttaaatacacgttgtgcaaccatacttctcgctgttttttatttcagtgcagggctggaagggggctgagaagtgatgttgattctagtcttcccaccaggaaataccttcactgttacctagatcagaaatgacaagtaggttttctctggaataccaactctgcctgcttgccggtctcagcctgcacactgcattgacggtttcgaggctctatctgggctcaggggaacaagatgccgtgatcaattagtgatgtctgtagaggtgtgggaaggtagtactatagatcatgtgcacacgcctgccatcccagacctagagcttagcatgagtctcaggaggaactggcatggaacaaacttaactctgtcttaaatccctctcaaaactttaagaaagttcagagtttcttgtgctacttcatatttgcatgttccctaattcttaattgggcaccctgggttcaaagctctttttctaccctctgttagacaatcagcctctgtagcaactctgtacaaactcctctgtttaagcatcctgtagatagagagtatgatccctacatttagacagttcgtctaaattcaatatgcggctttgaagttctcacttttgaactcattcttctcctctggtaaattcataagcataagaattctactgaaaatagcgcccccagtagttatggcaactgtcctattataaagcattttgaggggaaatgacccctcaatcgtatgtcaactattgagatacttacatttcaaatcagtttgcaattaaggtaaaacatgcacttccccagaaaaaggcattgtgtttacagcatgagattcactccagggactgttcttcccacgtctttcataaatggccatttagtgcttgcccgcaaccccccaccactgggaaatctctgaatatcaggaacacaggagaaatgtttacttaatcaagccaccattgataaacgtagcaatggaaggaaatcaacaatgataaacatagtccctgtcttgaatagctgactatatatctttgggaaattagacacgcacagaggaaagttaattaccataaaaactacatagaaacatgacaacaaaaggggattcatgaggctgggtggggcaggtgactaggaagtgacatgattaggtatgccatcgctgagtggcacagggcgctcacccgggttgtagatgtgtgtacacacacatgcagaattctcggaacctgtgcattccaaaccatggataacaccaggagtcactgaaacacctgcatccgtcatttctgaaggcctctaatgccacttccatagccggaggattttaggcccaaatttgaaggcaggttggaaagttaggctctttacaaactgatgcggaaatgagaagtccaagacctgaaggagaccgaccactgaaatcccattcttgatgaactctgaaaggtgggaattggcacatttgaggccaaactgattaaagctgtaggtaatctcctcccagacaatccccactgattttccaaccttcttctcaccaacagatggaagagggtacagctgatgggcgaactactagaaatttcatgccttcagcctgcctgctcccttttcttttttttctaataagtcaagcatatttaatcgttatgctttattacacatgttacactttgaaggaggcacaatgacagtagtccctccttatcctcaggggatacattccaagaccccctgtgtgtacctgaaaccacaaatggtacaaaccctacacataccatgttttccctacacatgcatatctaggacaaaggttaatttatcagttaggcccagtaagagattaacaataataataaaatagaacaattaaagcagtagctgtaacataaattatgtggatgtaatttctctaaattccttattgtaccatattcacctattttcagacagcagttgaccatgggtaactgaaactgaaagtgaaaccgcggatacagggggactacttcatttcttcatggtatagataaaactgaggcagtgagactttcagtggctcagctgtgtctcatccccacttcctttttaataggcataaacttattaggaataagagtcgactgatctgagggtaaaataatcagcaaaatggattctgatctccaataccaacaacagaacaaccataaggacgtcagtgtcgcttagtgaagggtaccacttcaaagttgggccaacctggttcccagccgggctcccctgcttgtgggctgtgtgactggacacgtcacttcccctgtctgagcctcacctgcaaaaatggggaccatgactgtagcctccacctcatagggtgattacgatgatgaagtcatgaattgcacataaagccttctttctataccgtgcccagcacataacaagcatttaattggtggtagctgctgttatcagtagcacttgtgttgtttatctggcaatggttctgcacctgcacagccagagtccccagcctagaacactgtaagccaagccccaaggccagacagctctacctccttagactgccatagcccctcggatgctggcccttcgtgacctagtgctctgtctttggtttgtgcagctgcctgccctgtcctgtgcagtgggaatggacaatattctaaagggacgtgccagtgctacagcggctggaaaggtgcagagtgcgacgtgcccatgaatcagtgcatcgatccttcctgcgggggccacggctcctgcattgatgggaactgtgtctgctctgctggctacaaaggcgagcactgtgaggaaggtaagcccgccggccccggggctaggcagcagtggagggaggcgtttgcagggcctgacctttgctaatgagcccagtcctgggctgcgtgttttgcaagagaagtttcaacattttgcacaaaacaacttcaaactcctttgctttgataaatttctttggttgtagaacaagaaaagcctatggagatggttctggaagaaacgttttgttttactctcctttgtagaaattgattccttttctctttcacctttgtttttctctttaaattgctctctctgcctttgtctttctgtcttctctttccttctactcctcctccccttccttctctttcttttcctcttttgttcctttccctcgccctatctttcttcctcttttctcctgctttatttagtaattgggaattactaaagctattcagagaaaagaaacaagaattcctaagccccttgcctcccttccaaacaaaaagctgtttgttgttattgttgttgttactaactcttcctggtaatctaaggcccgtgtatgtctgtgtaaatatttcagcaaaaattaatatcaatagacagcagtcaggcttgaaagactgtaggttttttatgtcatttagaaacaccatgtagggcaaattagcttggttacttacaattgcacaaaactagaggagagtgaggatgcagcaagagggacgggatttgatggatcctgaaaatctcatcctggcagacacgtaagggcctttcacacacatgggtgaaaatcagggatataataaactgaatctaatctgacaatatggtcagagatcaggcttggagatcaggagagggggacatagaagaggggatacaggaacagggagaaagagcacctctctggaggggatccaaaagcagctgtaactactcctagttaccttgatcagttatttcagataaattattttgtgccaatatgttgggactgacttgcagtagctataaggcaagagaaagctatgctgcctgtcagccttcctgctctgtatttggccttgcagaatatggtctctggttgccatttgattacttgtcaccatataaagaattggccacagctggtaggaaggtaagaccatagaccctctcagccccttgcccattccccaatctctgaattggcttcatcattgtcttccagctgaggctccttttctctaagtccatctcccagtgaaatgccctcacacaactcaaacagcccttttccctcccatgtccccaacagaaatagaagtgtcaacttgcccaacaaactaaggggaaaaagtgaagcccctgcctattctgcatgaacttgatgtaaccacccaagatatccccatagaaaagatcctgttggatgccatatgcattctgtgttcctcatggccaggctaacaagggatctcaggttttatgaggttctcagatgctaatggattcattctttcatcccaacaaccaatggatctccagagttctatacaaaataaccaatcatcacagctctcaccacaaagtaatgacagtgctttgtacttagatacacccacatagggttcccttgtgaaaccccgcatttcatcgtttttagaactatggctaccaaaagtcagcttccataacattattcctctaagatttttcaatatatcagcagtaatgcccttaatggggaccagaagtctgacccccagatcttcacttgctcagttctctatataatttttcctctattataaaaggtagcctccctatgtctgcatcataaagaattgggagtttggatggaggaaatactgatttaataaccctgcttgaaaggttaaagttcttaaagataaatggattgcaggaggcaaagctgcattcgctgaaaacataagagaggccaataatacgacaagaaaggttaaaacgaccttttgcatgcatcatttggagaaaggaaagtgctagggcaacaacattgccagtcttcgaattttttctctccagtaagattatacacagctgtatgcatggaatctcaagtgatttctcaactttctcactatcccacccagtcttatttaaatgttcagagtgaattaaccatccaaccaaacaagccacgtgaatcattatgaaaggatgaaatctcctccgttgatttctgctacccaaaaagaatgaaccgaggtgattcatatgctgttttcaaaataggaaatggaatcagaaagtctggatcagcactttttcttccatttagcttttttatttctgatattcgtcatagtcataacgttcaaacaatttacctgaaatggccatggcaatgaaatcaatagttgccatcccttcgtttttcctgcataaacatggttgtactattaacaaatttgcccaagaaaatgaaaggatgtattcgtgaggtttcattcaatgatgtgtaggggagtgggaaggtgatgagagaggagttgacatattagtttaagtcagccatgttttcatgtcagtttcatggttgagtcatttttcaatgacatttaacttcataaatgtaattcatggttcttcaggggcttatagtacatattgtttgtaaaactccttgacctccttttttatccttagggatagaaattgcattcacaacccttttttgtcaaacctacagagggcccaagactaaatgagttctaatgatttcagctgccagggggctgatgtttcgaggcacatggtacttagctggtaaaggccactgtccccttttaagtgtaacactgtttctatttataaagcttcgtaaaatgccatagtccctcctgcctgctaaaggctctaaggacgtggccacaagagcatcttaggaaatcggaaccaaatttaaaattcatagtaaaactgctcctcttgaagtttgaatttagttattccatccactgctgtaattatatagcacaaagggcatatttactggtatcactgaccagagaaagggttagctcatatttttagatacaataaatggtttttttgatggcattctagtaccggcgctaataaatctctgtggattttcctccttcctttatactataattcaggatagagaagagagagctaatttatctggaagaaaaatgccattttcatttttttagtgtattactttttattatttcatccttctaagaaaaagattgtgattttttttttttgaaagctcctagctgctggcacctcaccaaacattttaaatggctaattataggttaagaacaatttttgaagcaataagccacaagatatttttgtgtatattttgatttttccttactagaaatgggggcagagtgaaaaattagaatttcagaatttcctttattggaacaatataaacatgatgggttctgaatgaatttgttcataatttacagatccccaaatacgattttttttcaaaagcaagaaagaagttgttagcacaatttctgcttcctatcggtcctttctctacacaggaagtgtgtcccatcaatgacaaatgcttatagcacagtctgtccttcattcttgcagcaactgtgtattgaacacctggtatattcccttacctgtgctaggcatgagacaccaaaggccctgcacagacctttgtcttttttgttttgttttgttttttgagacggagtctcgctctgtcacccaggctggggtgcagtggcgcaatctcggctcactgcaagctccgcctcccgggttcacaccatactcctgcctcagcctcccaagtagctgggactacaggcaccggccaccacgcctggctaattttttgtatttttagtagagacagagtttcaccgtgttagccaggatggtctcggtctcctgacctcgtgatccacccacctcggcctcccaaagtgctgggattacaagtgtgagtcaccacgcctggcccgccctttgccttctatgtgttcgatgctttcagctcaagtttacgttcagatgtgctccaccaccctaaatggagcaaatctgaaggtatcaaatgggcttatgtcatcaggagttatactccccgagacaatgaattcaactgtaaagtgataataacaagattatgtaacatcatcataaatatctccaactaataataagcaaccaaaattcacctttgggggagtgtacccctgatttttttttaatcactgttttttccccatgcctgaaacggttttgaaatgacttccatatataataccttcctgagaatatccaaatgggatcgtgagaaatatctcttaccactgaaaattattatttttgcctcaagggagggctgccctttggaaacttcatggaatattgtgatttccagtaagtccaaatttctcaagtctgttgtccctcaggactagttaatttgtggcatggatactctaaataatgtcatatttagagccaatacgtcatcagtattaaaatacaccaatggctgggcatggtggctcacaccagtaatcccagcactttgggaggctgagataggaggattgcttgagcccaggagttcacaactagcctgggcaacatagcaagaccccatttctagagaaaaaaaaaaaaacatagctggacatggcaatgtgtgtccgtggtcctaactagttggcagactaaggcagtaggatcacttgagctcaggtgttcgagactacaatgagctatgatcataccactgcattctagcctgggtgacagagcaagaccctgtctcagaaaacaaacaaacaaacaaaaaaggcattattttgtgccccatagggaaagaaaaaaagacactcagcataaaaaatgtcttaggagatcctacagaaagctgagaccctgaggaattatcatctgaatataacagtgaattatttagagaccagaagtcttacatatttcaatcttggcattgtggaaggagagaaaacaaaattttctgagaatttaaaccataagacggtacgcatacacaggaaggatttaataacactgtcagcgtggtccataaaaacttcaagaatagaattcaaagtggtctcaagctagctgtgcccccaggtgatagaagaagcaatcctttaatctgggccaacaggcctgatttggaagccgtgaaaacgggagaaatatgtcttaatcaagtaaggtgatgatacatccacatttgtctgatccacaaagccatatctgagccctgtgctagaccaccatttctcattcaaaccgtatattacacaaagaaccctcttctccaaatgacattgcatcatttcctgagaatacataggaatacataagaaagctgggcttcctctaaaaggccctatttattcaacccttagattgaatggaggtcccaggtttgatatcatattctcatgcaaaaagtcctgtcctcaagaactggcctttgcagctcgctcctctcctcactctgagtttattcaagttacgtactggatgtatatccactctattaagatggccaaacaatcagacagtgaaacaggcaagaaccacaatgactggactctggctatcagctcatctgattgactggtagaaggtcagtgcctcagccagagatagccatccagtcccctggtgattacctgtaggaaggtgatcccttttggatcattttcacacccaacttcgcctcttctatactgcacatttactaactccttcagtgggtgtgtgctcagagaatggatactaattttagacttagcctaagtgaaacctcattaggaaagtgactcataagtttcattggttttccttttcatcttttgttaccttttgaagtcaagtattagtgaagttacaatgagcctctctacttttctctcttatagtgaggggcaatccagtttgacgacacatgtagaaacatggcatatattcacattcctatcgcagatgctctgatatgattcagtcaaggtcctaatctttataagcacaagatactaaaggtggagtggcatccttctatatctgacttctaatgctgcttgagaaatccccttttcgtttctcttgtatcttcttcaagtttgagatttggtgtttgacaaataagaaggcttttactttttatgggtgtcttcaggtgaccacataagtatttcttgggctactccatttgctagcaagtggatgggaactggtgacccactggtccattcagcagcaagcccatgtctcatggtccatcctccatgggtgattaatacttttattctttggtttttgtttttgtttttttcagttgattgcttggatcccacctgctccagccacggagtctgtgtgaatggagaatgcctgtgcagccctggctggggtggtctgaactgtgagctggcgagggtccagtgcccagaccagtgcagtgggcatggcacgtacctgcctgacacgggcctctgcagctgcgatcccaactggatgggtcccgactgctctgttggtaagccacaaggttttctccttcctctctccaacactcctgccctgtgttccatcccattctcagatggatgggaatctactcttaatacttagctggggataaggggactttgatgaatcacattgtgtctttctcattctcttctcctcaatcgtggagtctgtgatctttgagaaacaaacaaaaaagcactgggttggtaccatcaccgcaaatgcatgaggagcccaggagggatgcttccatttgcattataggttttcttatgtacattccctaaaggtaccagaaaacaaaacagaacatttcagccccagacaaactaaatggaacatcccataaaacagaaaaggggctccctcggggtgctgcgtgaacatgttctacagctctgtaatactccagtgacaggaaaataatgaagtcgcgctgtacacttcattttcctaaaatttagagtatgtgtcttccctccagagtgaccttaaaaatggaacagttcaacagttcaagccagtcccaaccttcctgagaaaggttctgttcacactgacaagtccctatccaagcaagcgatcattccgcccccttcctctgggtagtgagacagctgtcagattgccatggcaatcaggaagggaatagacgtgaagctttgcctacaatgggaaagaaatgaatatttcattccaaaaagaaaaaaaaaaagaagagtcagttaaaatgggctattttggaatgtcttctcagcccacttgactctggcttcaactctgttgctggtggtcctggcaaggccgtgcagatgatgggaggaggcaggggtcctagatccaaaacccagttatgctacagatatgctgtgtgactttgagtgagtcactggccccactccccggcctggtcttccttcacctggcatgccaagccacgcctccctcaatagactgatgaaaggatgaatgtctggcacgtgcttgtcctcgcgtgagaggtctggaataccagagagtgcatatctgtctgtctgcctcctccccaagcacaaaagactttgagctcctttgagaaagaagctgtgtaaatgcagcacaattacagcggtcattatcaccgccaaggtaccaatctgggtaacggggtatctgcagtcatcatgggaatggagcagcggggtccccaactgacctcttgtgcttggtcagttcaggctgtcagtgggggaggaatcccagctgactagagagtcaggatccgtacatggatcttttcaggtgggtacttcccggttagctttgccaaactggttggagtggtctcaatctctagaagagtggttctcacattctagcgagtatcaaaaccacctggaggacttgttccaacaaaatctctgagtcccattcccagatcttctaattcacttggtccaacgagggcacaagagtctacatttctaacgagttcccaggtgatactgatgctgttggtccaggggccacactttgagagtcacttctctagaaaaaaagatctaacaatgaattgatacccagccaaggagagacaagcctccaaagatgacagagctgctgggcctcggggcctgctccaggggtctgggccatgtgcgtggtctggactccatggaaggtttcaccagctgtggtgttgagctgtaatcattgtttttcttccagaagtgtgctcagtagactgtggcactcacggcgtctgcatcgggggagcctgccgctgtgaagagggctggacaggcgcagcgtgtgaccagcgcgtgtgccacccccgctgcattgagcacgggacctgtaaagatggcaaatgtgaatgccgagagggctggaatggtgaacactgcaccattggtaggcaaacggcaggcaccgaaacaggcacatattgctttattttcataaattgtagatctatagtgatggtcgcgcatggcaactggctgttccttcagggacacaagtgctctcccacatttcctgctgcccctccaaatctcccaggggatagggaaggagaaaaatgaggtccctaattgggaagggcttttccttctttccaggattccgagttgaaaggaaagggaccagagcagataagaaaacccctccaaacttgcaatctcagggagggagaaatgcacatgcatgggaaactgtcggtgtctgggggttgcaagcacctcaaatcactgtggtctgcaactctcccctttttaaatcctctctcagctggctggatcactggatccctgcttgctggcaacaaggtgaactcactaattttaggtcaggttagacgcaggcaggactctcaggttccctccgtagcaggtaccacggtaaggtcctgagattccccatcaccaccaccgtcattacatgtctcctcctctggtcccattttattctcactcagccacctctctataaaagcttctggaccaaggataatttaaaggtcattttctttgttaagaagaaatagttttggagtttcttcatttttatttttctctctttttcggcacagttgtggtttagggtaggactatactggattaaacgtacctaatcatccctttggtagagaagctgggagccaatgctgtttggctttgcacatctctcagacagttgggatgacaaagttgtcaacttgagcatcattttacctccggtttttacttttgttatttaattagatcaagcctaggatccatttttatactaagctggttaatctacttgcctgcatggaaattctcaaagacgtttccagccaaactacagtttggccccttgaagttacctttgatcccagccatcaagtttgagaccctcccctctgtccctgcctaacaaccccagtcacagatgggccacctggagtgagagacagggctaggagcttgcgcagggctgattcatgagatcagactcaatttcccatgctgttcatttgggtggttatacagagataaagtggactgactctgtattcgatttcttccggttccatctgattgggcatccgaggggcagcatgccaatcagggccacgaccatagcactgggaccctgctgggacagtctgttggcagtgaattgtttttgcaatctctcgatgacgctccaggtcttgctcccctgcagccgcttttatcctcagttccctgcagagtctgaggaataattcaaaagactttcaggggacggctgtgcacagccctatactgagacagttcttacaatagcttccattcatcaggggcattccttttgctgtactattgcatgcctggtgttatttacatgaagattcccctccccatatctccattgccccaaatcctcccctcaaaagctcttgccaatcatcagcgttgaggtggataatcctactttcttttaattcacacaatccaacctcacctcccctttgctcccccttcccacatctgggggacagaggggcagggttagtgtttccacaatgatgcctgctggctctctcctacctacaatctgtctttactttggaaatagctcacaagagggcagtccagatggattcgagcaggagtcgccaaactacggccagagggccaaatctggcctgctgcctgtttttccatggcttgccagctaagaatagtttttacattttctaagggttgaaaacaaatccaaagaaaactatttcctggcacgtgacaatgatacgaaattcacatttcagtgaccataaacaaagtattattacaggacacccacacccattcactgatgcctcgccagcttccatgccacctgtcagcactgagtaattaggagaccgcatggcccacaaagctgcttgtgtggcccgttatgggaaaaaaaaaaaaaaaggctaactcctgaattgcacaaatcttgatggatagaggggagaaaagcaaggcaggtccacacccccattaagaaaaggacaccaactgtagcttgaaggatctgaggggtctactccagatatcgcagagtgggagtggagaaaaaacagtagatgtgctgaaatgcttccggggcccttgaaaaagagatgggaagatgacaactttggtctcagcagagaacagcaaggaattggccaacaagagaacatagatgtttcggtcaagctagtcctttgggtgagataagttggaaaaaaaggtgtttctgccacttgaagtgtttggtacaggtttcacatctttgtgagatgacatacatgagttcttgagagacattcagaaagtgtaaattgatatgccagctaaagctcccaaaatgaagagagtgctggtccagtatagtctcttgttcagaacgatgatctcctgtgactttagagtttgtgctctgtatgttataaagatctttactaccaaagccttttcttgtgagaaattagggctctgtgtctttattagtaggacatgtgccatctcctcatagttatgttcactgtggttttctcaaaaacaaagccaagcataccttgatcagtgagatttgccattcaaaaaccagagagatgttcatacatgcataattgcatctttagcttttctatctccggcccccagagctgctttggggagttttattcttctagtttgagcagacacttctgtcatttcatttaaagtaaatgccacaatttacaagcccagcatcagttctcctccttggggatactgacagagaggaaatgggggctctttggtcctttccaagcacagcctcaaatgctatattttgaaaatagaaaatacagaaaaatgacatggtaccaagtcagcaaacaatgcatagggaaattttgggtaaggcagaattgtgggagttagtgttggacacttgggttgtctgcgacctgtttacaaaaggtcataggtggttttcttggggtcattgcaaatagtcaactgaacaattcacatcagtccttgtggattacatttactgtactaaaaggatcaaaaagagaaatggggaaaaaagatgaggacacaaggacagacttctaaaacttagtcaggtggaagccccaggatcagtccatgtttggttaatgcctttctggaatttgcaaccaaattatttatatttgaaaatgtagtagagattgctaaacatttaaatataaggtataagacttcaatgttaactgttagagctaacttattgacagactggattctaccaagcaatgactgttatataaccttttccttaaaagttaaatatatggcatggctaaaatctacagaattgtgtagataaaaaatatactttgaatacatatcagccacaattcatgtgtatctttggaatatattagcattttttgtatagcgtgcagtttactcttatgactagcgcagacggcacattgtgtggctagaagaggtttattctttaaacataattttaaaatgggttgttgttcctgtcatctgccaccaccaccaccatcaccccttgttaatactgggacctaggccaggtgcagtggctcatgcctgtaatcccagcactttgggaggctgaggtagacggaccacttgagatcaggagtttgagaccagcctgaccaacatggtgaaaccctgtcactacaaaaattagctgggcatggtggtacgtgcctgtagtcccagctacttgggaggccgatgtgggagaatcgcttgagcccagggaggcagagattgcagtgagccaagatcacaccatggcactccagcctgagtgacagagcgagatcctgtctcaaaaaaaatactggtacctaacatcaaaaggccatgcaaagcctgtaacaccaggacatggaggaactatagaatgtgtgtaataatagatcaaaatcactaagaactatatatagtaaatgtagatcagcgtctcatgaagaggtaaagtagatgttagcgtgtgttaatgagcagaacaattgggcaaaatgcaagaagaagccaacatttgcattgccggggaatcaaggagggatgctacatgctaactgtggactcttgcaattatctcctgaacatgggctacccagacatctgctccgaataatacaaactaacccgcagactaaatctgcccactctgggcacttcccaaccctgagtgaactgtttgatatctgggtagtgagtaaaggctgcaatggttatttcaacttgtgtattttatctatgtggtcctaacctccgatttcatctcagaatcataagggcttgattcctaggaccttgtgaggctgagtgacctgcccaggtgccacaagtcagtacagttttcttttccctgtatcgcactgggcccttctatttttcctctttaattggttggggaaagaaatcggtgcttgtgatgttaataaggaaaatgaatctttacccaaggtaaaaccagccgtgcgatgatccgatgtgctgattaagtgattgtcatcagaagtagacagggtcacagtccaagagggagagtgcttcagaacaatagggaacaggttgagaagaaagtgattgtcagaattaaccaacttcagactgaggacagctgcttctgaatctcattccagtctcattctaagttatgaaaactttttttttcttgtggctattgtccttgaacacttgagctttcatgactctacagtgagatcaagttgagatgaaattagccactgtggagccatccttaccaccaggcctgtggaatcagctaattctctgattggttaattaacctattcctccaggggctcttattagaactatccttggagttcctttttttattttaagtgaaaacctaaagcgatggccttttactgataaagattatggataaacttttaacagaatgcaaaagctgttccattgctgattctcccccaccacccccctataatttggccaaaacatgagcttccttactgcagatcaggagtcaccacatgcccagaagttctttttgagtctgggtcagacagtctgccagaggtttcctatctaatcccagaacaaggactgggagacagacttacagaaacatgttttcacatcactgcaaaaacataaaaggaaagaaaataacggctttacaagcagcaagagtctcatcactggaagcatttgctttcttgtcctagacgttgaagggctttcagcatcagtagaaacatagacaagatagacacaaactacattctaactttatgactcatcattctgtagtttagatggaagcatttttttgtatttttatgtgatttagtaatgtctgctcatgttatgagctcccatcaaaaaagaaaagaggagaagaattcttggtgttttagctctgtggggagacagtgatttgtgtcgtactctgcgctgttcccttactgtttcaggggaactggtttgatggactagcttgtggctcacagtgatggggccaagcttgctgagtcaatagcttgatataaggtattccttcctgacttcaccagagcaaagaattgaacagtttggaactcttgcaacataaactcatggatgagagttaacacaagtaagattccaggctcaaagaaaggggaccatgtaataagagctgttgaaaaacatgggatgcattgtcctaatgtatagtgagtgttctgcacttgagcttttatagagaatccacgtgccttccaagtctgtgactctgggctttcacaatacgcactaaagattttccatcaaaggagaagggaaaacaaagtggttcctggagagctgagctcccttagatatttgtgatggacatctttcttatcacttggtagccaattcattgtggtatcatgaacagtagactggctgatgaaggaggacatctgtgttctagctttgactctaccatatacattttgtatatcctggagcaagtcaccaagccttcccgacctcaatttctccatgtggcaaatgaaagggttggatcacatcattgccttccagggcatgatacacaaacttgagatgcttttcattggtgtacaaatataccttattgaatagtcatgtagggctttttaaaatagatacagtattaggaaaaaatataactagcacatcaaactgatgattatacagctattattgcttagggagggggcaaaagtaggtagtgatattaggcctgagtaaatttaaagaaaaatattaagtaaatagtacagatattgcaaatgtcataaatgcagcgtgtgattgactgaatttagaacacatttgaatgagctgatctctaaggacctgtccatttctaggatttcattacttttgatgcagaaacatatgaatgggttattctaatgcaatcaagcctttctctcttctgtaaggcaggttttcaatgtaggctcccataatatacactaaagactttacattcaagggacagatacagcagagtgctgcccagctgatgaggcattgttgaattattgaggatagtgaatggagcttttgttgtttgtttgattgtctgctcacctcagctccaatttatatctggtttacctagggaatcttttgtacattgaaaaacttccttgcataagttgaatcatcaggccccacttcgtccatttatattttttaataaaaagaaaagacatggctcatccatccacgtctgcttcacttgaatccagagaaatgcaagcatgataacagagtttttaagaacacaggattttgtggcaagacgtggtggctcatgcctgtaatcccagcactttgggaagctggggcaggcagatcacttgaggtcaggagtttgagaccagcctggccaatatggtgaaaccccgcctctactaaacatacaaaaattagccaggtatggtggtgcacacctgtaatcccagctactcaggaggctgagccatgagaatccctcgaacccaggaggtggaggttgcagtgagctgagatcatgccactgcactctagcctaggcgacagagtgagactctgtctcaaaaaaaaacaaaacaaaacaaaaaaataggctcttgtgtcattctacctgagattaaatcctggtagcttttctaacctttatgtgtctcagtttctttgtctgtaaaatgggggataccaaatagcacctatctcactgggacatatgtaaagtacttggcacagtgcctaccataaagtaagagccagatacatgtaagctgttatcatcatcaccatcattgtctagcaccaatgcaggacaaattgccaggtgtggtggctcatgcctgtaatcccagcactttgggaggccgaggcgggtggatcgcctgaggtcaggagttcgagaccagcctggacaacatagtgaaaccccatctctactaaaaatacaaaaaattagctgggtgtggtggcgagcacctgtaatcctagctactcaggaggctgaggcaggagaatcacttgaactcgggaggcagaggttgcagtgagccgagattgcgccattgcactccagcctgggcaacaagagtgaaactctgtctcaaaagaaaaaaaaattctcattagacatttcttccacttccaacctccctttcacaaatttgcttccaatccctcaagaagttagtagcatgtcaaaatcacacccacccacttttccaaacaaaggttgttcagcaacctgctggcttctggttcttacagacaaacataaactgcctctcttacccggaatggaacctgcttattttaccagatggcctcattgactgtatgtagaagaaggaagctggcatttctcaagtttgaggatgctgcctagccagcgtcttagaacacagcatcctgtctctccttttcttacttcttttcattcctcatgactctctattccatgggctctgagcatcaagaaatcatttaggagacccaaatttgactcaatcaagtaccacgcatgccttctggaaaatcaagactctcattgattctgtccccattcagcctgataaacttcacagttaccctcattcctcccacgctgcaatttcttggctcctttggagcatgacccatgtgtaacatctggggattcgttgcaattttttggttcatctcctgggttatctgcagccacacagatatcccagatgttcatgtaagcagcagactttatttttcctcgcaagtttcctgcctaattgggttcaatctttaccaaccctcttttttcatagcattctatttcacgagctcttctttaaaagcttgctgttattgcctttggaaaatagaatgccatcatcttgaaaacctgccagtcaaaaatggggtttattgcttgcttctttatccttttcaccatgcacttatatgcattgttataatcagacccacaaaaggtaaccacatcgttggctattattgaacttttccattaatgggtaataaagaacccacacaaaatagcagctacacgaaatttaagtatttcatcataaacagtctcaggataattagaatggattaaattacaagagaaaatgcatttagttaatcttccctctaattaaaaaaaaaatccctagttttaagtaaagtgttcgtttttaaaaacatattttcattgtaatcagtaaaggagaggcctgtttggtccccagtgataggacgaaacatctgcaaagttgcatccggaaacatctgaatagctaccagccagtgtttttttggttttgggttttgggcaggggttttattattaaggtccttaaagaatgagtctggtcttttcccattgctgttaccaagggattctctacaaatagcctcattccatagtccatggtggcattcctttctgttctgagatcgctgatgatgtggttgactccccttgaccaacatgtgtcaagtgagaagattaactcagcagatgtttatatattctgaccgagctggggtaagagtcaaaatgaaactggtaggtgacgtgagaagttttcaagatagaacggacacgtactccagcccttcatgatgctattccaagacagataggactgaaatcaccctaagccctacgagtgtgtcccacaaataaggaatcattcacatcacctcaccaatttcttggctcatcccaactgcaaagctcactccacactttcatcccaagggcctctagaagtttccaagagtgtcttgcatgctcatatttaacccaatctgattttacaagcttagtcccttcattgaaacctgctgcctgagaaatacacttacagggactcctacagcactgcccctactgccaggatccatgccaaggttgtgttcccccgtgccagcagcaccattggtgctcacgctactgaagtcctgctgtgtttacacagtaaaggagagaacaccacactccccagctttatcaacgggtccaaagttcctttgagaagacaaaccttcactttttgccaatagtggctctcccatacatcaaggttttgtcccagcgctgagctgtcgaacagacaccacagagtcctttttgtatcctcacctctcctcacccttagacaggctctcaacccagggtagtggaggatgcttacaagttctttaagctcagccagtctctgaatcccagtttatactcagtcaggacccctaccatttagataagcggctcttaaagaaaatccttttctcttcatttaggttaagggttgccttcattttgagccagctcaactgcaaatgcaagagcccctgtgatctccctccttcataataatcgcatcccagttggaatggagaggggactgcttacatatcccctagactccaggttccaaacagtttcagcacagctctttgaggccactccatttaatcatgcatgagacccagcaccatgcagtgcaaactgaacatcacaaaaagtacgtcctgccagttcccagagaaagaaagggttaaccaatggtctagagacggaaagccccacataattgctgcccaggaggaattaaaagagctgagaatcctgggctatacattccaagtttagccaccacagcacctggtcaaattagcaatgaagttggttagaggttggcccagaagggtcatctttccaaagctgtaagcagagggagaagctctgataagtgtgaattgcatgtcattatttcaaaaagtatgctttaacttcaagagggattgccagacagccctgtctaggtgtctagaaacaatgccagggagtgggggagtccccaagattacaaaataaccacctcacaagcacagaggaaatgtttgtacctgattttattccaacaagttagccagctgtcaatcaccggtcatgctattgcatctgaaacacatcctgtctaatgacacaaaactcaaaacggtggcttctgctttgcagatagcatcctggcaacagggcaaggagattgtttccctatattaggtgtgtgtgagcccagaaagcctaaatgtcactgatgattgcaatccctgtgaataagaaaagagatggaagataccggaggcagtgtgagaaactagctttttcctattaatcccagcaaagcaggcaagtcaagttgggtcccttaagcatgttactgtcaacttcttgctatatgttgaatatgaactgatttaactttttgcttccatttaatggggccaagaaagatcagtatctattcacttacagacctactccctggaggtctgatacaggaagtgttatcgtatcctagagagaagcctagcacagacaacagtctacccaggattaagcagtttaaaatgcataatacacaacaaaacccactccaaactctcaatcatctcccacgttatgtttatagaatgtaacatcttttctctttgctattaacattctttgtcaatgcttgactatggctggttttatgcattccaagtttgaggcagtttggggaattatgtagcaaaagaattaaatgcctgagatttgggatcaaacaggactgccttcaaatccaccttccatcacttgcaagttgggtgacctttaacaagctatgtgtcttcaataagcctcagtttttcccgtctgtaaattgggaataataaataatacctacgacctactgtattgaggatttcactgatggagagcacttaacatatgcttgctactctgtaagtgttagcttaaaaattattaacaccacactttcatatctttactgtagtttcccaaatgtgtcttcacagagtgaatggctaagaaaattgtagagatagcaaacaacccaaaatttcccaaagggtccaaaattccagaaagagaagccaagggtgccacacctcatgtgtccacacaggtgctcgtggccctcctgctatttcactgttccaagacaagttccttggaacagctggtttctattccattcagcagggagcacagggagagagaggaaagcaggaagggacatggaaatggcccacttaggatccatttgctggttttaagaacatggtgttctaaacatcaataagaaagccacacacatcatccatggtaacatgtctggggtctacaccccctccatctgtttccagatgggcagtgataactgtattcaatcatttgggaagcattcattgagtgcctaacatgtgccagcacagtactgggtgtgacacatgagccacctctgtgtgaatatcaccgaggcagcaaggacaagaaagaagtggtttgcagagggtggtaatcatgggaactttagacctcagctgcctttttgcccacttgagactttgatgttttctaacccaagacacccttctcactgtttctatcaataatgtttggttaatttttcaacattgtccttgctcaagcttcccaaggaggtcaatataaggatggaggcctttaacttcaaatagtagtttaaattcatttgcaacacaatgtaattgcataaaagaaagtagtcaaatatcaaactgtatggatacacacaaatgactccctcataagtgttaatatcttccacaatggaggaaacttagttaaatcaaatgaaggtggcaactcattaaaatttgattttccctcctatccttttttatcttttaatcctctgtatatggcacaacttgttctgttaaataacactcattaatgaaatctcatcttctcttagctatatctattttatttattttgaaaaccttcagatgcttataatctaatttagttagattactgcttggacatctctaagtaggaaaactttgagcttttaaggtggaattactggcaaaggctagaagtgagagaaaccagttctcttcccatttccccttggtaggaggtggttgggcaggcctttcctctgtgaggggactgggcctccatttggttaatgagggcactatgaattaagtatctgtgttgattcagggaaggggagggagggaagagcctctagaaagagttgtaaactcaaattcccatacatggggtaggcgagaatgacgtaaagtgggtgcattcaacagggtgtaagaggccagggaggggtgacaaactggaaagtgaatgtcccacctatggagggcagacatgacccagctccagctgaacatggccatgtagaaatgcaagcctagtcttccccaaatttccaatttttcagtagaggccagatatttggattgttatgtatggtctcccaattttcaaatgctggcaagcaactaaaaatgtattaaaatgttgtgcaggccattcaaacaagactgggggccaaatggaccacccatctgtgactactgacacctacctccagggcaggattagtattgagtgaggaagcatcatttgcctggattgagactgggacagctttggcttctcttgtttgatgccccatctctccttggtaactggtttaagctggtgggagtctcattaccatgatacaatggtgatactttgcacttgcatggtgaattttctccaaggagctcaaaagactttgtgttgcctcagtcaacctcacagcaagcctgtgaagcaggcaggtagccattgcccccaaacacaatgagcaacaacagaaagtattttacacaaagcagctaggtggactcattggcttaaatccagcatctacactattggcaaatacagcattcaagaagcgtgggcaggatttcccactaatgcctcccctgccacccttttcagcttatcttccttccatctgctccaaatggcagctaagccccaaatctcaacaacaaataccagcaaaccaagccagtgactaatccctgttgtgtgtatgagtgtatacacgtctgtgtgcatgcgtgtgtgtgcgcccacctgacttcttagcatacccagcccggtacatctgcatccattacaacgtgtctctgcattggtcattggtctaatgccatgctctgaaatgctacttttgcaagtgtttaagacctaaaaacttcaaatggtaccttcaggattctggatacctgtattttgctaacggtgcctaataatttgtgctgcttgggaaccctgtgtccctttctcttccttatgctgataaaattacaactgtgaagtctttccctgacagagctagaatacggccctctctcaggctactgcaggttcataggagtggccatgtaaaatagagataagggccagagccgtgcagtggaggccagggacaagaatcttctctgagttgccttggatagaacacccgagaaagttggactgagcagcagtgactggggctcctccagagtcatcattttcccctgtatgactgggttcaagagctttgctacatagtcccgctgggctatgccttcccctctgcttgatggacatatgtgctctatgtcctgctctactcagagaattccttgggctttgcaggcatgacccagagagaagattccagttcagcagtgtaaacctgttgatctttttcccaggacaggacagcacaacacaagtattctgcattttctagattgccttgctcttccttctaaattgtctcagatcaggctactgatttctgggaacagttcccagcatgatattctactataatcattcacattctctgcatgcaggcatgccataaacatccttcagaggcagatgcaaaaccagggaaacacctggccattttaaatgcatgtgttggagagataactagacttactggcattggaactacaaaggctgacatatctaccagcttcccatctgatcccacaaatcagaacatgcttctttagagccagaggaaactgcctttcccagggatgaaaccttaaagatccagcagaaaagtttgggaagtgtctcttgatctaattggaacaaggaattgattaagcatccagaatcaagaatgatgtttcagctcttcccagtagatcaaaatcaatattgaatatttaaaaggtatatagatttaaaaagccatttctttatatacctaagtgtatagggagaaatcaacttttatttttgttgccttgggagaaaccaacttgtgctttccacttggctatgcagaatgaaaaccgtacaggctttcaaaggccagctgaggcttctctgtatcttcattcatcatgcctctcaaagcgtcagacggatcagtcataatttgtgtttttcacacacatacacaaacatttctattttggagcgattggagcgctatactggagccatctctgtcttagtagcctcaggtgcatacattccagaaattctaaaaagtcagagaagacacatatccccagtgctgccaaatccagtaaaaccgaaagagttcaggttgcatggtttacggacatcccagagaaagaatgtccattcaagcccaccaggctgaactagccatcaggtgaaattaactcctgactaaactaaattaaaaggtgaaactcagggaggcccaagtagacagaggtgctgatcattagggagtttggccactagagtttctactttcggccctgctcaggcttcagaagatgcagaggtgaaagtctagtttagctaagtgtagccggctggaccaacaggtcactttaagtcatgtctaactgatctcagtgctcctggaatggctttaccttgacatttaaatttcggcttccatcaccagtgagatggggttatgctaagtaatacaactttaaaatattttctgaacagtaaggcaaccattaaaacaaacaatttcagcgttataaagttatgtcttttaggagacattaaaatgttgctgatactgatgacagtgaggtaaaaagctgcaagccaaggctttgaggtgatagggcagaggccctgaaagcagcatgaggctgatagataaagaaggtagttgaagccaagctgagaatagcttcagaacctagaggcacacatggctgggggcattgccttttactttgtttttcctcccaggctgtggctttacccctttctcttaaaatcctgacaatacttcccaagaaatgtggtctctgacagaggcaactcctttggatgggccaaacgtggcacctagcagcaaaacatactattcagaaaagtcctaaatgatcccctgccttgaagcctggaatatagtagatgctcagtaagtgctggctggcttgagactcccctgtgtgtgagccctctccacccacctttcactgcccaagtcatttaagatagagaaaatggagaaccacactgcatctaaaaatagttggggagggaattacatgaatccactgtaagttagcttcaaaaatactgtgcttcctaggtgctagaatagcccatttttagggagtcaagagctggattcagagaaggagtagccaaggggctcaccaagtaaataaagggtttctcttgagttttggagcattcaggcttgaacaagggattttttggcctgtgacctagtgcataatttgcagtgggggtaatatcacccccaacacagtgaaaaattgttctaggggtagatgaaagtcttactctttttttttttttcagaaaccacatttattttggggggttcatagagaatattatactctcaaacaatactttataaaaattacttagtatgctatatctattctgtttgttacattttatatttgtactttctttcctaagaaatatactgctgctaataatagaaagtggaagaaaaaaggcataagcaggcagaagtggggggaaaaaaccctgcaatctttgtggcaataaaacattagattgcattaaaataacctaaaacgttagatactggccccagtgcctgggcgcagaactttgttgaaagggtattccagtggtaagatgaaaataaatcctgtgtcatatatttgccctatagcagaaggagggtggggtttaagctcaggaatcacagcctaaagcacaataattgtctggtttcctcaaaggagtttgcaagtttcacataccggaagtgtagaaaggctgaaaggagaaggtggggcaagggcatgagagtttctttcaatgataccagtataaactgtacgtgtctgagctaatattaactagaaatttgtctactacacttctttttttttttttttttttttttgagacagagtttctctcttatttcccaggctggagagcagtggcgcgatctcggctcactgcaacctccgtttcccgggttcaagagattctcctgcctcagcctcccgagtagctgggattacaggcatgcaccaccatgcccagctaattttttttttttttgtatttttagtagggacagagtttcgccatgttggtctggctggtattgaacttccaacctcaggtaatccgcctgcctcggcctcccaaagtcctgggattacaggcgcgagccactgcgcccagcctactatacttcttttaagtctttttttttttattattatactttaagttttagggtacatgtgcacattgtgcaggttagttacatatgtatacatgtggcatgctggtgcgctgcacccactaacttgtcatctagcattaggtatctctcccgatgctatccctcccccctacccccaccccacaacagtccccaaagtgtgatattccccttcctgtgtgcatgtgatctcattgttcaattcccacctgtaagtgagaatatgtggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgagttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaatcgccacactgacttccacatggttgaactagtttacactcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgacgagcattttttcatgtgttttttggctgcataaatgtcttcttttgagaagtgtctgttcatgtcctttgcccactttttgatggggttgtttgtttctttcttgtaaatttgtttgagttcactgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttagatctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttgcttaggattgacttggtgatgcgagctcttttttggttccatatgaactttaaagtagttttttccaattctgtgaagaaagtcactggtagcttgatggggatggcattgaatctgtaaattaccttgggcagtatggccattttcacgatattgattcttcctacccatgagcatggaaggttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctaggtatacaatcatgtcgtctgcaaacagggacaatttgacttcctcttttcctaattgaataccctttatttccttctcctgcctaattgccctggccagaacttccaacttccaactcttttttatataaaacgtgcacatatgacataaacagctatgtagcatatctttggcattaagggagaggaattagaggggaaaaggtctaaaaaggtttctaggatgggagataatgaaaaaaaaaagttgagaaatattaacctggtagaagagatgatagattgatccatttctagagcctcaacagaagtggcctcaagcatcctcagggaagacactgtttcttagaagactctgccaactcatgcttctgtctttatcgcccctgcctgctggctcatcttataccaaatcagtttggactgaaataaccaggcaggccaaataattgatttggtgcatgtttttaatttactgatttactgaattcccttttcagaaaataccagctaacattattgagtactaatgacagaaacggccggtcccattgctaagttctcagcatggctcctctcttctaatcctcatgtcagttttgtgaggtgaatactgttagcatcatcatttcacaggtgacaaaactgactcagagaggttaagcaatgtgtgaaaggcttatctgtcaatgagaggggccggtgagtgctaaatccaggtttacttgacagaaaccaggcttaatcattgcactttgcccccaggtagttgcaatggggttctggggagtccagcaatgaaatcagagaatatgggcatcaggggacccccccttcacctgtcgggaaagtcatcctctgcaggagtgtgtccttggtgatggaggacaattccccttttcactttaccagtgccccctggccaaagagtacactaaataatctccgattccaaaaatgactcactgctactccgcataggcgtagttggccaacttccctaaatttaagttgactttctatcagagttcacatttccaccaacttttcattaaattaattattcaaaacaattcagagttagcgttctcgcagcaactgtaactctgccatgactagattaaggcgtaaattgaacagcatgttttgcaataaagttaattttatattcaccagagaactgagttatagttgctgtgggaaccatcatttcgaatctcttgactttggtgcatttaaattctcaaccacagcgttgcacacagtagcatattttgcacggacgtttaatttgcttcacaccacggcctggctatcctgaacttggaaggcctgtcagaaataaacattgcagctttctagctttcccagccttctacttatcctatacctatgacactatacatagaaacagccaagaaaccaaaatgattccaattttatcttgaaattatctgtttgggggaagtgaatttccttagaagaactgagtctccggcaatgtcaactaaagcaggcaatgccattgcttttgtgtgcagccaggattctcatccaaggatatttttggttctgcgctgtattattcagtacacatggggtgacctctgaaagctccaagtccttgcatgtgccattaatcaagcaggcatgcacagccatacatcagaacttattggagctccggaaaagctaagcaacatttcccagagccacataaaacccgagcatccctaaatcaagacacattgcagggcctctaaaaggtacgttcagcagaaccggaatagaactcaggctaaatgctggtggtatggaattgggaacatgtaccaagtaaagacagaggcttgtttggaaggaatagcagaggaagatgaaactctgagatggttagagatgcgagcattccatccacgaggattatcgatttttgtagctttattggaaaaatcagtcatgctttctgcctcctgggaattgctctgctgcaatttgggagtgtgtacgtgtggaaactgcaggttagcagctgagtaccagctcccattcactgttcaattatccatttagctagaatgtgacttagcagaaacagactgctgttttgcatgtgtaagatgtatttgaaaggagggatttttgtttctctgtaaatgagaggatttccaaggagaagctcttgccttcctaagggcacactcattatgcaaaattgaagagtggcacctaacaaaagcataggccagattgttggaattctgaataccattgtacaagctttcaagaaacagaagtctcttatttctcatactgtgccacacatgaatgtacctcctgatcagaactactgcaaaatttgtagataaagaccctgtaatgatcagtggcctccccaccaagtccttgattagctaaaaactgtttaaaagaaagtttcagagagcaggatatgttcacgataattcagggttccctgggccacgtggatgggatgggtaagtgatagatggctttagattcatgataaaggtgggcaggggaaataccatgccagtcagagcaaagaaaaaagagtgaagaagcaggggagaaactggaatgttttattgcttctgtacaaggtaaaaagtgccataaaacaatataaaatacgggctcctctatgaggtcgtttgacacttactgttttgtgaccgcatcttcacaggatttagacagatttttggtaaggaatgtttgacagattaataaataaatataaatatatatgatagatagatagatagatagatagatagatagatagatagatagattgatagatagcacaagctttttaagcatgtctgagtgtcccattcgggtgggtcaagctggcctatagggttaaagagaacgcaaaggaactaaaagaccaggagtaataacctgggagcatgcttgggtggttcaaagagaccctattgccaagaattagatgaagctggccggatgaatgcagccttaaggtctggagtcgctgtgttaagaaaggcgaggcattcatttgctggagctgttcatatgaggttgtctgccctgaccttgcagatagagctgctgtgactcaatggttctctccgcgtctccactctcagccatgtctgtcctgatgcggcacgatgctcccctgtcaccctttcccttcatctccacatgttatttttagtatgaaaaagcaacttggagaggagggcagaatcctcacaaaatccagcttcagcaacctcatctgcctgctagttccaaccgaggagtctggtttgctgcatcaacaggggtagttggtggggagtgctgtttatagactgtatgtctaattgtctgcttttgtgtctctaaagccttccctttccgaggcatgttaggaaaacagaaacacatctagcattagcggtgccacatagagtcacagagcaggacaaatttgtgccctgcccaagcctccaccctggcttacccagatggtcctgatgggtccctgctggccagccttctagattctgtcctggccccatcctctctctgttcctcacccagcacaaagggagcctttaaaaactcatgtcagatcaggccactcctctgctcaaaagcttccaatgacttcttttcactcagaataaaagcaatatccgtacagtggactatgaggtcctacccctcactcactctgctacagccacacgggcctcctctctgtccttccaacaccccaagcactctcatgcctaggggctttgtacctgcagtttcctctgcctgtgctactatctcccaaatattggtatgatttgtttcctcccctcctttaggttttttgctcaaacaacttatcatcaggggcttccctgaccatcctatataagacagtcacctccatcacacacaacccccttgtggtcccctccccctacatttccctaaagcagtgattaccatctgacataccatattaatttttattgtttattgtaggtctcctcactgtagaatgtgagatctttaagaacaagactttgtctctttcattgactactgtatgccccttgtctagaaactacccggtgcataataggtgctcgataaataattattgaatgaatgaaagaataaactcatgagtctacagcagaaatcagcattttctaatcattcagtaaatgtttgatgtgggattggtatttctcccttggaggtccatttgtcccctgattcgcacacactgaactcaaggattagggacagggcaggagacagaagccaacactcttgacagggagaccaccccaccactcaggcaggacgccatgcgggggcttccccaagtaggatcctcatggatcctattctcagctttagaaatcccattttgtttctgttaacagagtggatcaagctctagactgactccgtcacactacccaaattcccatccaaacctgaaatggccattcagtaattcacagtgaggaaattctacatctcctgctcagtgtattctctccctaaagggaaatctatatgggaaatgaagttaaaagcagaagatttcttggggaacaagaaatcaaagcaagtaatatgatattctgagtctgccttctccctgtacagtcctacctggctaggggggcgcaaagtgcatgggctgagagttgcacaggcctggattcacaccctccctttaccacttgcagtgattatgaccctgggaaagttaattaacttctctgagcttcagctttttcagccacaaatgatgataataatatgtatttcataccatccttgaagtggctcagtgaagtaacaaggatgtgaattgctgagcatggacaaatggcaggtgctgttgcttgcctcccctctgtcaagccggacactctcacccgtgaactgaccctggctctctcttgctccaccacctccctctccacatcccaggcagactacccctttctgtgggcatgcttttctgagcctggttgagatttctatgccctgcgatccttgataatgtcacctcacacaactcttgcgttttaaggggagttctattgacaacttgtcgcatgcattatgtgcagatcttactcacgtaactctcaggaaattacctcatttttctcattttcatttacgtctttggagggcacctttctggggctttgctgtattgactacactgatcctattttaaataatagcattcagtccctcctcataaccaattcaagtgcaaatcaaaggctttcctaaaccacgcacagacctttctgccatcattggaggacacttttaataaaaacaacaacaataataacaggtatctgttgtagaatatttattatgtgccatgcatcatggattctctcatttaaatgtcagcgaccctctggggttctattgctctggttttgcaaatggagaaactaaggaattgaagagcttatgatttttacccaagatcatgcagccaaagggtgaagccaaggtttgaacccaggctgcccagattcagagccactaccttcactattccaagtactgccacatggtgactgaggtgacctgatgcagtggccccgggcagcagcagaatctgttggaagccctaacataccaaaacaagtgacttggtataaaagtctgcaccctctttcttgcccttgggggccttcatctctgtccccacctctgcctctgggacagccaatgaaaagagcctagtcctcactccctgttttcaatgatgaccaatgattccaggctgcctcttggggcacaagattttcagtgcaaaaacttggatcatccagggcaaattggaagggttggtcaccccagttgagaacaggaactatagagccattggctggtgtcaaatcctggctccaccatgaacccaccctgctactttggccaaattacttaacttttccatgcctccatttcctcacctataaaacaggaataatcgttgtacctacaccgtagggttgttgcgacaattaaatgagctaatgcatgtaggggatctaaaagtgccaggcacagagaaatgtccctgtgaggggtttgctatttttgtggctattctataaaaagctttctaaaatccagaatttcatcctggggcagattctttgcctagctcttttgagatctattagaaacatttagtgatttccttacatttcctgaagttacactaggagcaacaacaacaacaacaaaatggcaatttatggttgacctgattttacactagttaaaagagagccgtcaaccctgcagaagtaacaagtccgtgcccacaggcctcctcggtgttatttgtatttttatgaccctcctgtggctataaggatgctcagtgggtgtagaaattggatggttaaaaataacaaataagaaatcaaagtcgtgctttgtccctatttccatactggtaggtaccacattcattatttgctggacagctgtgggaataagctgcacaaggtacaacaacttgattcacctccaaaaaccaaattaaaccactggactctcttattattgtcatccctacctttgtgtaacacttgtcaccctcctaagctaccaacatgccttctcttctactcgctgggtaccctagtctgcctctttcagtccagaggtatctgcttcttacaagttgaaaggcacaaacccacatccgcattcatacacagcccctgtcatcagcttggttttgaacgctgggctgcaaccagctgcttcatttgcttagagaagtgtcatccttccagaggcttggggtgtggcctgtgggaagcttttccttttacctggctgttgaatcaagaacacagtgaagcagcaatgaaacaaagcacagtttgtttgtttttaatgtattcattcaacagatatctttaatgctctagggtgggaattaggaaaacagccatgaacaactgagccaaagcctttacacttgaggggtttggaggctcccaggaagatggacattgaaccgcttgctctcatcatccattgcacataggaatcacctgggtagcttaaaaaaaaaggaaagaaactgatgtctgggtcgcttcctcagagattgtgatttaattgggatgcagtttaacatgggaatttttcaaggctcccaggtgatttgaaagtgcggcccagttaagacccgttgctttaaacaaagggttcattagaattatgaggagtgctacagagaaggggaaggtggtgctataaaagcatgcaatggagcaggaaccctgagctggaagccaggaaagccattcctaaacaagggccagctgagcacaaggtgaatggctttagccaaagtgggtgcagggagcgtagttcagagagacacatctggaaaagcccacaagaagaatccaggctacagagaacagagacaaatgtgacatgagaagagagaaatgggcagggccagataatgcagggcctttgaggcccttttaggggtttgggacttaatccgaaagcagaggctttcacattgagcaggcgtctggatcccgggggcttgttataaatgcagacggctgggccccatccccagaggttctgattcagtagctcaagaatgtgtatgtctaacaagttcccaggagatgctgctgctggtcccaggaccacactttgagaagcactgctccaatctaaagcaatgggagaaactcccggaggatgttcagcaggggcatggcatgagttggggtgcgttttagcaacacggtgctattcacccccataactctcaaaggtaatgttccagggagataaagcaggcacccccaggaaagcacaggccaggctggactccagtgcaaccgggtgataacaattcagtcagaattcactgagtaactgacgtgggatttccctcccaagaagagctattttggttactgttgcctaaattctccatttcctcacatgatcacctactttaaaaaaaaaaaaaaaaaaacagtaagagcttgaaacatcaaaacaccaaaaagtaagatacatcttcctttctccttttttttgagacaaagtctcgttcttttgcccaggctggagtgaagtggtgcgatcttggctcactgctgcaacctccacccacccagcttcaagcaattctcctgcctcagcctctcaagtagctgggattataggtgcctgccaccatgctctgctactttttgtatatttagtagagactaaacaacggggtttcaccacgttggccaggttggtctcgaactcctgaccccaggtgatccacccgcctcaacctcccaaagtgctaggattacaggtgtgagctaccgcgcctggcccctttctcctctttattcaaatgtgaaaggattgtttttactgtttttacaagttcatcatttttctgcagccaaggctgagcctactgccttccttgtcccatgcagacagacatggtgctgatcagtgagaatccaggtgcatccagaaaacatgcagcctagacagctggaggcaaatttatatgacctcatggaagctctgctgtttctattgctgttggggttgtggggagtgatttctgccttaggagcaaaagccagccaatagaccatggaaaggatcactggcctcctaacaccccaacccagcatcccccatacttgcatctacacaaacccttaaagacatacagacaccactgaaacaaagaggaacatctgcctctctcaatttgccacgtcttttctaacaaagcagagtcagctgtggacgtgcaggttcatggctgcgtgtccacgccatttgtgcctagaaacagagtccccgcacagctccctcccgcacacacgggcaagcaagagggacaatccctgccgttttccagagaccagagaccagggtgattctttggcagccggtcttccaaaactagttggagattttccccagagcacctcgaagcatcagattaattttctgagcatttgccactgctgttcagtataaatggctacctgaacccctggtgatccccgatctccaacacctcagctattttcaactacaaagagctctggaatgtaatggcagactctattattaaataatgtccagtgtatgtgtgctctttaattccaacaatgcacagctccagggaaaacaaaaacaaaaaacaaacaaaaaaaaaacagtgatatttaaaacagttggtgaaagggggggggggtccataattaagttaatattcaaaagcacaattcttcccaagagaaagggcccccatgtagtctaccttcgtgtctcctgcacctcataattgcccttagctccagtgggttttcttctcactcagcccgtccaatgtggtattgctggagttttggctggtggtcattgggagaatgagaatttcttaggctgtgacacaatcacacacggaggacacttgatgaaccttcattttttaacttgaaaaaggatgggttcttgtttttttccctgatctcagagtgaggcaaagagaaatgacctacacttcagcctatgtgctaaagggaaagcttaccactaactatgatagctgtcataacaactatatagacactgacaacaattagtgccactatctactgagcacttacaatgtgccaagctctgttgaaatatttagctttatcattccatttaatacctctggcatctgtaaaaaaaaaaaaaaaaaaaaaaaaaaaaaaaattgtaagtacggtcttgtgaccatccctaaattatttgatcagcacatatttcttgaatgtctgttacgtgccaaccgttcttctagaccctgagaatatctcaatgaacaaaagaggcaaaactttctgcctttctggaagctgtatgctattggaagagaaaataaataagattaacaagtaaaatataccattttacaaacaggctgaggctcagagaggtggatctaccagcccaagctcacacagacagtaagagagacatccagattccattcccagaactctgactccaaaccaggttaaggttttccccatagttaaaaaaaaaaaaaaaaaaacactttttttttttcacctcagtttaacttaggatgtaagttctctcctgatggtctcttgaagcaagcagggacatctggcttctctggctttcactgtcatctgtctgcatttccatgcagcctgttttatgtttttacttgcatttccatctggatagggtattgccctttatgcttttcttaggcatgcttgatgttgaatattaaaatcctatttctctcttcgtacccctcatgcattattagccacttatttctacctttaaattgctgcacatggcagaacatttcttgatgcttttttagaaaagccttttatggtaattatagctttcttcaagtgcatttatttttccctttttaccgtgctgtagacattactttgttcatgcctaatttttgttaaggcaaaaagcctgcctagctggtaactgtgtggacagacttttttttttctagtggttggaattttatgtgtagaaccttggaaactctctcatttccactctgccaaaggcatcggattcagccagagttattcgttcatcatttcccccaactacttattgaatactggcaatccaagagtaaacaaactagacatggtccctccctgacagttttacaccatagcaggaacgcctggggcagccgttcggttcacagtaggggcaccattcaaagtgtaggtaatgacaacgggcacatttattatgacacttttccagcaggtgacagtaaaatgtcttaaggaagagctgctacatggcctagcgagcatcaaggaggtaccagccaattgtgatacagcggggcgggtagtaccacataaaggaaaggataaagatgccatgactggtgctgctggcatgagcttgggagctttggaaaagcttccaggaggaggtgacttctgagtggggatttgaaggatgtattgaagttagggaggtgagaaaagtgaaaaggaaaggccgagtggcttaagtctaaccaaagcctaaagtgatattgagataggctgatgtggtaagagtcagttcatatgaagtcagcaagcccaattaaggacttcagactttacccatgggtcaatggaaagctattgaagtgtttccagcagtgtccagaatgtgagacatggatgatggtacaagactggaggcagggagaccagttaggaggtttcgacaagcatctggaccaaagatgagggtggctggggttaatgtggtggcagtaggggtggaagtagagcacagattccaagatatttaggaagaaggacagataggagttcttgcagttaagaggaaaattaggcagaacttggttggaattagatagaagagacaagagaaggtaggagaggaggggaacaattaagaatgcctccaaggtttcagtggtgggcaatggggtagatacctggatgtgccatgcactgctcaaggggtcagagtttgtggggaggaaaggtaaagagtcagaattcttttgagtttgaggtgcttatgagtgtacaggtggggaatagatggctatgttgagacgcaagttggagttcaggtctagaggtcagaagacttgagttgaagatttaggggccatcagaatataagggtgtgggttgttgtttgttgttgttggtgttgttgttgttgttgttttgagaccgagtctcactctgtcgcctagactagagtgcagtagcacgatcttgactcactgcagcctctgccttccgggttcaaatgattcttcagcctcagcctcctgagaagctgggattacaggcacctgccaccacactcagctatcttttgtattttcagtagacatgagatttcaccattttggccaggctggtctcgaactccggacttcaggtgatccacccacctcggcatcccaaagtgggtttttttaaatcccaaatttcccatcagctctctctctataggttggaatgtgacagaactagcccattaatatcactggcgtccttaaaaattctccctgggaagaggacttttgatctcagagaggaagtctctattatcttctcatgattctcagaagagtttatagatatgaggcaggcagacagaaaagatatagtacgccccgattgtttttattcattcaagcaccttctatgtgcctaaaaccaggccaagctctgggatccaacagcaaacaaccaaatcttggatctcatgggggtttatgtctagggctaggtttctcaaccttagcacagttaacattttgggctgtatcgttcttcattgtggggcctgtcctgtgcattgtaggatgttgagcagcatccctggcctctacccacaagatgccaatagcaccctcctcaaattgtgacaatcaaaaatgtctccagactgggcacggtggctcatgcctggagtgctgtaatcccagcactttgggaggccaaggcaggcggatcacttgaggtcaggagttcaagaccagcctggccaacatggtgaaactccatctctactaaaaaaaaaatgtgtgtgtgtgtgtgtgtgtgtatatatatatatatatatatacacacacacacacacacatatatatgtatacacacacgtatatatatacatgtatatatgtatatatacacatatatatgtatatacgtatatacatatatatatgtacgtgtatacatatatatatatacacacaaaaaaaatcagctagatgtggtggcatgcacctgtagtcccagctactcaggaagctgaggcgggggaatcatttgaacctgagaggcggaggctgcagtgagccgacattgcgccactgcactccagcctgggcaacacagtgagactccgtctcaaaaaataaaaataaaaaataaaaagtgtcttcagacaatgccaaatgttttctggagagaaatagggagacaaaattgccttagttgagaaccactggaatagggtcatgatagaacctttagtctccaggcagccagctctctctagctccataaaagaggaaccaaatgggtatgctttaaggggctttatattggtggtcttggagacaggcagtaccagcctgaaatccagaagacttcctataggagacttcttgggtgccccagtataagcccattagcccaatccaacttcggttatagcatcctctccagagaaaagcctctacctcatacccattttgccctccagactaattacttcctaggttttgtttttccttaagcagaagctggctttgcactttacaaacacaaaggatcacttcctcagaaggccaccagtagaatgaacttgtgctggggttagcttggggttgcctagcaacgccatgcacctaccagggctgttctcttcctcttcaagctaaaagcaaagtcctgtccgttaattaccagctgccctgaaacttctcagagatttgccagcttcctacttttcttgttttcatcttcctcatgtgatgtggagaaaacctgctactgtggtctgtttatttcacttcagttggtctgcaggggcaggttggggaggaagcaagagaggaagagaaggggttaaaaaaaagcctcattcaatctagaaatatatgtattttgagtgcgtatctctgactgacacgctagtgttttttgcagatttaaatttgatgtagcggacgtgggtttcctatacaatgaggcttctgttgacacattggacatgaatttagtcagacatgagacctcaaagtagctaaataacaaagctccaccaaatagataccatgctgagcaaatgttggtaggtctgtcatttagtgtattttccgtgatccattccccaaaactctaccagtagaaattgttaaagctgaaggtagctggaggttggagaaattctcttttccttgagaacctgtgaaatgtcccttggtcttttcctactgagctcattttgttcctgcagaaatgtttgtggcatttctctgcaactggggacggctttccctccacacaccgtctcacggtatgaagtgaacaggggttttccaggcaggaccacagtcaggaaaagcatggaaatgtgaatctgggctttgtgaggagaggtgtgtagaccaaacaagcctttccaggtgtgcaaacactggtgctttacttgcctgctggacttagtgccaggctgtgcaacaaaagaaaacagattccctggtaagagtctccttatttgccctctcaagacagcttggcttccctagggactggcccacataggtctcttctgttgcatgcactccttgctcagatcctaatccaataccaccttctggaaaggatgagaggcagcaagcactgaagagtgaaactcctcttcctaaagaagtaaagcttaattgtatacccttgagaccttgcttcttaggaagatgcctttaaattcccaccactggccaagcataatgcttcatgcctgtaatcctagcactttgggaggctgaggctgaggctggagggtcatttgaggccaggagttcaagactaacctgggcaacatagcaagacccaatctctactaaaaattaaaaagaaaaaatcgctgggcatggtggcacacacttgcagtcctagctactgaggaggctgaagcaggaggatcactcaagcccaggagttcaaggtgtcagtgagctatgatcatgccactgcactccagcctgagtgagagagtgagaccctacctcaaattcccaccactgccatatgcatatattaggtttatcagcattctcataaggggtactcaagagaaaagaaggaagatgctaggtgaaggcctctggaacaccggagagaagagcaggggagatgcatgcttttgatccacaagatttgggccaggaaggtttcaaatcaattacctccatcattacaaagctttttatcctctgccatggcccaatccagcctgcactttatgtagtttaaaaatagatgtagaaaaaaatggaaacagagatggtggcagaggtagagataggactcgagatagatattcaaggaaattactttctggggaaaagtaaattaatggtcactggggtatatttaaattaagcaagaaaacatatcccaagtgcacaactctgcaaatttactagaagtcatcgcattgtacacttaaaacaggtgaattttatggtgtgtaaattatgccccaacaaagctgtgaaaagaaagaaaaatgaaaacatgtctaggaattcttgccagcacgtaggttttgtgagtgtggccacatcctagtagttctctgcttctctcctacctgttataaagagtcacggaggctctgctagtgagacctttcccatgtctctttagtgtacctcctttctccacttttctcccccagtctccctttgtccaaactcaggtcaggagagtgctggctgcaattgttttgggtcctggagtaattagaaaattacacaggcagccaattttgcacagacacgtgagcgcatgtatacacacacacacacacacacacacacatcaataaaggaaaagaaatccacaaaataagaactactcctaccccaccacccttccccgagcacatatattttttcttctatctttccccaattcgtggcacccagcatctatccactccacagccttcgaatcctgcagtatttttaaattgtgccataaatacgttgagtgataagcagccaacatctttaagtgccccttaaaactaaatattacctgtacaagcatatgaaaatagcccagcagaaccatccagttttcagtcatgagaagctcatgataatcctatgtaaatatatctttaaaactctgaaagatggcgggcactttgcctccatcctgggttgatagggaattttttctcttctacagaagagcacttcttaaaaaaagagagaaagaaaagcttcttttcagtagcatcaatcctgagctattggctggaaaccacagcctagctagtctggttgtcagctcagcactggtttagttgtctgggatgtgcattgaactccccgctttgggaaggttgcctctgacctaggtcagttgtcactggggatcccctgcatctgtgaccccactgtgtcttgctactgcatgcgttgcctgctcccctgactctgtggaaggcaggcgcgggccccactgtgaggctggcccagcggctgccctgcggccttgctcccctctgcatggctcccctgcttccccagcgcggcctcacgtccctccttctcatcctctccatttctccaaccagatggctgccctgacttgtgcaacggtaacgggagatgcacactgggtcagaacagctggcagtgtgtctgccagaccggctggagagggcccggatgcaacgttgccatggaaacttcctgtgctgataacaaggataatgagggaggtgagcacgcgtcttctcattcccagcccctaagagcagagcgttgtccatgcttttgtcataagtcatttttcttcggaaagacctcccctgcactattgtcaaatgttgttgtaacattttctttgaagcaaatgcagcagagaacaggtgtccttatgccaggggggatctctgggagacaccggctggaggcactgggggttgatactggctgagaattcccaagtgcccattgccacataaaggtggctgggccctggcgctgccttcagggtcaccagtcctgccagaactttcagggctgcggataacagtcggtgacaatgaggatgacaatctatgcctaacgcacaaagctgtcataagcaatgcctgctgccttcatccttacagccctttgagatgtcactctacagatgaggaaaccgaggcctgaagagtgattaagtaactttttcgagataatccaaccaccattagtaaaattgagacccaaacccagctgtggctccaaagcgtcttttctaaccagtagttggcaaactatggtccatggaccaaacctggcctgtaagctaaaaatagttttaacatttttaatggttggtggaaaaaatcattaaaaagaacaatatttgataatgtgaaagttatgtgaaattcaaattttgatgtttataaatttttaaacagctttattgaggtataattgacatataaaaagttgcgtatatggccaggcacagtggctcacacctgtaatcccagcactttgggaggccatcaccaccatcaaggccataaacatgtccatcgcttcccaaagtttcttcctattgactgaaccaagggttgggctgcttgttttcaaggtccaataacaagatgcagacacactgggaaagtaaccagaaataaactctcccaggtacagggagaaggccagagataattcaccaggccatctctaaattacaaagttttccagtgtgtatataccttctaagctatgtgtctacatgtaagtgtgcattcatctgaagacacaaatgattgattccatctaatctataactaaggtttgggtcctggacaccttcctccagagcctcagtaaatttgcttagcctagatgggtcctggtgccgggggtgattacccttatcttttctccagctaaggtgtggaggtctggggagttcctttagactcccagtaaaacttgtttaatcctaaatgggtcctggtatgaggagcatgagaatttcttcattatcttgtgaaggttcaaggcccaggaaaggcctaggcaagactcttggtgagcttttgttacattccagcctttgtgtaagtgcgctggctctttccgcctttaatatttaacctaaccattcattcagtgccaaaacagttgtcatggaggcctgcctgttcagctggtggtgagacctggcctgccacactgctctctttgtgattattgtcttggggtgattttttggttttaagagtttttgtggtaagaacattttaacgtaagatctaccctcttagcaaattttgagtgtacactactttgttagccatagatactatgctatgtgtagatctccagaatgtatttatcttgtatcgctgacactttgtaccccttaacccacacctctccatttattggaatacagccatgcccatttgtttatgtttggcctagggctgcttgcactctccatgtcagagtggagtcaaagcaaaaaccacttggccatcaaagcctaaaacatttactctccggccctttacaggagaagttttctgtctcctgttctaaacctctgagctgaatttccccatgttccttcctgatggagtgctaagattctggggctaaatgaggttgggttagcatgtgggccacctaatctcctaagaatactgtggaatgttccgtagacttcagtacaggtatgttatccacccccatcaaaattactaactgatcagaattcactgggggcagaggttgtttcagagtgtaggaagatccatgagtccaatcatttgatttaacaaaaatgtatttagtgccaccttggaccagtcattgaattctagggatatcaatgaccaagtcaaagtcagccactgccttcatggccccaacaggtcctttcagtggtgtccagagcagggtggaatccatcggggtggtggatgagagtattagatattctatttttattttttctcatcctcttaatgggtattttgcagtttccataatttatgattgccattgtgcctgtatgtaatttgtaaataaacagatgtacatacactgataggagtacacaatcaaaacagtttacagacctgatgtggtttacagagctcccattcattcattttctctttcctgaaacagagccaaagagaagtcactttaattcattttttaacaagttaaggcataactacataatgcattttttttcaagtcagaatcgcacgacttttgctggtaaggttcactgcttttccttctgcctccctggcgatttcattgagcacagcggttgcttacagatcagcttctacttccagaaaggagctgctctcctggctcccttccccgttcctggtgtcagcagctgaaagcataacaaatggctggaatgccacacagaggggagagaggaaactctgggggactgtctccccagcataccctgccttacccacctccctccccaccagccctacccctgatcccagcttccacccggccaaaaccaaaatcctgaagtgatggagctaaaagaggctcacagggtccccgggcctaagggttgcccaccaggcacaattcaggatcccccccccaaccccccccccccccccggctggcagagacaaagcagtccaaaggcagggcacaaaagcaaatgaggcagtggtgattatgctaaagacaataatggccttgttacgggaactgttaaagcaaacctcccaaggaagtaattaaccacaaagaaaaaaaaaaaaaaaggctgcatggtgtttatgaaaagaaactcccagttaattcagagttgcttatgtcaggtgagaggggtagacaccaattctctctcacctggcataagcaattcacaattaactgagttctttttttggaggtgattcctcagtgtagagtatcctttttatggttagtgacttccctaggaggtgtgctaagcactttgctgtttattgataaatattaaggttgctcctcatcaactccagattcaatcctgcagcacactaattatatcactctttttgtttggttggggtggggatgggagttctgccctcgtctctgtcctgcttcgtgagttatcaggaagggctatgtgagtttataaacctggcagtgggtcagagaggcacccgggcagaacatgaatgcagacccggggagcagcagcaatgaacacatttgttataaatttcatgaacgagcaaaataatagagctatctaccaaagtggactggaaaagacaaatcacttttccatctagaaacactctactttaaaaaaaagaatctgtttgaagggatatgtattttttattttaaactgagatagatatagatacaaataacagatagagatatttgaaacctttaacagccttttttcaacctgggttcctctatgagagaattaagccctaatactttatggccactagtagttctgaaacttcagcatgcagcaaaaccaccttgattcaacacagagtgctaagccctattcctagagctcctgattctctaagtctggggagggcagtgcaagactgaatttctagtaaatatcccagcagtgctgacgcaggggacgctgatgcaggtcctctttgagaaccactgtcctaagccatccattctatgtaatgaattaacttctctcctatgcatctagaatggtactggataaaataactcctttggaagaactgagaaaactttcactcaaatatgctctgtagtcagcagtgttgagatgaaaatccctgttggagaaggctgccttagaatatccccaccaaaacagtttatgccaactccctgccttctcacccccttggctttcaaagtctccagacacccccagtcatgtgaccgccactcatgtaacctcaggaagcaatggctgattctgaagggacaagccacacctgcccatggccactaaaaagaagtggaaatggttcagacagacacggcagctggcagactgtctttttaatagtgagagatcttcacttgaactgctcaccccaatttgaaaaagaagagactcaaagaaatatttttgcttacagaagacaaataccagctcattaaagtctgagaatacacacaacatgtgcaccaagtgacaggcggataatatttaattatcaccaccaagacagaggtgtgagatttagttcatcacagccaggggtaggagagagggtgtaggtttcctctaaaagtgggaactgcaaggtgaggaggcgttgttagactgtctggcctggtgagacagtccttacttcttccccactcccctttatcaccctgaacttagagtcaggagccctagcccttccatcatttcaagccggcatcggagtgagtctgaagctcctgtggaatcctatgagatgctttctcccatctgtgggcagcggtgacagtggagaccaagggaggtgatgtcataaccacatcacctggaggtagggtaggaggaagcctttttaggctgagcctgtcccgtcaccccgcatcactttcttccttactaaactaggagagatgtcttttcccctcgttccgtttcaacacagcactgaaagatgttttgcaccttctctttcatgtccctggtttctgaacaggtgacactgtatcatcataattgattgagggcttgggcttcagagtcagcctttgtattccagctctgcaagtcactttgcttctcaaagtctcagttttcttatctgtaaaataggcatggcaatgccaatgtcactagctggtgtgaagtttaagtgagaaaatgcatgtgatgtattttacaagacacctggctcatagatgccctcacacgttggctgctgctagcattaacattattaatattaatgttattttctagaaaggagactgaattcatatagatggaacccaaccaataatttttccagtgtacacaaccacaaagattctaactttgtgcttattgaactttagtgctgcgtgactgtgtggagggcttgtttaaaagtcagatttctaagcccccacctttgaggttctgatttattagtcagacatagaatgcaggagtctgcacttttaccacgcaccccagagtgtctgatacaagtgtgtttgctctgcagatgacattttgagataaactttttaaaataatggtgttccctgggtgggctcacccagcctaatgtcatagtgcttataccccaaaccctttcccctaaaatccccagaacacaggagtgcagtgaggagaggggaattttatttcaggaagaaataagtagctgaaaagacatgaagtctgggcatggtggctcacgcccgtaatcctaacactttgggagaccaaggtgggtggattacttgagctcaagagttcaagaccagcctcggcaacatggtgaaaccccatctctacaaaaaatagagaaattagccaggcaggcatcctggcatgcgcctgtagttccagctactcaggaggccgaggtagaaggatcgcttgctcaggaagttgaggctgcagtaagccgtgattgtgctattacactccagcctgggcgacagagtgagaccctgtctcaaaaaaaaaaaaaaaaaaaagacatgaagatatctttatgtttaggtcctttgtgaatgacttcagtatgatttagaagttctccattcttgggtggagagttggctgatgtttgtttcaaagtttaaaaacctttaattctctgtcattagggtatgaattcgtctatccactcatccatccatccatccattcattagcttattcatttatggtttaacaaacatttgttgagggtttactaaatgttagaccctgaaaataagcctttagaaatactaaagcaaacatgacatatgtccacaaagagctcactatccatctacaaagatggataaacacattgttattattattattacagtccagcatgtgagaggtgacagagatggaccatcttattagacggcaatagttcagtgggagcatagcaaagggactgtcacgtgtatgggtgtcaggaacatgacatgagagaaagcgcagcccattgttaaggactggctcttcagctcgtctccatggagtgtcctcaaagccacaaatccgtgtgatcagtaacccgtggtagaggctcttcaggtcactagcagttactgcagttccctctctaaatgaagcactccactctggcttctctgcagagcagtatttcccaccctacctccatctgcaaggctcggttccttggttcactccaaaggaggctgccttgggttaagagacgtggatcctggcctgagctctgggcatgccatccaaggcactccagccaggtctaaatgaggagaaataacactggagtctgtccaaagcacttggaacagacaaaactcacccctcgcccactgcctcctcccgctccctccccatcccgtagccatccaaattggtttgacacgattcaggaatgctcttccggcatttatctcacttgctaattaataactcaccttgtctgtgcatttagcagagccaagctagggacttcagggactccaaaagggttctggttcccatgcccaaatagtccagtttcttcctccaatgagacacaaagcttggtgaacccactgtaaatgccttgattaatgtatcccaatcgtgttgatggattggttgggtgggggacagcttaaaaatacaatattgagctattaattgggttggatgaggattccctttgcagtccaaagaccttgtggcaaatgtagctggagccataaacagagtccctgattagctcccagagagaaaagcaatgtctctaatgcttaggaggaaaacttggccttgaggacactgccagctggccagatgctgggtctctcttctttaggagggaagcagaattagcctcaactgagatcttcagggaacacatagcaacagggatctgaagttattctggctcttccagttgaaataagatctttgacttcctgggcatatttgactagagaatcttctgtttagaaaactgtaaggtaggggttcagttttctcttatgctactgaggtttagaaaaaagatagaaccagctgcgcacggtggctcacacctgtaatcccagcactttgggaggccaaggagggcagatcacttgaggtcaggagtttgagaccagcctggccaatatggtgaaactctgtctctactaaaaatacaaaaattagccgggcatagtggctcacacctgtagtcccagctactcaggaagctgaggcatgagaatcgcttgaacccaggaggcggaggctgcagtgaggcaagatcgcaccactgcagcactccagcctgggtgacagagcgagactccatctcaaaaagagagagagagagagaaagacaggagggagggaggaaggaagaaaggaaggaaggaagaaggaaggaaggaaggaattctcttgcatataaaaataataatcagtaagatttttgagagcttacatgtgccaagcactgtgctgagcttgctctgcacctgggttacgggaacagcctcccaagtggtctccctgcactcctcttgccgtctgctctctgttcctccacacagcagccagagggagtgttttagtaggttgatgcaaaagttattgtggttttggccattgaaagcaattaattttgcaccaacctaatacattgtaaatctcatcattccatgttctcaaagggtttctcatggagttagaatcaaaatcagctgtttttttcaccttggcttagagggccctctgtatatcccctgccttgtctctgacctgtcctcccccatcctctccggaagctctgcctcatccactctggccggtgtttagactgcacaagtgcaaagattagttccacccgagggtctttgctagtgcaaggtggaaatgctcagtcaaggcacattgtatcactggctcaatgtagtcattcagttctcagctcaaatgcctcagaaggacttattacgaagtcttcctctgtgtctctcccatcaaccattagtgtttcctttatggaaatatcacactcctaaattttctcacgctgttattcttgcagattgtctgtttcttcacactagactgtaagttcaatgagtctatttcatcatattattttcattatacagataaggatacaaaggctcaagaagttaagactcagaatagccctttcagctaaccaccatgatatatggcttttctcctttaaaaccattggctccttttttctaaaacactcaaaaaatttggacagtgtttctgaagaagattcaaacaagtacagaatgtgtgctgctgcaaggaagccttagaaaaaaacacctcaaagacaaaacttttccattgaaaaccttttcctggtacatgtaattgaccattgaattagttgtgttcttttttaaaaaaaggggtttaaagtttataatttacccaacacagcactttcagtcttttttaatcaagtctttattagtttaaatggttattaagtgtctcttaagggattatgtttttttccccctgattagatgacaaatcaaatatccattatgaaattgtgatgaaaatgcataatctgaaaaaaaattttaatcatgtaaatcactatggacttattttagggaattaaaggatgaaaacgcagatttcactggtggcaaggaggtgatattgatagcgttatgttggcttcctgtatttgtgctttggccagagccttgccctagatggtggcaggcacacccttgccatcccccggtctctgtgaccagcatttgaataaagaggcaaggtcctcgtgccatcactagctctcttgctcccacagtcttcccccaagtccagaccagtggttccctaccggggcaactcgctcacccaggaacatctggcaatgactggaagcattcacgagtcatggtggtggggaggtggggaggtgctactggcatccagtgggtagaggccagggttgctgccaaatgccctacacacataggaaagccccaaatcaaagaatgatcccacccaaaatgtcaataacaccaaggctgagaaatccgatatagacatttaatgtcccaggaacacatctgtctgagggaccagagggtcccaaaacaggcagtgtccatgggcctgatttgaaaggacgtgatgtccaaaaccctaaggcattgagcccttactaagggccaggcccttgctaaaacgtcacccacattgcctaaataaatcatgacaatccccacaagagccctgggagtctttcattatcctttatatagaagcagaaactaggagccagagagaacaagtggcttgtccaagctcccacggcgaaaacatagccaagccaggattcagaacctgggtcaagaaccctcctctgggcccctcacagcacctgagtgtttgttgtgtttgggctcagagcaaggcagagcataagtgcttgaacaacctccgcccctcagaaacacgaattttgcagcatgcttaaaaataccatcggcgttagcttttccctccggttttggatttggaatgcatttttgccacaaagcacttaggcactgaaatgccagggggtgagcaggggagagttgagcagctggactttaaatagcaaggtgttagcaagcagcacagcaagagcagctgcccaaggcctgtgctcttttctttgactttctatcttctcagccaagagctctgggggattggagaggggccagaactctgtggccaaatgcaaatccagagaaaactgcgaggtgttcccccaaacctctgtgcctaatgcttctcttcctccccactcacaaccaagaccaaacctttccaaggtgattctcctcctctgcctgtcctcagggtatgtcatcatggagctctccccacctccttcagtttcctggaactccatggccacgtgcactgaggcacactacctctttcatttatgagaatcacaggatgatttcatttatgggagtctggaaatgtcagatgcaaaaaggctaaactatagagtccccggcagctgcaaaacccaaggagggaagccacttactcaaggccaaggagcaggcagggcagacctgagactggagtcctggtttcctggctcaaaatccagtgtgcttttgtcaatgctgcgttgccaccaaaaggactcagtgacactcaggagaatgggtgcctgccactactggttggagccaagatctatttcagacctgggacctagattagaatgagtggagatgcctagggtacctcacagtgagtgtcgccttcactttcgccccctcagcccctcattcacctcttcctagttgcaaccctgctcagacctcttgtcattgatggcaatgacagaaaacaccctcccccacaccagccacactcctggacagaccactcaccaccaaaatcatttattcatccaacaaacatataccaagcccccactctgtggcagggcatgtgaatgaataagactcaaactccgcccataaagatgctctgtctggtgggaggtaaaatacacactaaagctgtcactgcagagccacattttaagggtccataatagaagtaaggccaagagaccatggccgctcacaagagaggcactgaagacttccaaaataggtacagcttgaatcttaaaagataaaaaggaattaggcaaggaaggagggaaaagcattgtgaacgaagggaacggcaaatgcacagaggcaaggaacagcaatgcctgtgtggggacctctgagaagcctggtaccttgcagcctagtccacatggagaatggaggaggatgaggctagaatggggtttgcgtgcagtgctgggcagagcgcaatacagccatcatatttgtttgtgcctcccatcaacatagcatctcagtcttcaaaattgcaaccatgcctgcccctcagacagaaggctgatatatctgcttgagttattataaacacacacaccacagctgagaagcaggcgtggccttttgttgtgttgcctccattgcacatgggcattctttctcccagggaggggagacagcctggcagggtagtcaagaggctttgggatttgagcttcaggtcacgtcccagctcctccacttcctcaagatatgagcttaaatttaagctttgtcctctgtaaagtggagctagggctaatttctacctcataggatactgtgaggcttagatgagttaatggatgcaaaacagtcagcacaacggttcgtatacatcttatacgtcagtgagcatcagaatcacctggaaggcttcaggcacagatggctgggccccaccctcagagtttcagattcagtaggtctggcaggaagcccaagaatgtgcatttctcacaagtgcccagatgatgctgttgcgttgagaaccactgacttagcgtaatacgtgccttttgaagggaagctcaagtgctggcagagggattcctccgagcgtgtcagccctgggccagctgatgaggagagacaggccaaacagctctgcatcctgaggcggtggccacttcattagcatatggaccttgggtacattcctgggttcactgaggtcctttccacagaagcttgtcatccggagaggagtcagggctccaacttcccgggatccatcctcctccttcaagagtgttggaataaacgaaaaatgtggaaggagtttgctgggagagagcagtggtagctggccctggttccttgccttttatgacattctgctgcttctcccatgccccctgccccacttaggacaggtggtgctgtgccatttactgatggggtccacagactttggaatcagacggacctagctgtacattctgactcaggttcttactagctgtgcttccttgagcaaaggacctaacgtgtctgagactcagttctctcatctgtaaactggaaacaatgatatcaacttcattggcctgttgtaaggtttgactagaaagtttatagacagcaacttaatgcccctttacttaaatggctgctctaagtgtttgcatctccctgtatgatgtgagttcagagattctaaaaacatacactgccttccaatcaaaaactcatcatttcaaataatacatacatttcaaaatcaggaacccatcttttggtccctgttataatacatttccctcaatttcatccccactggctctggaatgagtgctgtcttccctcagaggtcatgaaccggtgacccccaagctgggtgggtcactgtcatgttccctttagccacataggcttacaaaaatctttgcattcattgctgacatttagaggatttcatttaactaacaaagaagctgagggcctagaggttaacttgcccagagtcaaacagtggaagggctgggattggagcccagttcttttgattctaaatgtcttgttcattcttctctcagaccctttttctgaaagtatttttatgccaggtgtgccagagtccaaagccactaggtgtctggggttatgctggaaaagaggaatccatggagaagacagatgcagaaaagagaaacagcagtccccggagcaagcttctcctgctcttacttctgccatgctcactcagaaagcttgtggctcagggagtgtagaaccagggagaaaaccccagcctacctggggtccatcactcaaagtcttagccctttgacgagcaacactaatatcatcactacccaactagcacaccgtctgccagggaggccattgcataggcctttgacatgccctctttgtctatgcatcttgccacacagattttgggatgcccccttacctggcctctccattccctactcttaatccttaaggccatgatttcttaatagctttccacctccactcagatcatgccaacaacttctctgcgctggactatgggtcctccagcttctaatctgttccccacagagcagctagaagaatcctttcagaagtcagatcctatcacacccctgctcaagccttgccagggcctctcatctcccgtagcatggcacccaggttgccgcagtggcttccattgctctgcattagtgagtccctgcttccatgctgatctcatttcctctctctcttcctcgtcctctctctgccatacctgccatcttgccattcctacaactcacagatacactttcaccctaggcttctgcacttgctgttgcctctgctcagagtgttcttcttccagatgtttccatgactcatttcctcatttcgtttaggtttctacacgaacatcacttctttagagaagccctccctgccctccctgtctaaagcagaaaatcccctccttcatcactgtccagccctttaccttgctttacttagtgtcttcagaacactgtcactgtaattccatcatgcattcattgtttattgtctattttccccctctagaatctagggccataatcacagggtccttgtctgccttggtcaactcattgttacacgaattgaatgagtaaaagctttcacgagaagtgtttgggatcagaagcaattgtcttttattcaatagatgattgggagataaatacatttcattttaggatttcaaaaaacatgcatacagtgacacccaagtcactatataccgctgatatcgttttatcagtgcaaagaaaatccagatataaaatacatctttgcttttcagtaaggcatgaagacatggttgtactgctcttcatctgtattattgacttggcctcatcctgttcattgacttcgtatgggttggtgcagtaggtatgcaagcctcataatcctcctttaaaacaagaggaaaggcagaggcagctgcagattgttcttgggtgaactccgacctcccaaactacagcttgctggagaagcatagagtaggggagaagaacagcaagtctaaggctgggccagctgcgtgtgaatcccagcttccccacccaccagcagctgcccaaccttagtcaagtaactgaccctctctaggactgggtttctccatctgaaaagtggaagtaaacaaatggttactatacaacaagtccttctgcatacagtttatttgatttttttgcaacagccctattaagctggtgtgattatttttattttacagatgaaggaaccaagactcagagaggtaaagtaactagcccaaggccacacagccaatattttgctgacctggggttgaacacagatcagctgcctctagatcccgtgatcataattggcagtatgatactaattcctattatctacaccatagagtagatgcgaagattaaatgacagccaggcacaatggctcatgcctgtaatcccagcactttgggaggctgaggcaggaggattgcttgagcccaggaacttgagaccagtctggtcaatatagcaagaccttgtctctacaaaaaattaaaaaattagctgggcacagtggtgggtgcctatagtcccagctactcagcaggctgaagcaggaggatctcttgaacctaggaatttgaggctgcagtgagccaagattgcaccactgcactgcagcctgggtaacagcacaagacctcatctctcaaaataaataagtataaaacaaaataaacgagaaaatctccagcgagtgctaagcacagtgcttggaacatggcagcagccacgtttaggaatgacaccgtttagaaattagtacttccaactcctctaattccacaggaagctcgtagaatagccaagtccgggcccttctcccagctggcagtctggggcatttctttatgcagcagaaggagaagcatcatgcgcccctactaatcctctccactctggggccaagcctcccatcttccccccagggacaaggtctcccctcaggcggaaagtaactgttcaccttgttgctctgaggtgtcggtggtgacagccccttttctttctgagggccccagcaggtcactgtctggcaccaggctgccaccccctgccgggcctcggctgcactggccgtcggctcagttctgtgtgacctgtcagtgggctctttgaaatggaggttgatgaggaacagagcagggtagaccaggcagcgagaggccaggaacagcaggcagagggcaagcatttggggaaatcagaggccaagagcagaggcccctgctctctgttgccagtggtttttgtaacagcaaagtggggagacagctgcagccaggatagaaatcccccaggtataaaaaacgtggctctaggctaacaagggtgagactgtgccagagaggcctgtcagaggctgtccaaggtgggaaatttctgatcaaatgagatgattcccagaggccctttctgggttgagagtcagcaggggcgggacagggagaggaaaagaaggaaggggaaagagacagaaaaaacaactaagaaatgaacatgtcttctgaagcttcagtatttcccttcataagtcctgtgacattcagagggtacctatatatggctgtgactgcttccagccccctgtgaaaaaccgagaacagaagtcaagaggctttggaggaggctgggcatggtggctcacgcctgtaatcccagcactttaattccagcactgtaattccagaagtcaagaggcttcgggaggccgaggcggatggatcacttgagatcaggagttcaagaccaggctagccaacatggtgaaaccccatctctactaaaaatacaaaagttagccaggcatggtgaagggtgcctgtaatcccagctacttgggaggctgagccaggagaatcacttgaacccaggaggcagaagttgcagtgagtcgagatcgagccactgcaccccagcctgagcaacagagtgagactctgcctgaaaaaaaaaaaaaaaaaaaaaagaagctttgaggtagacaaccaacatgtgaatcatgaatcacttctccatcatttactagcactgtgaccttgggcaaggcccttaagctctatgaacctcagtttctttatctgcaaaatgaggatcatagaacccaccacaaagggttcttgagagcatgactggatgctggctggatcgaagcacagcacaggctgagcaagcacagagggacttaagtggctggcagagggccaagcacttaattgtaaacttaagtcaaaagtgtgaactggatgaagctaggagctggggcagagggctggccaaaacattctgctgcccagtttcccaaaacataaatcaccctgtactaggtatgtaaatggttactctcactaactgtcttagataaaagagctcatatgtacatgcttgtacaaacatgtcatggcagagggtacaacaggctcctgtgtgttggacactcagcataacagtcacacaaccttacatggcagctttgtgtaggatttcgttccagagtgcagcaaacagggtccaaaacccagtcctaccacttaaaaacagggtgaccataggtgaattatttaatctcgaagtctcccatttctcacctgtaaataatgatgttaatagcacccaggattctggtggtgtcttaataaaggcatgcgtttaaagtacctaacccagtgccaggcacccaggaagctcctcctgagcaccaaccattggttctcattagacatggttgccattaatgttccattgtcttgctgacgccaggatgttgtcacctagcacagggtccccactctaaaatgcactggccttgggagacactgggagctggaggacaggggctctgaactgatatgctagtagtaccgacgtggtttgtgttgggcctgatcaccaaaagccctgcactttataggaagtcaatcaaggatgagactgccacttgtgactattgagtagatggaggtatggctggtccttccaagaacaaagcccccaaacctagagccctatgttctcatgaactgttttccaacgtgcatggcactagatgcaattgcagggagaggctcggagccagaagggtccatggtcaggaaatgctgcgtactccatgacaatattaaagactcataacgtgtatccatatatcaaagcctccaggaagtcctgctgtaaagtttaacttcgtttaactgactcccaaattacatttgatggcagatcctcccctcccacctccacttttgtgtttcagggaatgcgtattaacatcctgcaggagacagagtttggaaaaactgttgtagcccctcagctgtactgctgtggatatttgaaggctttttctcagtcactcagaacagaggtctcaagctttagtgagcaaaataatcattcttgagaatcttctttaaaatgcagattcccagccaggcacagtggtgcacacctgtcatcccagcactttgggaggccaaggcgggtgaatcacctgaagtcaggagttcgagaccagcctggccaacatggtgaaaccctgtctctactaaaaataaaaataaaaaaattagctgggcattgtggcgggcgcctgtaatgccagctactcaggagactaaggcaggagaatcacttgaacccaggaggcagaggttgcagtgagctgagatggcaccattgcactccagcctaggcaacaaaagtgagactccatcttaaaatttaaaaaaaaaaaaaatgcaggttcccaatatttagtctcaggaattcagtacgtctgggttgatggcatcttaacaccataccggagcaggtagtcagggagcacaccttcagcaacgctggtttaaagcttagccactggaaatacggtgctcagagcaacaacatagacatcacctgggagctcataaataatgcaggctctcaaaccccaccttaggacacgggatgagaatctacattttaacaaggtccctgagtgattgtgatgctcattagaatttgagaagcattggtttaaaaggttttgttgatggcatttgtttttggtttttgtccattagttgctggtgaagaaccattttttaaaaataactggacaacactataatccccttgtcaaacatttcccccagtggcttcaaggtacagtctattaaagagaggccttacctgaatcagatttctgcctttggtagcagagccttgattttcttaagcagcccgtgctttttttcccacatccatcctaaagagtagaaaagccagcaaacagctttcactggggcctcctctctgccagatctctggtcagacatgattcatcttccatgactaagtcataagaaaggccagaaggtgctttggtacaacgatctctggacttggaagtcagagtctgaccaaaagagttggcaagaagtaggaggaaaacttccaacaggtcttcttccagaaggagtgcaaatacagttttacttctttttttttttttttttttttttttgagacagagtctcgctttgtcacccaggctgaagtggagtgatgcaatctcagctcactgcaacctccacctcccgagttcaagcgattcttctgcctcagcctcccaaatagctgggactacaggtgtgcaccaccacacccagctaatttttgtatttttagtagagacggggtttcatcatgttggtcaggctggtctcgaactcctgacctcaggtgatccacctgcctcagccgcccgaactgctgggattaccggcgtgagccaccgcacccagcccagttttacttcttgcaatatttgagaatggccgttgctctgtgcagggaaggaggatgcctgaggagcgacggttcatcaggcagccagggtattaatggcaggtgaaaccttccaaacgagcatcctgtcagccaatctattgctttaaaaggttcgcaatgcaggagaccttacagaggcaatgaagaactaatctcatattgccaggttaaatcaagtcagccttgcctattcctttcacttcttagttacatcaagcccaaatactttcaattatcctcacttccaacttgtcagcaggcgtagggtaaaatgcaaatggaacagtacctttctctcgtggagagcaggaaatatcattaagaataaccttcatgtattgagctttgcctccatcttaagtgctatacattcatcatctcatttcacacgcaccttcttagagcacctctgtgcatttcagtgcagtcagcattattaagtccattctatagattggaaaactgagccacaggaattcagtcacgtgcccaagatgacacagctgataaataatagaccaggttttaaagccagaccattctaattctaaagcccgtgtttgtttgctgtttttcaaactgagccaaaagtccagtaccaccctgggcaaatggggcagggcagggaccaagcattgcatctcagcgggccctgagctttgggatgactcccttgaaattttctaagttgctccccaagtgtcagggactggccagagtcagcaatgctaactgggaggagcacctcagtccagactaggacccacgtgagccctgatccctgttcctccccttcagggtgctctttttttttttttttttttttttgagacagagtctcaccctgtcacccagcctggagtgcagtgatgcaattgggcctcactgcaacctccgcctcccgcgttcaagcgattcttctgcctcagcctcccgagtagccagaaccacaagtgcgcgccaccatgcctggctaatttttgtagtttttaatagagatggggtttcaccatgttggccaggctggtcttgaactcctgacctcatgatccacccgcctcggcttctcaaagtgctgggattacaggcgtgagccaccgcccccggcccagggtactctttgaccctctgccacccctcacccccactcctgtgcatgtagggtcaataagatgccccaaattgttttggcatttgcatctatgggatatcctaaggcctaacggccagccccagttccagcaggcagcctagcaagcactggccaaaggactctctcttttgcaaaccaagcttccagaatggtgctgacctgctgatttggggtgactcaaattgtttatatagccaggggcccagcacaaaaaaaaaaatgccctttgactggggtgctgcataccttaggcatgccctgcaggagtttacctcaaaacaaactaactcccaaggcaaaaccaatcctatggttccccctttttactcaggaaactctttccatctctatctcaaattcagcaggagcctttggcctttgctggccagcattaagtgccctccaggacccctgcaccttcttcatttccatcacgaacaaccagatttcatctttcttgccccaacttattgcttcttccctcctttttattgctgcattaatttttcacctcttcatcattattagctgatctcaaaaacgaccctgagtcacggggttcaccacctgactacccagactttccttggggaagtgacagcttggcaagcacctagctctgtataggtaaaaaaaaaacccatatgatgccaagaagactcaaaaagaaaaagaaaaaaaaaacatagaaatgactcagaagcacttagtaggtgacaaggtgctcacaactgttgtaaggacctttcgtggattacctctgtggatcctcccagcactcctttgggtataatcatcactgccctcactttgtcaattcacctggggaaccaggtgactaagatgaagatcaagagcatgcccagtgcccagaaagtttccctgtgccctcccaactaatacctcctcatcaaggtaactacaacttctaactttctatcatcactgattaactttgcctgttcttgaacatcctatcgatgggtcagagagtactcttcaaagctcatgtttttaaccaatccactctatggcttcctggcccaatgagtaggaaaggtagatttggtgcttggtggttcctctgtgaaaccatgactgcaaagagtgcagcttatttttaaatctgagcttctgaccagtccccaaccagcagctgcgtgcagacactagaagagccatccacagcacctgcagtgatttgttagaggccatctccaccactctgtcacaaaatgaaacttagaaaagtaaatgtaggtgttcttctggagcctttaatacctaggaaagccatggagttcatgcacattggagagagactcacttgcaaaccaagctacagggagaaaagttgaacaaaatgcttccattcaaattctctataagctgcccagaagatcaaagaagaaaataagtgaaatcaacatcttctcattccctgagccatttcctatgagaatgatgatgcaagaattcacacagcctcctccaggcagaaaggtgtgcatggttcagccaactccaaaggatccagatgcttattgtggctgctttacagcctctccatcgacacagggcctccttcctcctgagtgtagctttactagtaagcgtttaatggaggctttgagcttaaatctctttactagttaggagctccttttaaaatctagcagagtacactagacaggggattgaaacggctgacaaaaacctatagccagcacaaaagtaagtgccaccttgtgccaatggtaaacagctgaaaggggattgtgtctcacaggtaaatagtgtggtcctctgcagcctacaatgccaggaataaattcccaggcatctggtttctcctgctgattcctcttcagatgctcatttcaaccagccacattctttcccagctataggagtagacaggccttcagaagtgattaaatctcacagctgcccacacttacccctgttgatgggtgtccactgccttgtcttcagacttccttggggaaggaagcgtcacccctcctaataatgaagacaaaaggtgataatctcatcggctgcctttctctactttttattcatagctgcttcttagccacttggatatccaccttctccaagcctcagttgcatcctctataggtgggtatagagtgggtggcatggtgataatggagctaagataatgtactgagcattcattatacgacactgctctgagtactgtacagacaataactgctttaaccctcccagcagcactatctaccatcgtgatcatcatcatcatcaacatcatcatcatctccattttatacatgagggaaactgaagcacagagcagttaattgcccatggtcaacagctaggtaatagtcaatctgagattcaaacccagataccctgttctataatctgacatttaagagttacattattctgctttgcaggatttccatgaatctttaaattaaaaaaaaaaatgtaaattctgctcaatctatagcatttgttattcctattaattattattattaacctatcactgtttggaaattaagtatttttgccaagattcaaccagcccatagcctacaccagtggatgactctaaatataagggaatattaatttcatttacttttgcatctttttttttaaaatgaaaaagtggaagacttcagggagtttctggttatagttatagttcattggacatatactatataccagactgacatatatatatatatatatatatatatatatatatatatatatatatatatttgaatttatatatatatatatatatttgaatttatatatatatatataaatttatttattcttcatcacataaccctatggcatatgtacaattataactcagtttttaatgcaaggaaactacaacccagcaaggctgattacctttccaagctcacacagccagggaactagcagagacgagcttcaaacccaaatccatctgattccagaggccaggctgtcacctctgatgctgtgtagaatttttggctttttaccttgggacttctaatccaaaggtttcaattcagcattaatgaacctgtttcacgttgccagaactgttatggaagaatctctctgatttgctttatcaaaagcaataaatagaatgccttggtatcattcccagaaagtttctccatgatcacatttctctgaaattgtcattacaattagcttatgacgtgtatgagtagactagaaccagagctgtgatttagcgtccgttctgacagaaaacacctagataattctttttggccccgtttcactgagtgaagtaagattaagcagacatgagccaccgcagtgtgggctgattcagaaggcctaagtcgctttcccataaccgctgagtcagtattgggccctttttgaggactctgcaaacctctcctaccatcctcacccccttccccaggaaaaagccaaccagactaacaaataagtaggtagataaataaataaagaaatcgtccattgtcataggagggccaggccgctttccctctgctgttgaatggagacatcggccacctctcaggtcctgaactggcaattcagaacagtttgattgcctgcttgattgtttgcgagataactgcaagattgtcagtgacagggtaatttactgaagattgcaatgtcagactccatccaaggggcttgctggcataaagacgcgattctcatgactgacaggccactgggagattggagtgccaatttaaagttcacagtgtcgtctgaaagtgtttggcggctgcagcccataatcacgcagcatgatgaggtcattataggcataacgtaggctcctacttaataacgggtagaaccccaaatgcacaatctctggagcaggtaaatgtaaatatgtaggaggaaatcatttgtatcctattttctttctgttttggcatttgtcatctgctattgctgatgtgcttaggccatctcctgccagacaggcccttgaatcaaaagcccaggatcaacaaaacagtggggaaatttgaagttcacaattctgaagcagtcacaagcccggaaagagtgacaggctggagggggagggggaggcaaatgttcagcactcaataggaaaactgtcttaagttattcttcaagcccaaagaggtcttcaaggcggttatatggagcgggtggtaaatgggttggagggggaggaaatatttccccagcttcaggagggaaaggccaccagagatggatgatacccctaattggaagaggcctgtgaccttaaagaaatctatagtgctaacagcagtgggtttcttctcacctgagaagcttcttgtggctgctgaaggaagccctgccagcatatctcagcaggttattttttaaatctgaaacaggcattccgtggtagagcccttctgtcttttgaaggcagcccgtggacagtgatgttcaaggcagaattctatgcactttttttcttctttttcttatgctgccaatggtcctccagattggacagcctgaatgtggatctgaaacaatgcctggatatcatcctgctactaagatacaatctccagtgctgtttctagggtctgaggtttgccaggctccggggaactggggagtatccgattcagccagcatatcagcccgagatgttcagagccttgattttgaaagtctctcaatctaaagtgtgcatgcctgctcaccctcctgtgtctgcatttctaggaaattgtgtaaatctaaatgtgttacgaggcacatgagcaacatttgcccatgtggaaaatgagaggctagttttagtaatttaaagccaggcaaaacatgcaacctcctaatttgtttgtttgctaaaaagaaagtaatgcattaaaataattgcacattaattgctaaattacagtggaactttggtgaaattacatatttcattttcattagcggaaccaaacgaaaagggtaatgccaaaaaattacactgtagtaaatttaaagcacccagccaggcctctgattcagcgttccagtacaagtgtttgtcaaggcacagcccagggtttgagtgcgtgtttccatggttctaattatggtccaaaaaaatgccttgctatcaaatccaggaggtgcaagcaagttattctccaagcttctccactgtgtattcaatccgctcccagccgagtgaataaggattgactaacgaattcgttcttatcagaaattccaaggagcaaacactgccctaaacattcccatcttcagccctcacagacaggtgaggaatgggaaacagtcattttattcattcaacaaacatctgttgagtgcccgattctgtgcttggtactaagagaggaatgaatataaaattaataagacatcatttttctcttcaaagagctcattttccagatagggaggcgagcattaagaggtcattaattctactataagaaagttggcattaacaatggtttttaaatcgtattgtgtgttagaatcacctgagaatcatgtttaaaatgcagattccagggcctgctcctggaggctctccctggggagatgtggggtgggccgtttattcttcctgcaggattctgatgcagaatgcttctttgagaacctctgattcagggatgtacagaacagggattcctaactgtcttggtcagtttgggctgctacaacaaaaataccatagactagggggcttaaacaacaaacatttatttctcgcagtcctggaggctgggaagtccaagatcaaggcaccagcagattcagtgtctggtgaggccctgattcttgattgatagactgcagtcttcttgctgtgtccacacatggcagaaagagtactgaagtgctctctggggtctcatttataaggacactcatccatttataggagttccaccttcatgacttaattacctcccaaaagccccattcctaataccatcacattgggagttaagttttcaacattgaacttcgaaggatcacagacattcagtttgtagcaataacctggccaggggcatcatccagaaggcttcctggaagaagaggccaacctaaacttgatcttaaaggatgagtcagtcctgtcagtttcccccactctaccattagctccttaaagacagtctccatggttctttgctctctctcatttccagcacatggagaccactcaaatatttgttgaatggtagttgagtaaataggaatcagcccaggtaaagggatagaggcacaggactctaggcaagtgcataataatgttccgagtcctgagggcgtgcaggaagacagaaccagaaactactgcggaaactgcaggcttaatttccagattcccaagccaaagccatttctccacatttcctagaaaatgtaatactctcagcacccaggtttccaattggtcagcagttcccttcctggcttagagagagtgggatagaatacttttctccgttaaagtgagatttaagggattccatgcattttagttttttttaatttgataaaaaaattgtatttctaatagagacagggtctcactatgttgcccaggttggtctcgaattcctgggctcaagtgatccttctgcttcagcctcccaaagtgctaggattacaggtgtgagccaccatgcccagccagaaattccatgcattttgattacttgtgcacccattagcacggacccctgggaactgaccgtgggtaatttgctgtgctgtgttgtttaaaagcgaagtttttgtttttattttcccactcaaataatacgtgttcatagtagaaaaaagtagaaattccagaaaagcacaataaagaagagaaacacactaatctgctacatgaggataaccatttgtcaacattttaaattatttcctttcagtcttttattttctatgtgtatggattggaattggatgaggcttgctgtgtgaaacctgccacctcaggcccttgggtacgtttgatgctgctcatgcctgtgctggtaacaaaggtgttagtgtctccaaacagctttatgccatgaaatctgctgactctggctctgcctctgcccttccagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcaggtaggcaccctctgtccctgcaaactcctgaagtctctgattttcttcctgttggagccagaggcagttctccagctttcccggggacccaattggcctggaatctgcccccctagaggcagctccctccaagggggactcagagaagtgccctttcctcactttgtgttgggctccagaacagagccctagtgtctttgcaggatgtcaacatctttaacccagaacctgctggagacacctgttgattccctggtttttagatcatttttaaaatctgttattttatgatgttattgtcattatattaaatctccctttaaaatgcctctgatagtggcttttgttcgagcattgctgaaatagttcattcaatagagtgtttttgaaagctgttattaacttgataacataacctatcatttggtggcatcttagagtcaagaagatgttggttgcaaggatttattgagcacctaggatgagccagagactttgtgtagattatctctaatccacacaacaatcccatctattgcctctcctgattacctattgcatgcaagccattgtgccactgcatttcacccctcattctctccagtttattattgctcttagttgctaatttgaggcttagaatattctagggtcaagttctagattcattttgtcttcaacttcaccccaggacaagttagaactgtgctcctggagaagagagcaaggggaaggtttgtcttggagacacttccccaccaccccatcccctcctcttttctatgcactacgtatgattctgagggtagagaggaggggtaggagaggctgggggtcttcttatggcttggccatgcttgatcttcctctcagttggtccaagtccagatgtcgatggtgtatgctgatgcaagaaggaggagcgtggtctaattggggatgccccgccccatctctgtggtccttcacatcaagaaataaaaactgctggtcaggtcctttttcacaaaacttctagatactaggaacttgggtaggatggtcctggcccctttgcagccctgacgacccccattgtgccatctttgtcttatttctctttagcctcattcaggtaggcccaggagcaactctggatgtatgctacttctctcggcttccaagcagggaagaaatactagacttcccttcttacagaagcacctaactttataagtgattctctcggagcccctctcatgagcctttcatcggtccccaaccgagacagcccagcgagggtgggatggggaaggaatgggtgtcagcacagctgattctacagcctcttagagctctctggaaagttggagagccccaattcctgcagctcttttgaatatgagtgtcttaacaaggtcaccttaggccaacaacttttgcttctctctgttgtcgtttttactaaaaataaaatagaaaaagaaataatagaaaggtaaaaataatctcagccctcttctatttcagccctgatacctcctagcgatatcatgttgggctcgtaaacctcattttcttgattaataaaattaggataacactatttaaatacgtaaaagttgatcagacaaattgggtcattcttgtcatacccaactaaagcagaggcaagaagccaggaagaaaaagcactctgggcacataacattgccctagaaatgtaattctccccaggcctggctactgaaactgtctgttgtaaccggaaaccagttgatctaatagcgactgaaacaacctactatgactctaagactagttttacccaccaccatcattcaccagtcagaactcaccagatcgccaaaactttaccagtcccagtgaactttctctcaaaagaataagtaacatttctccttataaaacctccaaacttctctttgatcttcagacatcctgaagactacccccatgcatatgccctgaattgccattcttgcttcccaaataaaacattttaaatttagagattaatctttctattttatttgactttaacatatactatacacagtattattactgtttcttttagtagaagaacctctcaagaaaataaaagaaaccacagatctctgataaataaaaagcatttactctgcttgttaaatcctagctctagaacagattctgtaagtatgcttccttttaattatgaacataattcatcttgctagagacccgtgactgggcagagcttgcactgggccataagcatttcagtggggtttgtagtttgcttatactgaaaatgcatcctctgaaggcctgtttcaatctgcttcctcattaacctatcattatttctaccctaaatccagtcatttcctgatattctccctttcatgctttctccacctggcccttctggttttatcttattctcctcatcaatggttaccacttccagaaggcaccttgagctagagccaaaatacaggtgaacagtcaggaaccccagaatatttggtagactatgccagcccaggagacctgaaagaaagttgctttagagaaagcgtctcggaagctttaaatgtaaacaataaatggcacttcccaaatgagcccaggctctccggctgtctgcatggatacataattcagaaatatgaaatgtaactccaagacataggttgaagttcagtaagcgtgtgaattccagtacattatcatcttacaaataacgaaggacaaagctaggagtaaaaaagaactcgaaaattcaagatttctaaaagggcgttcccctagataatggcatacaaaaataactaaaatgccttgactccaccactataatttatagagcagatctcactatctagataatgcgataattgttacacatcaataatcataaatagaaatgaactgatagtatgtcttagctgaatcttttctgcaaattgactgcctggaaacgataggaagccagcagcaaggaagaatttgaaaaatagaggatagaaatcacaggcagcactactcctgttattcctatggcacactgcaaagccttctgctacaggaatgatttaaaagaaatagcagttgtagaaaaaggaagggtggggggactccattgtggaatgtactttcaattttgttttctcatcacgagcactgtgtaccttgtggtcgtcaacacacatcactgattttaaagtagtgtctggtaaggtcttaaagaaatcttagtccgagctaagataagaaaatggaattgaacaaaaggattattttcataaattagttttccactttaaaagagtctagcattgtggttaaaaccagctaaaaatggcattcatttgttaggcagccagtagcagacaattagagctgtcagtggaacagtctaaacactcctgagatcatcaaagggttggagttgaacagctgggggtattgctaataaaaagagagatgcgtggagacagcatccctccggttttcaggacacccaggaatgcaaaagtaagtgcatccaaaaatcgagccgactttgacaagattgtgacaaaggacgggtcagttgatcacctagttcagaaactgggagtgtgtccaggatgctgggagcctgagaacctctcttcttttgccaaattgcccagtctgctgggggcttggtgcagaaatggagcttctcattgtcccatttctctgtgaagtcaagagaattcagatgagaggaggcatgcacattctccctccatggactttgagcacaatattgtagcatctctctggctttataggactttcccaggggtagctggttggaaaccgggatttgtgggaaagttctagttactgtgtctggaaagagggagatgttctgtaacactggaaataaattggtaggatttcaaaacccttcaagatagcaggaattcgacataagagaaatatgtagtaacacagaatccagaatccaatatatttctagcagaaaaaaagtgtatatagatatatacacatttttattgaatgtgtatattgaagggttttgctatatatatctccaaagttctcgtttcctcagaccctcatggattatgagaaattttgctcttagagggcagcaaaagacaatgcatgtgtatttcccagccataaaactctctgtgctcccctctacccactctgacattctggcctctagaagagtaacatggccatcctccaaagccaaaaaatggaaataagtagccagatgtggaagctctcacccgagtatggcactctcggtgccaggctaaagagcacctgggaatgatgagggacagcctgaagctcaggccaaacaaaagccaaacaatgtcaagaaatggagcaaggccaagagtggaaggcgggtgcccaggagacccctgggcccagctcagtgacgggagatgctgcccatggatttcaccccaaaatgtcactagcgtgattgtgcaaagccagaagttaatgttgaaagccttctccttgcctgagggaccagatgaggatgagggagcagaggcagtggggaattgtctctgttctcctgcatgtggctcaaagacctctgtttctgtctttctcagcttggtttctctcatccgaggccaagtagtaactacagatggaactcccctggtcggtgtgaacgtgtcttttgtcaagtacccaaaatacggctacaccatcacccgccaggatggcacgtgagtagctttgtggggctcggacctactcaggaccacacgtgtgtgcaaagggacagacggtgctgttggcttggaaccacaggattccccctggtggactggaatgtccaccaggcctgtcccctagtgaggattcccccaaagacatttcatgctttttgatgtgacatcaaaaacagaaaataaataggaaagccagcttacctagtacagctcacagccacctcgtttttttaatgtcaggtcaatgcacgtgtgtgtgtgtgtgtgtgtgtgtgtgtgtgtgtgtgtgtgtgtgtgtgtgtgtgtgtgttggggtgggggcaggttctagaaaaagaagggaaggtagctcttagaaacgaactcctgttttaaatcaaaggcagtgcagggtgacaggaatccacatgacatagtgtcctgtggtgatccccttctgctttcatctgtggctttaggagttgtgttgttttcgctactgtttggagggggtggcgtgtaatcagagaagtctaattaaatacatttagcagtcaccctgctgtgtgaaggaggcaacctttccctattatcttctgattggaaacgtgtacccgttcagcctccatcaagatgaaagctctgtcatttccttaatccatttgggcatagagtagaaatttaaagaagaagaaaagaaatctatgggagggagaaaacactaacttactctgggctaaaaaacacacagacacacacacaattatggcattctgttttaaatgaaaagggaactgtggctaccaatctgatccaacactctttctgtaaaatgcactctggaaaatcttggatgtatcacagaagtaagaacagggattttttacctttctctggcgaagagtctggccttattttctttcttgccctaaggtagccttataggcagtttcaacaattaccagcccccaggagccctaacttcactctcccacctctgaaacccaaacaaggagtctaaggattcatatcaaatcttcaatattcatgaaatttctgatatctcactcatacatttctgtagccaaatctaattattttaaagcacaggatggcagatgtgtgccttgcaaaattactctggcccttgttcgttcttagaagccggtggggtttttttgtttgtttgtttgtttttgagacggagtctcactcttcttgcccaggctggagtgcaatggcgcaatctcggctcactgcaacctccgcctcctgagttcaagtgattctcctgcctcagcctcccgagtagctgggattacaggcacccgccaccacgcccagctaatttttgtatttttagtagagacggggtttcaccatgttggccaggctggtctcgaactcctaacctcaagtgatccatccaccttggcctcccaaagttctgggattacaggcgtgagccaccgcccccaggccagtgttcttgaagaactgacatccttgagtcaattgctgtgaagtcccatgaaacaacagaaggagacatttctgagtccctgatgtgctattttccctttcttctgcatccctctccactgcttcctgagtaattatgccccaagtccacttcccagatcatctatccaacctcctggatcagttactcttcagcttgttcaggttgtaaagctgtggaagtcacaggacgtgcttgagaatgctctgaggaatcccacaatctgttgcatagtggcgtgtgccccaaatattcatgttgattctaccgtgccaactaggaacaattttacttcaagacatttgactctcttctgtactctatgcagaactatccccagcagtgtgcatgcccgataaataagcacataaataaagtaattaataagtaaactattgtactgtacatgctctgatatttgtcttaatattcctatgctccctgttcattcacatttactaaaaaagaccaaatgtgttactaagattggatgaaaccagcgagtcaagtatatttttaccgagtttttactgtgatccaagtactcttagctgctggggattctgaagggagcaagacagacagcaccactgccctcaaagagatgaaattctaaggccaggtgcagtggctcacatctgtaatcccagcaccttgggaggcagaggcaggcggatcacgaagtcaggagatggagaccatcctggttaacagggtgaaaccccatctctactaaaaatacaaaaagttagccaggcatcgtggcaggcgcctgtaattccagctacttgggaggctaaggcaggagaatcacttgaacccaggaggtggaggttgcaataagcccaaatcatgccactgcgctccagcctgggccccagagcgagactccatcccaaaaaaaaaaaaaaaaaaagatgaaattctagaggggaggtaaaataaagcttaacattaggacacctctctgttaacgtccttgttttctgttaattgggaaagagctacctttattctactttacaggtaatacacctccatccagctcttaagaaacgaacagaaatatagcttaagaaccattggcaaagaaatcagccacagagcagaggctgattagaagaatgctgtaatgagctcctctctgtgtcctaacgtagtatcgttataattacactatttattgaacattctattagcctaggactgtgctaagtgctttacacgagtggccagcaaacattttctataaagggccagagagtaaacagtttaggctttgctggccatgtggcttctcaccaacaactcagctctgccattatagcagggaagcagcctaaaagatacataaacaaatgggtgtaactgtatgccaatgaaccctttttttttttttttttttttttttgagacagagtctcactctatcacccaggctggagtacagtggcgcaatctcggcccactgcaacctccacctcccaggttcaagcaattctcctgccttggcctcctgagtagctgagactacaggcacccaccaccatgcctggctaatttttatatttttagcagagacagggtttcaccatattggccaggctggtcttgaactactgacctcaagtgatgcactcacctcagcctcacaaagtgctgggattacaggcgtaagccaccatgccctgcccaataaaatttatttaccaaaacaggtggtgggccggatttagctcataggtcatagtttgttgagctctgctctacactcatgatgtttcactcttagtcatgccatgtgtattggtgtaattattcccattttacagatgaagaaacttgggctgagagagggttagtaacttgcccattgccactcagctagtaagtgatagagtttgggttccagccccacctgtctgcctccaaagcccatggtctcctctgtgctctgcccatcgcatggccatcaggggaggaggagaggcatcctgccttgtctaaaagtgagtctaccccctcatcagctcatttactccctctccaggttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggtaggaatggcagtgccagggcgggactctcaggacttccctaacgaaaaccaactggacactgcctctccccgagtggaccagaaactaatattgtaggggagtaaaaaaagtgggagcataataaaatttatagccaccagagatgaaagtttgaatccctcttggctgttctggatgtctgcagatagtcgttcaagactttggcagtcatcagagcttttaataaaataaaaacaacatacatatgtgcaacccacctgcaaattgctttttgttcctgttagtcacagagatacatggtaagaggcgctttaatgatctacatcggtgttacgacagagggcatattacattattgcctccctgttgctttatacggattgtcagtggaagttgtaggttcgtataattacagcctctcgtggcctccttgcatgcagctagcaataaagcctgctgttcttatttacatcttttgccaacagtgtggctttttaaaaagaaacacaacagtgaccaagaataattattaatccaaaaatcataacctcagccccatcactctatggtggaagataaagtttttgttgttgttgtttttctttctcagtggtggtaagtggttcttgcacccacataagatgtgatgcctcagtgagggacatagcagacagacagtatcggggttacagtttacctgcacaggtgtgttttaggtgtgtgtctgccatgtgtttcctctccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttggtatgttttggtttcaaccacttattgatcaatggatttagtcatgtgttaattcgacccatatttattgagttccgaggatatgccaagcaccatttcagtagataaggacacgatggccaagaagacagacaagattcctcttccacggggtttacattttggtgaggtattgagataataaatacaagtgaaacaaagaaatatcaagcaagataggtgctaataagaaaataaaagtaaatgatatatattggggaggagggacaactgtggtgagcatttagggaaggctcctctgcagggcagcatttaagcagagactaatgacaagaaggaaccacatgaaaatcagaagaagaggatttcaggcagagagaagagcagggtgtgtttgacagacagagagaaggccagtgtagctggagtgtagtggaaaagaaaatattcaagatgttgggagagaggtggtcaggggctagttcattttccagacggagcacttgtaaatggcacagaatgaccctgaataatcagaaaacagggtttgaggagatcagaaagtcacatgctatgttccagggctttgccttttgaaggaatcacgattccctccttatgaaagatcttcgtaacagaagtgtcctaccgttatcagagttgtgagctgtagattaatcttaacctaccttgtatcttcctacttgtggaaagctatctaggaattaattaaaatccagaatcctgtgttctcttcaccaatagtcgtgtgtattttaaaaactgtaaagataagttaccaaagtaggaaactagcaacctcagaaattttcactataattggtagccaatgtgtatcagacgttccttttgtgtagagagaattgtgttaaatcttttgttgggtaacctctcaataacccctcaagtaggcaccctcataaccccattgtgcatatggggcaggagggagagggtaagaaagttgcccaagatcatgccactaacaggtcacacctgctcagaatacagccctgggggtctgctccatcagtgagtggtgttaacttaaccaaggtagtaagaagttcccagagtaactagtgtatttaatatacaacactggctaatcaaatatatgtatatttgtgtgtgtgtgtatatatatatacacacatacatatatacagatatatatatgtatatatgcacatatatatacatatacatatatctgtagctaataccaaaatgacagccaatattaaaaagtagactaaatattgtaattcacttccatacactccagctcctgccattatcaactcatgatgaggcctgtttttccatacccccgtctactcccctttctcctgtatttttctgaagcaagccctagacgtcacatcatttcacctgtaatatttaagaatgtatctctaaaaacataaaaacaatatcatcacaacaaaaaaacacaataattccctaatgtcatcacatagcccatcattgttcagtatttcaattgcctgacaaataccataaactatcaatactttgtctcaggatcccattaagatccaccttttgcaattggttgatttcttttaaactgtttttaaagttctttcatctttccttatctttctctctctctctaacctttataatttatttgttgaagaaattgggttgtacaatttcccatatagcgtggttggttggttggttgattaattggttggttctcgaattgcataattacggctatttggcctgttcctctgttccctatatctcctgaccattgatagttgggttttgaagctttctcaggttcaggtttgattttttgattttttgttttggcagaacaacttgataggtgtggctgtgtccttccatcaagaggcacctaaagtcaagttgtgtattttttagagatttcagtagccattgatgctcattgcctagtctgtctggccattagggattgcaaaatgatagtttaattctgtacttccttcctcatctattagctgaaatacttctatatagagatgctttctccttaactacttggttatttaaagtacagttcaaataggaaagaatagataaatgcttgattatttccctttatttactagttttcaatataatgagttgattcattgtccaggggtggcaaattaatgtttcttaaataccattatgaactcatggactgaaatgcatccagtatgtttcaatccattgaagttattattctcactaatggccaaatggccccatctttggtcagtgggcaccttttcaagctcattcccaaatccttttgacatgaccctaatagattttgattccttccttgctatctagtatgataaagtaggctggtgtcattgtgttcatttcttgctccagccatttcttccagaagccctgattccttttaatgagaaataatatatcaaggccacaagccaggcactagcaattctctttgctgctggggctggtcatttggcctttgtttcttggcattttcagaggacaagctaggaaatacatagagttttttaaagataaaaatgcatcctccattcatattgacacttctatatctcaggaattttttaaagctgcagagaatccccaaaggtgacacacatagttaagagtttaatgcagtaggaacagcaataatagcaatgcctcatatttctagagcagcattccaattaaaaatgtatggcatctcagcacttcatctcatctctccttaccacatctgtctgagaaattgaggcttcacttaacccattttacacgtggggaaaatggagccccaaggaagcgtgagcttggagccaagctaggactaatgtccttcatttccacctctctctcccatttgtccatgtggcaaatgcaggatttttaaaaacagcttttggattctgttccccattgaatccccatgtaactggcaggctgtactcctgctggtgcctgcctctcctggcactttctggaatcctgagtgaacacaccaagtgtcttaatttacacaagctattgctcccagaatctccatgtcaatgagccagtacgatcccaaagggctttctcctagtaagtggaaataaataacacaaaatataataaatgcatgctgtgaacagcaggctgagagaagcagtctcctgtccatctctaaaggggaattgtgtcaggttttcaaatgattcctttcctccctccatgtcaccagggtcatttttgaaagccagtcgttcattggaaaggtctttccattcccacagagtactactgtgtaaagtttcaaggttgagttcagctcaaaaatctgaatttaatattgtagcatcacaaggagaaaagcaatcagcctgcctctttgagtgagtttttggaacagaatctgtattactgcgaacacgtgcttctcattcttgctacagagctctggagtaatcaagtaaactctctcttttctctcactctgccccaccccttttatctttcagtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggtacgtgaacacatcttctttcccaaatacagccttgccacttctctggaaccttgtctctagcctcagcatttaagtgatcacacctccccttccctgggtcattttttcatcaagtgcccaaaatatgcatggattttcctaccttcttcttttattatttttttatttaaatatttaaaatatttattatttttttaatagagacagggtcttgctctgtcatccagagtgtatgtgccatcatagctcactgcaacctcgacttcccgggctcaaatgatcctcctgccccagcctaccaggaagctgggattacaagcttctttggttatcctcccaagtgtcattttacccaatgccacagcatttggggtccacctctcccactgcagctctctccacattgtgaagaagttggagagctccccgagcactgaagattcctaatttgtctcttcccctccctcccagttggccaatacacatgtcttccccagagggcttcagtaacccctcccattctccaacccccacaggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacggtaaatggcctcacaggcaaccttcttttgctctcttgccccccataactcctgagtttgatcgggtaactggggctgcatttgggattctccagagaagatatagtccttgtgatccaaaacctaggcccagaatcaaataaggaggtgggaaaaatgctttgtgtatctgtgaaaaaccatacacagatttgatacaatagtcaacaactgacttacagacaaggcttttagtctccagactggagaacaaccaaagcatcttttatttttaagaagctctgtagacacacatcaaagtttgagaaccactaatgttcatttgctaattcaaaatgttgtattgagcacctctatctggctagctctctataaagtctctggatctttgcacattcactaggatagcacttcctttactgcataggctttgctgtgtaatttctggccagcctaggtagattcctcctgcccattgctggctactaagtctgaaagccagacccctctgtgctgggaaaaaactgacccctaaaagctcttagacatgctcttgccaggaaagttgatttcagaccctcaactcagaggagatctgtaatcaaagagagaaataagatctataagaaaggggcaaaatttcattcaacaaatatttggtgaatgtataccatgtcccaggagctttctggctagaaaaaaaaaaaaagtggggtcaaacaaagcacctgttgttgtgtttgtgtttgtgttctggtaaggagccacagacaaaatcatgtgggcaaataaaaaataataatttcctgtatccttaattgctttaggggaaatataacagagtaagaaacaggaactgggcgacagggagggtacatggatgaggaggctacgtaaggtgaattagttggagaaacctcttgtactaggtcacgtttggctaggatctgagtgatagacgtcagccatggggagatctggggaaaagcactcaggcaaagagaagttgttcaaaagccctataccagccaataacctggctgatttaaggactgatagaagcccaatgtggcaggagggtggtgagctcagggaagggtacctcaatgcatcagagtctcactaaccacttagacaagagtacattgtattgcaatgaacaagcaatggaggttgaagtagggagtggggtggaattgatatgatctgatttgcatttttttaaagatgactctggctattgtgtatggagtagattgtaggactgcaggagtggaggcaggaaaacccatagggaagctgcagcgattgtccaggattggggcaatggtgatttgaaccagaatggtagcagaagaaagaggagtgctccaattagaatatattttcgaggtaaatctgataggatttgctgatggatcaggtataaggaacgaacaaagacagaaacgaatcaagggccctgcctaggattttggcctgacaactgagtggatgatggcatcttctgaagcagcctcagcctctctcctagaaggaactgcaggttgcacttgcatttgagagtctctgaggccctgtctgggagaaatatcagtggcctgcccccagcaactgctgctgagcattcttgggagccaagagtgtgccagggactgagaggagtaaaaagaggaaaaaacaagagcttcaccctgaggaggctgcagcctcagtgatccagtgggcatttattgagcatggaggcgagccaggcatgtactgggctctgcggtacagaaggggatgaaacacaggctcagaaaacacccatgtgagcatgagaggtggcacctggggaagtcagtgcagttcaagctgagctgaagggccaaaggccaaccattatggagatccagagacaggcctggggtggaggagggggcatggtaaccagagggtgaacaatgagagcaagaaggacacacgtgggaagaggccaggtagccctcacgctgccaaactggcgatcagacaaatcgcttttcctagacttgcccatccatatagattcccttcccaagatgttgtttttgtttgctttttttaatcctaggaaagcctccttttctcaggcaccctgtgggcaacagagaaccatgggagaagacagggtagggtggaggtagcactgtgctttgccattgcctataggaaaaaagggtggaaatatttcatctggcccttgtaatcttccacatcaggcccttcctcctttgtcactgttcttcctgctcagaggctaatcagccctcacctggtacagtctcacctccaaaccttcactcttgctgcttgctctgcttaaaataccttctctacctaatctaccacatcacatccacctgcaaggcccagtgtcagggccccctcttccacgtagcctgatctccccagcagaaaccattgtcacccacctctgagtcactacaccctctgatcctccattagagttgatgccactgaatgccttgttgtcattatctccatgtaagtctttagggcctaagcatgtgaacttctgcagcagaccccttggtcatctttgtccttttaagtactagaggaggtcctggcccacactaggtgctcaagataggttgcttaaattaaagaaaacacagacccgtctcctccctcttgttggagttggtccctggttccacgtctctcgagttgtggaggccacaacgtcaatggtgcaagctaagggcccaatcagaacaagtcacgccatgcccacgtggtgacattaggacagcttgaggcggaatgtggctcccagtttccctcgacagccgtgtgattcttttttctaactgcctttagacttgttcttactttcatcagccaggtacccagagccgattagaagttaagcttttataagaacactggttttattcttcttttcttcccactacatacctgaaaacaaagggctgtcaatcccctctcttcaaaacagcaaccagcagagggagggagggggaggaagagacctgtcttgcttatgtcttttctccattgtaagttggcagctgaatgattccatttcgggagtcagtgcccatccctatctcgcttacccaccccggagctgagcctctgaattgggatcctattgaaatgtttccatggttctctcactatccttcccccttcctccttcctttgtctctccaaaacatgcagggacaagttctatacacttaaataacttctgatgctacaaagagccttctcttaggtaaaatggttatcacctgcgtgctctgattaggcagacatttaggacatttccatactcctgtcccatagaagcctgatatcccatctttactagtccagttcccactgcccattccaagtggtctttggaaaacctaaagccctggagcagagtaaatttgtcagtcactaacattatagggggaatttctctcatagcaaaatcttttctccctccccagttttagaacatcttaggaattagacctcaatatgaggcagtaaattatacgggatgggacggtatctctctcccttttcttagcttagctccttttaataaacataagaatctcacaccttacataatttttgaaatttccatttttttattttttaaacataaaataatattatgatattaaacatgcttttttccaactaaaccgcttctccatgctgacattctgatggtgctttcagcatggagtcaagggcaccaatcattagaggagaccttcagagaagggacatgtccaacccagatatgttagtaccgggcggggggaaagtgggagcctgggaaggcgggcaaagccagcagacattggaaggaagcgtcagcaaggacaagctctgcctgagagtttcagccaggacagaccctgcttgatgaccaggtagactgttagggaagactatgtggttccacttaaagaacggaaatgcttttcctatgtggtcaggctttgaaaatgggggtcaggaaagaaaagtcatgaagcactcaatcccgaataaaagtaaaaacaatgtccccataaaattttggagactgattggcactattttcaaagtctttttaccaagggtagaacccagattttatgaagcctaagactaatacaatttcagaggctctatctaagaagaaaaaactaaaattataaatatgaaatgagaaatgaaatggaatatttaggatgagaaaggaaacccaaaaaattgcaaagtttagaaaagccaattctatcacaaacatcacaaaatccacacaaataacctaatatttttattaattaactcctgtaacacttccatgatacatgtttttctatactttttggctgcatatctttgatcatcttttaatatcacagttattttgtaatttcattatctatagaaagaacagagggattttcagtctttagtagggctgatcaaaattagtttcatattattgataaattagaaaagtttcttttgtgttcataattgattattggtgatgtgtaaatcattagagttataaaattggggaaaatctttatcaagtttcctttttaatatctctgggcatttcagattttcctgtggagtgaataatctaaatagtctttgaaatgatgctcattaaccagtttgtcattgatgtccttgtattagtgaaatatgaattctacatggggacttttactctctgcagtgatgctagacaaatcaacattgtagggcaggagcattcctcaaagacattcctattcaagaatggctagcaaccatttaactgggtgctaaagggactgcaagccacatgagctcatcctcctgaaactaaaccaaatgcaccccaagtcaacttctctttagttagaacaacaacaacaaaacaaccctgtggctactccaagtgcaccttcctcaaggggaaaatgtggcacagagagagttggaatgaaaaaagacaacagtctccactgattacagatttgtaattctgagcagaacatgagggattggagttagtccaaggcaaagtctgcccagcactaagggaagcagcctcattccttgcttccttcactcaagaaactgtttttccagccctaactctctcctgggccttctactaagtatctgcaattcagagatgactgagtcatgtcctattcacaaagaactgagggggacaggcacacaaacataaatcaccagacagcatgatggcagctctgagagacgggctgagaatgccacaagagaccctgaaggcttcccagagacatcattgagaccctgcagtgtgaagaagagctaatccatctcaattctcccatctgaaacaccactttttcctcaaagggctcacctaaagagtctgtggtattaaaaccatgcacacaaagcctaggcctatcccttgtaagtaggacatctgtacccagctgcatagactgactcggtgatgctgttattctggtttgttgcctgctaagcacccagcctgctgtgatcctggactggaatagcagtgacctcagcctttctccaaagctcatattcgtatgatcattcaggctctacactctccaacaacttgatccttcaccccgcccttctccttcccccaacatagatcttatattaatcaactgaaagcagatgttcttaggaaagaagtaggtcaggcctgcagacccaaatcccatccagtatttttacaaaatcttgactttaaaaagtgaaattgatattgcaataattaagagccaaatatgactaccactggtggcagataacatttcactttcattaagcaatataaaatagacgcgagaattcccggctgccaccctgacacaccaggctttgcagaatgaatcttaaattgcactatgtcagtcagagctcagaagttatcagcatcatttaattaactttttttttttttttgcaaaaactaacacattggaataaaatataaaaacgtaatccctgtgcaaacccaccactaatgatggcccccggcagaggactgagctacacctgagcagaaatcagggcattaaactctctttgtcccttccctgaagcctttctcctcaactgaaagggaaagaggggtcaggggtttcttccactttggcctagaagcctcgagaatgggagtggttctccttaattgagaccttggcatcttctcgtctctggcacgtcaattttcagccacaatttcctattgaaattgaatgtatttcttcccttaaaacaacaacaaaatttttactagttctctgataagaaatgataactggagtctttgactccaattccaagaggatattattacctataaatttcatttatggacgttattgcaatattggacgttaccttttagaaagaatgcatatttggggtcccaccccaagttaaaaggagacaatgaaggtgacatggagcagggaaaggaagtggttcagagtctcagggttcaacagcctttgcccaactgcagtaggctgtgagcagggtctctctcttgggtggtactcattctaccctgaaatgcaccaatggcaaataggtggtacatgtgtcaccatcctccctcccacactcagaggggacattgcaagtgagtcacagtactctttatacctgatattaaatttggtttcaaaatccttctaccaccacactcccagtggccattactggccaacacatgttggcacccaagatataacctgtttgccatcccttccttagtcaggaggcatatttcacctgttgccacctctgtcttgtgacagccacattgctgatgagagaattcaagctttcttgtccagattgtccaatgtctgggaggagtccaaaatcaggggcacttctcaagctattgagccaggagttgtcagttacaggggaaaaaagaaaaagactgccttttttgggcccctttatacaagaaacaaaaatgttatgtttgctttatcatcaattcttctgctaactgtttgttcttttttcctttctgttttctttctataaagaaataaagagtttaaacataggtaagatgaagaactctttcccatataatttgatatggttcgtttgcttccttgtgtttgctttttttgttttgtgcttcttgtgtaatgttgtatatttttatgtaccaaatatagtaacttttttatgtgctaattgtgtgttgtggatatgataagctttagcaattatgaaatgcagtcaaaaagcaaccaaataagctgacagtaattagaatttccgggagattcaagtgcaagataatgaaccctcagcgaacttctatcccgactgctcagtgcggtccataattgggctaaacagttgaggcaaactcctggcttttgtaaatgctggactgggttcacaaaagctttaatgaactggaaacgggttaaaaactcattttcaactcattaatgattttttcccctggatatatggtcatctttaaaaaaaaaaaaaagttaattgccaatctgctgatcagaatgaatccaacagtcagatgcattgagaattttcatggagtaaaatcacttttgaatagtttgaaggatggagaccaagtattctttgtcaaaaccgccttggtcattacattgatccaaggttatcatttaaaaccacactagtacaattcacagataaagtgtaaaacacacatacacgtgcattcacacatgaaccacactgaaatgaagatagtgtgagctttcttaaggaaaaatgaccttatttttattcagaagaagagaaaaaacaaagcaatctgtaccactactcaacggaatgcttctgctcactttttgaaatgaaacatggacagctctccttcatgatattaggtcaaaattagacaaaaagtagagtcaaattgcacaagatcataacagtcagtggaaaggccatgcattgacaaagtcctctgtcttcttctcaggcaccccaaaattggcctgttataggcaccccatttgagccaaattttaaaaatgagtagaaatgccctggaaggacatttttccaggaaattcaccaacctcatgtgatctttgccacagccacaggtatggaggcatggctgtccctctgacgtgagtttctctgcaagcatcttggtgaaaacaggtatgagaccatggagaagaatggtctccctaagcaagaactgacctcacacccaccactgcctgctcttctgccagagcttttgaaaagcctcctcaaatcaggctccctagaaagtccaaaattaattatctctctcataggtaggcacagatgtgcaatgccttgatccttctgttgataatgccagctactgttcattcagtaacagagtgcagcatctaattaaaaaatggcatgaatttttccctttctgccctaatttgttttgcatatatggatagtctctaatgacttaatagccaaaaaagaagaagaaaagaggaaaggaaaggaatgaaaccaggtagtctacgctttagttatctgggctggaatttcagaaaaactttgacttctagttcagggatgtgtcttaatagcaacctgaagagaaacgggaatgaaagaccatctcaactccacccagattgttcctaaaaatagcttcctagttcttttcttttttttccttaaatcagagaagaccccaaatggtggtgttttaattagtaatttactagctaatgtcaacaggacaaatgcatccaatgctgtcatctctctcaccttccctccacctctcccagcccctgtcttcccatcaccccaaagtaaaattgaaaaataataggaaaaggctggttgcatggtttatacctataatcccagcacttagggaagccaaggcaggaggatctcttgaggccaggagtttgagatcagcctgggcaacatagtgagaccccatctctaccaaaaaaaaaaaaaggtttttaattagccaggcatggtggcatgcacctgtagtttcaactactcaggaggctgaggcgggaggaccacttcagcccagggatttcaggctgcagtgagctagaattgtgccactgctctccaatgagaccctgtctctgagaaaaataaaataaaatagcaggggaaaataaagggggcctgtgctcatttcaaaacctagtctaccacactgaggcagaaaggcaattactgtttgcatcctagaggtgctgattgtaataaccagtataggaataacatgagcacctattctggtcccaacctcaaaccagtgacaggcactacaaagggaagaactgcagggttttgagccagaaggaacattagcaatatccagtatgattgatttaatccctccagcccctgcaaaaaagctaagacctgacacagtcaaatgacttaaccaaggtcaccaccagctgggtcagaattgagtttagagtttcctgtgttttagtcctgagccacttctacaagtcttactctgtcctagttagcctcacacagggcagccagacacatggcaggggaagcagcccaggtctcagaggctcacgccttcctaatacacttcacacacacacaaaggtattaatcccctagtgtggctgggagccctggcagaccgtggctcacgcctgtgacctcactgttacctagatttgaaaagtgcatctcctgtctcagtaattcagattccagacacagtaccagcaagatacccacatttctttacactaaatgccaactttatccatgtccacactgaagagcagtaaagaagcaagctctgagcctggagattgggggcggttatggggtgcttcccatgataaaattaggaaaactccaggtcaccctggtattaatggcctagtaccctggaagcataggttaaaatgagaacattgtcacatggaagtgttcctctatcccacttgagaatacactaagccctcaaggggaaattaaggagactgcacacacatggactgtagatggtcttgaataactatcctgcttacaaaaacaggatcggagtgggagctctcgtactggctaaatgaagcaacagttgtttagcatggtgggaaatgaattttctaatagcataagaagcataagtccaattagaagtagctaagaaccatgatgtgttagaacactgagtttgatgttagattctttccagttcactaaagtggaaagacactagagaaggtaagcgtcttgctaggatttttgtcattcctttgatctaggaggccagctccatagccccctcctcatttctctttgtgcttcttctactaaagcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtaaaggacatcaaggaagagtctcccgccccagataaagctttgccaccagcttggctttcttctcatcagaacttaactaagtccagcagtccaaaacacagctttccctgtaatcatttaactcagatagattgctttggtgtgtggatgggtgtttaaaaagaaaaccagtcatgaggtcaggagatggagactatcctggctaacatggtgaaaccccatctctactaaaaattacaaaaaattagccgggcgtggcggtgggcgcctgtagtcccagctactcaggaggctgaggcaggagaatggcgtgaacccgggaggcggagcttgcagtgagccgagatcgcgccactgcactccagcctgggcaacagagcgagactccgtctcaaaaaagaaaaagaaaaccttatttatttatttgaagaaaactttatcatgcacataggctccaagtggaaagtgaaggggattgcgcctggagatttctgactgctgccagtcaggagaatcagaggaaatcctggctccatgggccacagtgccagctgtgtgggctggagacagaacaaagcccagcgaggggcctctggccacgcccagacttccgtggtagacagcaaatgtgtatgaagtcgaaagtgcagtgcctcacatgttgtaaatgcccaataaatggtagtaattaagaatgggtataatttccaggggtccaggatggaggagttctgggaacccatgggtctctatttgaaaaggactaaaaatacttaacattaaggagcagtcatctgagagtccaattcctgttagcatttttagctactgtgaaagcagcagggcagcatggattaaggaggcaaagccttgtacttgggcactggggcaaagacacaaaataaatagaagccatatctgtgcctttccagccctgctgcaacaggggaatgctaggccccagtgtccccctggggcattgaagtgctgattggagtcaagcttaactgggaatacttcctgaagcatacaccttgaattaggagtttgtaactacaagaatcatcatttctcagcattactgctgcaatcggttgtgaagtatattcaagtaacttactactaataatgtttagggtaatgaacttaggaaataacttcttttctaaggagagcagatgcaaagttatttcctgcttcattcatttgcggccttggttcatttgcagtccaaggagcatgctttcgtcagttgcagggaagaaggtggtgatatagccagcaccctaggaactatacaaatcccagcacagtgcccatgggaaaggatcttgcgttagaaggctgagaaccactgctctgagggtactaatcaattccagtaaggtctctggtctaagcagagtgctcagcaaggcatctcatctcccacctccaccccgcaatcctacacctttccaagagataaatccacaccgcttgtcttgctcaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggtgagactctttcttatttctcttcactaagcaacacctgccccttggcctgaggttcttacctgtttcctgtttggtttggaagtggaatgggagggagagatacagatacagatcacggggttgtttggagaaagcctgagatgagctaaacagtaagatggagtggaaaatgtcagataggtatgagagagagagagagagcaagagagagggaaaactgttgagaaaagtggaactggtgacacactccagccgtggcagattacagggtagaagctgctctgtaattacctcccttctccatcattattgcaggtttgagaatgtactgtacagtgttatatgtcaatcagaacttcccctttaatctgaaatgactgcatcctcactatataaacctttactttgtgcagtagtaactagagcagagccctctacaatatcacccaaagtgtgtgtttagtttgggctgttagagaggcagagaacagaggctcactcaaatatacagcatttgttctcagacagcctggaatatacgttcagcctttctataacggccttttcaacccttggcgagcctcataaatttcagctcaagttccacaacagacaacttgctactgagatttttatttcaaattccatagaggaaggatgcgttcggttccgtttattttttaaagcagacactcaagttgtagtttgctggagagcctgcactttggctccccttggatcagagccatcttccaagtcacatggctcctttttgtgaattagatacaggtgccgcctctaaatgtacatagcttccgtaggcgtctgcttggagagcagagtatgggctggatggcatggtctcttgtgcagtgaactacctgtgcaaccatatgtaacagctctgatgctggtccagccatctggagctgagaagcagcatcataggtagagctgatggcctgttctggtcatggcaggtgacacggtagaaaatatatattatattatctcttcttctccatcacacccactcatcatgggcaatgagcagctggttcaatgaagagcatttctaatacaatgtgttattaaaaagctgtcttttttcctagatatataaaaccagtaagtgccgtacggttaaacgttggacatattaaaggctgttctttaatctgataccacgtcatccacaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgagtaagtgggtttgtaaagcatctctgaagagcccttcccttgccctagctggcattaggactgggtcgcttgtgtagctttttaaattgctttgtcacgttgtctttctaactttaatgatgtcttatggcctcaagacattcatgtcccctctccctgactctgaaatgatttgctctaatggatctctgatattgagcatcctccctactagagttgggaattcctgttgcctgcttgccgttcaaatttcaggatattggacatgcacagcacctgggaggtaaaatgttgattaactttgctgattattcaagtttgccatgggtgcggaaattagaatctaaaaggcaagatcccagtggggttcctgtaatttgccaataggtccagcaacacacttgattgcacagacaggtagataaactctgaatttcctccttagcagaagcagatcgatacagataaagcattaggtatattaaaagatgcgagagctggtcatatttcccctaacaattatctcatacttaatagtcctgacgcttgttttgcaaaaagctgtttttcctagctcctgcaggcagttcttggtcaaagtgtctgctgctgtaggtactaatggtgggatgctggttggaggaagttactaggcatgattctcccagtggctggctgagactggagcagaatttataaatatctggctctcctaggtgatgaaggagtgtgttaacccctgtgtacttggagtccttgcttgtgttttgtctggatgctgctgctagctcagaatgtagttaagttagggagagttggcacagcaaaaaaaaaaaaaaaaaaaaaaaaagcgggggacaagagggagaacagaaaacctcattgttgatcattcctaaacccggcaatgtttacttcctgtttgtatgccaatggtcttgggagaatgtaaaaggaagctgttgccacctgctggatatttagtgcattgcagaagaattgcttcccctggttctgactttcttctttgggcaactctttctcaagcaccttaacgatgcttgagatttctgaagcatcttaatacccttcaggacactgtagttttgatcaaactttaccagccagtgattctgccctcgagggtaccatccgagtgctgtccttggctctcataccgaattaggctgaagctatacactcacccaaacacctccgagattttcatcttcctttctgacagtttcaaccaaagacctaatgcatttcagaaacaatttgttggctctcctgaaagagggggaaaaaacatccctctcagggaggccagcctgaactgggcctggtttacagactgtcataaagaagcttgggttcaagtgcatccacagatctgaactctaaaagggaaagtattttccagaaagtgtccctagtttaatgaaaacataggcatgactcgtaattgtgttttaaaatgttcagaagttacattgaaactgaatttttttatcttaatttgataagctgccctttttttcataatgtagataaatccagtgatcacaaattctccattgtggggttcaaatgtatagggttttcttttctacctgaaaagatggtgagttctttttgttttatggcacttttggcacatgatcagccaattggaagacacacagccaacttaaaaatcagacataacttcacctcctgtcagggcagtgtggtcaagaccaacactgcatagccttagccaaaactttagagaaagggtgatgaagaaaaccacacagaggctgtgaggctactagaaaagtctgtcctggtcgggagtgatgcctcatgcctgtaatttctgcactttgggaggctaaggcaggaggatcactggaggccagcagtttgagaccagcctggccaacatggaaaaacctcatctctactgaaaatacaaaagttagccaagtatggtggtgcatacttatagtctcagctacttaggaggcaaaggcatgaaaatcacttgaactcaggaggtggaggttgcagtgagttgagatcacgcagctgtactccagcctgggcgacagagcaacactctgtctcaaaaaaaaaaaagaaaaagaaagaaagaaaatgatttgtccttcagtgagagcttccttagggggattcctctcttcccactctgttacagggggcagagtacaaatccccctataggtgagaagagtggccatatcttttttttctgcatagaacatgaggtacagaagccatttatctgccgtgttgtcacagtgactgtctaaatatggatttgattatccccattttattgataaagaaactgaggctcagagaatcgaagtgactcccctaagaccacacagggagttggtagtgaagcaggactggaatccagatctccaagcccagcgttctttgcattgcacactagcgttgtaaagcagggctatgaatggaatttgtaactccaccttcagactccacatgggaactgtccctgaatttttgggaagatgtaactcaataagaccagcctatcaatgactctggaagcaggagagagaaaggggtaggaaaaaataacactatcgaatcttcctggacccattttatgatcagccagttccagaaacttccaggacatccaaccgtggaattaagatttccccagatgcaggccactgggtcttgatagaagaagtatcctgatttagtttcatccctgagggaactcaggttttcacagtcttccccaaaaggcagcatcttataccagaaagctcctaggtcttaggaccaggatgacaggggtgtggagtccatctctgccacatgcttactgattgacgttggacacgttatttaacctctctgagcctcaatgtctcatctgttacatggggataaaaatgcaaattaacaacaggagccctgtgctaatccactgagataatacatttttagaaattagcaaagcgcttggcatatagaagtttaactcagagtataggctaatgggatttgagaggaattattaagcacacctctgtctccttcctacccctcaggtttcactcaactaactgtagagtggatacaagagtcagacagatagagacttattttggaaaagcagaattgaagaatgcagcttgcacattaggtctttttaatacctcactttgcatttctcctgctctcttcccacctcccagtgctgcctgctggtctctcatcccctgcaggagcagagtctgccttagcaaacttcgggctcagaggggcagaaaaacacatcacccttaaaaagaggccctccagaagacagaaatgataaagagcctctttagtcatgttcaactccttctcccaatccagcaactggggaaggggcaaatgtcagatcaaaggaaaagatggaagttgacttcccatggtgtggggttcaagagtgattttacagaataagctgccatgcaattcatgaaggctggaatgggcccctttaaaagttgcctctctctcctctttgtcctgggaagtgaagagctgggcagaaatagagctgatacagaatgccttttggaaaccctatcatgcctgctaagttcccagactagggaagatgcatctgtattcctgaaaagaacagtactgtccttaaaattacactctctactccctatactctctccttctccactccctcccttctttattttagtccttagcacctattactcaccatctgacatgctgtctattttctatcttggtttagttttgccctcttcagctagcatgagtgcaagaattttgctccattttcttcccagccgtatctccagtgccttgaactgtgtttggcacatcacaggtgcttgatgaatatttattgactacataattcaaaggcagcctccagccccactccagccaaggctgggccagttccattgggttggcattgagatcccattgctggaacttacagcgcttcactcctacatgcagtcatttgcaaaaagacctacatctgaagacgttccttgggggaagtaagtagagctggaggcagccgaatcttcttaaaagttaaagaaaatctgtttttctccctttggcccatgagattctagtccctaccctaaagctctgctccctaaagtagaaactccaattcctactacttctctcataaggaaactcagcagcctatgcattgtaagtgtccccaaactacagtggattggaattaaaatccttgccctggtcccagagaatgtacttgtcagcaggaggagaaactgtctgttactgagtaccgcactagacaccccgtatccaaatacttagaattgctttgttttctgatgttttaaataccttttgtttctgtttattaaacatgaaagtattgattacaagtaatttcttttttttttttttttgagacggagtcttgctctgtcgccaggctgaagtgcagtggcacaatctcagctcactgcagcctccgcctcccaggttcaagcgattctcctgcttcagtctcccgagcactgggactacaggcacacggcactgcgcccagctaatttttgtatttttagtagagacagggtttcaccatgttggccaagatggtctcagtctcctcacctcatgatccacccgcctcagcctcccaaagtgctgggattgattacgggcacaagccaccatgcccggctgattacaagtaatttctaaattatgggaaaatgcaaagaagaaaatgaagattcgtcaaaattccatacagcaaaaccaccattaacatttaaatgtctatattttcagagaatttctgctccatatagatactgatattttttacccctccctgaaaaaaaaagctactgtcaagggagtatattttgtaccccacacttccactcaacacgtgtagatttgtgtatgccaataaatagaaacccatgttgtcgatcctgatggcttcataggtttctactttatggatagatcatcagttatttaatgaatctcccatcaaggaacatctaggttgttctaatttgtcactattgtaaatagcacctttgtccccctgcctgagaggtggcttctttagcaggtaagaaagcacagaggagccctattgatttagcagacctaagtccccatccctgattacaacaccagggctttccagggagtgcatggtctgcgccaccccatgcctggggccctgggcgagtgatagcggtggatcctgagctcacagacattcctgctccaagatctccctcctctctcccccaacacctttaggcagcgcggtgtacagcttaatgtgattgcactctcagctttcaaacttctgcagagcttcactgcttctagttcttcccagaagcaaagtttctcagatccctgaaagcctgagccaggtctgcaattctttattccaaaaacatttcctgagtgctctctgtctttgatgttgtcatcctaagccctaagcgacaacatccaacaggccacagcggtcctttccaccgctcacaggccctccccacagggatccttctctgaggaccccccatccccacgcgctgcacaagctccagttcccatccctcagaccctgccagctttttccctctccccagtccaaagggagtaacccgcaggagttgagccactttcccttcttttttaccctccaagcaaaatgtcttcatagctccgccttcttcctccccttcctcctccagtaacaaaactcatctgggagagctcaaaggcctggaaacgagcctgctttcctttcctgggtgtgagaagggcccagctctcagagtacagtggatcttccaaagtggggaaaggctgtcccaactagaacaaggcttcttgctaaaggtgatgtggggagaaaactccacggtgtgagaaaagaggaaagacgacacatatacataaagaaggaggccccagtgtcaggccatttgcaggcagtagggcatgatcactggtgtccctagacttacttgggtgctaaggacaactgctgatggtaagggagtcattgggaaactgtctaagaaggctgcttgggaagtggagccatggcggtttagtggggaccaaagaacaggttccatgcagccaggccttctatgctgagccaatttgtgcaggtggcatttggcacaggctgattgtccagaggcctaggagatgacaagtgagacaaggttggactccagtagaagactcagggcatggatggtctcaaatgcgagatttttatttgatttagcaaccaatgggaaaagagtgtggtttgttcagcagggaactgacatggtgaaactgctatttggggaatattgatttgatggctttgtagaagacctaaattaaaaaacaagagagggccaagtgcgtggctcacgcctgtaattccagcactttgggaggccaaggcaggtggatcacctgaggtcaggagttcgagaccagattggccaacatggcaaaaccccatctctacaaaaaatgcaaaaattggccaggcatcgtggtgcatgcctgtaatcccagctgctcgggaggctgaggcaggagaattgcttgaacccaggaggtggaggttgcagtgagcggagattgtgccactgcactccagcctgggacagagtgagactccatcatctcaaaaaaaaaaaaaaaaaagaaaagaaacagaaaagtaagagaagctcacaagtggctgttttctctaactaactagaggaagcctgagaccaggtgaaatgttttccaggagctgaagtcagttatatcagcgggtagaagaaagcatcacagctgtttctccgggcataatagggttttgactgtgacgaggggcctcagtgagatgcgccacccagccaacccaccttcccagctctttctctggccctgtgagtcttgggaacactgtcagccccaatgactgctgctaaccagggtttatctatctatctatctccccccagctatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaaggtgagcctccacccataccatcctacccccaaactcacccatagacccagaacccagccaagcccaacatgtgagttatgcagcctgggaggacttccagagacccagcgtacccctagctttctattttattcaagtgtccacagcaaactataagaggtcaatcttgtagaaaatgacttaatcagatagaacagaatgtcatctacacccagccaaatgtctagatatttgaactgtctacatagttatctgaaaatgtccatttccacccgccccccacatactctctccctacctcttacccttccatcaccacctctccccaccaacccaaaacacatagttatcttctcaaaggccatttattctcctggctcaccactagacttcatattttcttgttccatcctgattctctcttttaagcatttgtttgatgagttggttgccctgggactggagctctttaacattctctctccaagactgggatctcaaaggtctctgcccaccctgtggttattgttgctactagacatgttttgcagtccagggcaagcactggggctggcaagaaaatgaattgtgccgattaatttttcttttaattaagatataatgtcggtgggctagcccgttgtcagaggataaaagtgtcctctcagtagataaatggtgacatttctggactattatcccacagcggagcctgtttcaatgactctatttctgctctgccaaatgattaatgatgtagattctgtccttctgcgtgtgacggctggagtcacaggagcgacaggtacacacttgctcactgccccaaaagctgacatctcagaggccagcccaggccagctcctttgcccagacagtcaggaagcagtgtatctgtaaaaggagtctctgactcacatttccttcccgtaacttttcggtaaaggaaaaggtcagacgtctgattgactcgtgtagtttccactggggaagataaacacattatcagcacccacccactgactccagctccctgatgtatttgagtctcttcagagttctcttgagtgggggtggtatcaggtgcagtcggcagtaaaagcatgaggatggggaaggttgacttcttctctccattttctcaaagaaagaatcctgggctttgatttgtagtggatctggcctgtggctagaccagcaaccttgggttagacggcaggcaaaaggaggaaaactgaagtcatttgcctttctttttttttttttttttcctggtataagctaaaatatatatgttaagcttcgggaatttgattgacacaaattgtgtaggcaatagacatctttaaatgtttaaacgtgctattaatagtcttcagtgagtaaaagaaacatcacggcataattatttctggagtgccacatattatgtttttctttacgtggatcagtagtatctctgctacttaccttcacatggtatgtatgtgtgctaattgaaggcagccttcgactaatggctgcaaagtaccatggaaacctattaaaaaaaaataggggttctattctcttctgactaatagagcggataatttatttccctatccccacccccacttacatttttccagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtaagtggttccacccaatctgttaccacagagtgggaggggatatacactttcctcacagagctgagaaagtttctctgttaccacagagtgggaggggatatacactttcctcacagagctgagaaagtttcccagcttcaaagcctctaatacccctttattccctggaaaaggcaaactctccactcagaaggtagaatccatctccctttgggactcataccttgggaaaaacgttctccatttccatttcctaggactgaaaaaggcggccatttcctgctatggggatttacattacgctgtaactagagacagctttggtcttcttttcacacttgctgtcttcttcttcctcagttttcactgtctggccagttcaaccaatgaattggtgttcgtgcctactatgtgctgagtaatttgctaagtgctggaagaacaaaacttttaaagtatgttctttgcactcaaggaattgagggtctgataaaatatgcagacacaggatgatcacaggttaagtgaaaagacagaggtacatgcagggtctgatgggatcccagagggatgccactcagcctgagaggttcagggaagatttcccaagaggaagtaacaactgaacctcagtggggagttttagccaaccctcgttttcccagaccaggcaacttgccccacgtgacatctttttaaaaccaatatataacattaattatattattattataattattatataatgtaattttatattacatttttatattataatgtaaaccctatattatattataatgtataattatatacattatatgtatacataatatacatatacgtatacataatatacatatataatacattatatgtatacataataatatacattacattatatataattacatatataattaatgtataattatatgtataattataatattataatgtaaaccctatgttaaatgctttgcttgtattattttaactttttcaatagccccacgaggataattattactatcttcatttttcagatgagaaaacagactcagggaagctaaattacctgtccaaggacacaatagctagaaagggcaatgccaggactcgatcccacgtctctctttctgtctgactcacttgccaatatgtcacatgccttcctgcttatccgtggtcatccagagcttctcagcagaagtggattctgctccagtcacttatctgtcaccaagagggaacagttcctaccatcatgctaaccccttccctggggagggggaatgtaatggcatacaaagcaaaggccataacttcctgcaccttaccttcaggttgcggggagatgggagagaggggtagatcataagtaaaaactaataaataaaaataaataaataactgcagaacaagacaagcactaggaagtcagtaaacaatggaacaaagaaagagtttatcaaatgctttggaatccctgagagtagaaggctcagcatcgccaaagcttgggttgtaacttttttgctgtgtaactggattgaaatccagccagcccaggtgacctccctgcagagccaggcccctccatattaagattccgcctttgtctggctgaagtttaagtcaagtctccacattaggttagcagcagtctcccaggtttttcttcctctgctggtatctgcaaagttgcaaactgcagtagcctcctaaagacaaaaatggaatgagattagtagttaaatccttaatgactggatttcagggctgtgtaattgatttttgatatgctgcactgtagaagttgattataagtagtaatcgtgccttttctctgataaatcagttatgcattttgactaagttttccaaataaagataaatgtggccctaaaataaagtggctataatcccaactccaaatattaaaactctttctttaataatggtacttgtggtaattagcccaagttaggcacacaagtcttataactgaatttctgccagggttagatttgctggcatcgtgtttatgcaaatcaaaacacagttttatctatcaacacctcaacatttaattgtctggtgttagttcctgtaacaacaatcacatatccatttagctctcttaaatgaaaatcactatgagattataacaggttgagtggactgaaaatgtaatttgaaaatgagggagaaagcctggaatttatttgcatctcatttattttaattcagttcgtaaactgtttagtgaatgaaatgaaagcaacttctggaaatggcaggagagcagttggaagaaggtataagggaaatgttgggtgtgatgtggattgagggaactggggagtggccatttcgtcagatgtttcgtgagcccatggcagggagtttgcagcccctaagccgaaggtacccattggccccataaggctagcaggctgtctcaccattggcaagatgggctcttctctccctatctatctatcttagtcttgctgtgtcttttcatccctgctccactgtcacatgagggcatgaaagttcatttattcaaaagatgtttattaggtgccaacactacagtcagtaccacggaacaaggagactctagagagataaagaaaactgggtggcaccgactagctaacggtctcatggagaagacaatattagtagtgtgatgtaagctataatacaggccaaaagcacaaagaaagggatacttaactgtatctgctggaagaggataggccacggccaggtaacaaattaaccctgaaatctcatgggcgtaacacatcgcagtccaaatgcatcgggcggctcttcttaatgaggacttgctccagttgctctgtcttgcgatcctgccatcttaagcacaggctctgtgcagttgctgcagcaagggaagagagtttgggtgattcacgagagcttaataagcaggcctggatacggcaggcctcacttccacccaccctggtgagaacactatcagggaacctcaactgaaccacagggaagcctggaaaatgttgtcttttctgagtgcctaagaagaagaagatgaacaaagacttggtaagcacgtagcagagtgatcaggtctcccgtttgacaagagatcaggaagggcttcacagaggagctggaatcatttctgtagagtagtaagaatcagccaggcagagatagggaacagaggtgacaggacaaagaatgtcgccagtggaaaggccaagaggccaaaaagggaatggcatttcagaaaactaattcagtgtggcagtggatgtgttagagagtagggtagaaaaagaagatgcagccagagactgcacatggaaaagaacatggtgccaggctaacatttatcctgagggcaatggtgagccctacctggacttcattagcagagtgatgtgctgggatgtgtggcattagaaagctctctccagcctgggcacagtggctcatgcttgttttcccaacactttgggaggccaaagtgggaggatcattttcgcctaggggttcaagacaagaccagcctaggcaatatagcaaaaccgcaatatagcaaaaccctgtctctacaacaacaaacaacaacaacaaccaaaaaaaaaaaaaaagtttaaatagccgaccatggcctggcacagtagctcatgcctataatcctagcactttgggaggccaaggcaggaggatcccttgagcccaggagttggagaccagcctgggcaacatagggagaccctgtcatggtggcacatgcctgtagtcccagctattcgggaggccaaggcaggaggactgcttgagcacaggagtttgaggctgcagtgagttctgatcatgccctgtactccagcctgggcaacagagcaagaccctgtctcaagaaaaggaaagaaaagatctctctgacttcctcaggtatggaggaagacagatgagaaggggacaagatagatgataggaggagagggacagtaaggagggtgctgcattagtccaaacaagaaactaaatcactagcagcgaggaaagaaagaaggtagggggagagatttgagagatgtctagcacacgaggacgaggattgggcaactagcagggttgctgtgtcatgctcaccttttgacaggctctccccatgatcatgtaaactgggaaggctgggtggccgtccacgctttgtgggctctgtaaaagagagtggctgggagctgaaacccaagccagagatgtaagattctggtggccccagccctgcctcttggaatggagaagaaactaaatgaactttgaaatgcagccacttaaccagctccatgtaatcactgctccccatgtggagagcagggatttggagagaatgtgtgggtatcatgcatgaagcaaatagcctgaacgtccccgggactggcaagctcctgggagcctggtcagctgaggggtgtgagggcccaaggctctgaacattcctggagtttagagaagaccaacaatctcagtgaagccatcacaatagaacagtgcccagtgaaattccaacccacctaggtaccctttcttcccacaatcctccagacggaggcatctcttagtggaggaaagtatcagtggctcttccttacagcctggggaaatgtaagatgatggcggatggatagaccgggaccacatcctttcaccaaaagctttgtaatggagtgttagtcccttcattcctgcccaaactcagtgcagggaagattttcattatgcctcccaagaactcctcaaagaatctcctttgaaagagtcctccccctccttcccgcattgtcctccattcctttcttcactcactctggccttgcaaaaacatgaagcaggccgggcgtggtgtctcacgcctgtaatcccagcactttgggaggccgaggcgggtggatcacgaggtcaggagatcaagaccctcctgaacaaaatggtgaaaccccatctctactaaaaatacaaaaatcagctgggtgtggtggcgcatgcctgtaatcccagctactcaggaggctgaggcaggagaatcgcttgaaccagggagtcggaggttgcagggagccaagatcgtgccactgcactccagtctggcagcagagtgagactcccatctcaaaaaaaaaagaagcagttacatcatggcatctgtgagctccataagtgcagggaccaggtcgcccctgtatccctggtgacaagtgccatgtggtgggtactcagacaacaggtgacaaagaaagatgtaataactgtgccttctataggcgccttcttaatgtgtaaatgctcccccaccacagtgggtataaattcacaaatacattgcccctacatctgtctggaatccttccactgcaagagacaggaagtgcattcagactaacttagaagagtaggcgctgtcttacctaacagggccaccacaagggagaagctggcctcagagactctaagatgtcattaaatggtgtactagtctgttttcacgctgctgataaagacatacccaagactgggaagaaaaagaagtttaattggacttacttacagttccacatggctggggaggcctcagaatcatggcgggaggcaaaaggcacttcttacttgacggcatcaagagaaaatgaggaagaagcaaaagcggaaactcctgataaacccatcagatctcgtgatacttattcactatcactagaatagcacgggaaagatcggcccccaggattcaattacctccccctgggtccctcccaacacatgggaattctaggagatacaattcaaatcaagatttgggtggggacacagccaaaccatatcagatggacgtctctctttctgtttctcacagcccccttccatcccatggcagggtttctctctcggcagttgacctaattttctcctacagtagactaatgtcctcttcacattgcgggggtggggggtggtcaggcagacttagccaaagttgactccaggcttacatcatcacagctaagtgaacccagaggaaaaaggaaggtatctcccccagcatttctatttttcataaaatatctcatggaagaaagattgacctggcagagggagttcacattcctgggcaaatcactggtcagggagctggggatctgtgatgagtcaggcaggcacaggtcacatgaccatacctgtatcttataatagacatctcagtaaaagcacctagacagggaagccctagaaaaaagaggtgccgtacccaaaaaagaaagaaagagatacaaggttaaaatataaatatcccaaatatagtctacatcctccatccctccgaagcctaatcataaggcgaaactcctggccctgaggatctaaaactcctggccctgaggatctcttgaggctctattgcctcccaccccaacaagccttttttctaggcttttggaagagagaactgaaatcaaccccttctattaagatttaaaacttctaccctttcctaaaacggatcttgtgcaggatgattctctttctttgtaaaggaaagcatataaccacgctctaggatatttcttcctgattgtgatttacatagagattgcagaagcaagaaacagctacatgtgtaggtagcagaacaaaagaaaaattgcttccaagataatcttccatcatgatattggtattagtgttattagtattccaagaagaagtgggagttagtaattttgttttggctcccatataattaatatgacattgcaattacgtgttggcatgtgttacttttacttatgtggcaaatcacagtgacagaggagggaggtggggggatgggcgtgcctatgtgcatgtgaacacacacacatgaactcagttctgcgtggagcccactcaagccggtctgttaacacacacaagtcattatgaaagcctgaattttcacagctccttcctgccacaatgcattcattcttcacgtgactaatattttatatttcaaacacctcctgtgttcttggcactacgctaggcactgagtgtacattagtgaacaaaagatttcaccttacatggtgagcagcacttgtgcaggcagaacttgggataaatttaatattagtttaaataacacataattagaagggcaagcctctgcaaacagattaaataatgtattccccaagcaaacattacttttgggtggcttctgtttgggatgatgatgtggaaaagtggaaaaaccctaatggagcttatgcctttacctcttataccttagcaaggagataataatccaataaatgtacaaacaatatatagaaattgtgggctgggcacagcctgtaatcccagcactttgggaggcccagacgggtggatgacctgaggtcagaagttcaagactagcctagccaacatggcgaaaccccatctctactaaaaatacaaaaattagccaggtgtggtgcggcacgcctataatcccagctacttcggaggctgaggcaatagaatcacttgaacatgctagacagaggttgcagtaagccgagatggcaccactgcactccagcctgggtgacagagtgagactctgcctcaaagaaaaaaaaaagaaattgtgatgggtgctttgggaaaaatgtacggtggagctaatacggaatatatgatataggttaagccctctctgagaaaatgacatttgaactgagaactgaatgaagagtaggtaggaatttcccaggcatggagttgggggaaaagcctctatgctaaagccctagcatgtgcaaaaggccctgaggcagaagagacttctgcctgtatcctgaacagaaggagagctccagtgtggctggagtaaaccagctgagggtaaggtcaaggggtagagccttatcttgttggcccttttaaggatcttagaaatacagaagtcttctgcagattatccacccggtacatgcaaatgagccctcatcgggagcctccttcttggacactaggaaatatacaacatacctgactcctgaaagttcaggtcaaaggataacaaatatagcttattccggtcatctgggctgagcctccataccagacaccctctgccccttctcactacatccctaccaatggaccacccacctgcactagaatactcacagcatcacctgaaaacagccatgctctgcctgtgcaaggcctttgctcatcccctgtgctttcatttgctgaccctccccacctggaatattctccctgattcttctcccaccctcacctgtccaagccttactcatacccaggcccccactgagcagcgctttctctgggaaatcatcctcatcagtcccagctctggttccacatccttcctcactgccacagttccttccctgtgtctactgccattaccacactaaaaatggtttttgttgttggctcacctgtcgttatccccctctggcctgtggcctgcccctctagggcaggggtcataactgtcttgttctatcttacaacagtcccagtaacaaacacagagtaggtgcccagtaaatattgaatgaaagaatgaatgaatgaatgggattttccactgacataatgaaaatctgctccctcccacgtttgcctatgaattccaggtcccaggggccttccagaatgactctaataggtctttggaatgaagcttttcagatattttgagaccacagatgtcctaatcatatatatatatatatatatatatatatatatatatatatatatatatatatatatatatatttttttttttttttttttttttttttttttttgagacagagccttgccctgtcacccaggctggagtgcagtggcacaatctcggatcactgcaacctccacctcccgggttcaagccattctcctgcctcagcctcccaagtagctgggactacaggcatgcaccaccatgcccagctaatttttgtgttttctaagtaaagacggggtttcatcatgttgaccaggctggtcttgaactcctaacctcaagcgatccacccgcctcagcctcccaaagtgctgggattataggtgtgagccaccatgcccagcctaatcatattttctattcctgattttccacgttggaactttagatcatcagagttagcagggttcttgtacccagtctgattcagtctgcttattcactaatgttcattgagcaccaagcactttccaaaacaaaatagagacactaagaaaaataagataaagtcccgactcaccagttcccaggctattacagatgaggaaactgagacatgaatggtgaaggtatggttttggtatggcaaagctaatcagtgacactgatgagtatcaaaaccgccactcaaactcgggtctttccacctgacctccatccaaaacagcaagtcatccaaacataatgtttgcttggggaatacattatttaatgtgtttgcagaggcttacccttctaatgatgcattatttaattattatattaaatttatatttaattattaatattaaatttatagcaagttgttttgtctccacaagcactgatcccaatgtagcattgagtcttgttgtgtgggagctggggatagctactttttaaatcccaggccgggcgcggtggctcatgcctgtaatcccagcactttgagaggccaaggcgggcagatcacaaggtcaggagatcaagaccatcttggctaacacggtgaaaccccgtctctactaaaaaaatacaaaaaaattagctgggcatggtggcgggcgcctgtagtcgcagctactcaggaggctgaggcaggagaatggtgtgaacccgggaggtggagcttgcagtgagcccagattgcgccactgcactacagcctgggagatagagtgagactccatctcaagaaagaaagaaagagagagagagagagagagagagagagggagggagggagggagggagggagggagggagagagaagaaaagaaaagaaaagaaaagaaaagaaaagaaaagaaaagaaaagaaaagaaaagaaaagaaaagaaaagaaaagaaaaaatcccagaagactgacccggaaagaaaatgaagatgtcctctaggccaggctttacctctgggtaggtaaataactaaactctccaaggcaaactcttctgcttttaaacgtcgccagacagggagactctcgtgacccccctcactaatcttttttgggtttcccatactcaaagcaggatgggcaaagggttcttctatacgtctaactgaaatctctcctgctgtgttacaattccgtttcctggaggggatccagcccagtgtaatttcctccctcatgtttctcaaatcactagctcccgtcattgcgcctggagctaagttagagtcaccagttataggcccagcagggccgttttgaagacagcgtttccttttctccaggttttttatgagcttccttgtgacaggcgtatgcttggtgagatcaaaacgttctggggggatattctgcaggggaaaccacttcccaaagtctgccctctgcaaaaataaaaaagcatgctaaatagctgagttttattaactggggaagccaggctgaggaaaatgcccgataattaaaaataatggcttccttacaaacacaaaattgtattaacttaaaaattggtttctctatcactgaattcctaccaagccgactgggaagggaatcgtgttgatcccggcagtgaaaataattcaaaataacttttatgttctccaggaagcctcaaggttaatttaaatattgctagctgggtaatttaattcagaataagagaacattgcagctaaattaaagctcccacatgctctaaactgggggggcaggtatcctcaaagggccgatcgtgcctgttggaccctccagcatctcgcacccacagccggggcacccccctttataaatggcaccctcataattaaagaaatttgattagattacacaactggcctgaactccttggctcaccttccagtgaatttttcagatttaattattagaaggattgggcattttaatagaaattttcacatttcaaagttaactcaaacctgtgctatcaaaaaatcccattgtcccagggatatggtaaatttgcaagtaaaaacccaccctaagttatccatggctaatggctagcacctatcattacttctttatagttggtgcacctgggtcaatggtcagaggcctctcagctctaagtaacagcagtaaatcccagggtggcagtcagaggttagggacccctcttctttgtttacccagtatttagttcttttgtaatcccatccaagcactaaccaggcctgatcctgcttagcttatgagaccaggaatgttcagggttctttctgtaatctaagcaccctcacacactaatatcatccttattatgatagtcatgatcacatatattatttacatgttggtctttcccatgattacatattatagtatattatgcacacatatgtacatctatacacacatatgattatattatggttatatatgtgattttcccattggtctttcccaggtaactaaagataaggccttatatcacactgagtgtattttaaccaagagtacacatcagaatcacccagggaggttttaaaaatcaaaaatccacagctgggcacggtggctcatgtctgtaataccagcactttgagagactgaggtaggcagatcacttgaggtcaggagtttgagacgagcctgaccaacatggcgaaaccccgtctctactaaaaaaatgtaaaaattagccaggcatggtggtgcacctctgtagtcccagctactcgggaggcagagacatgagaatcacttgaacccagggggcagaggttgcagtgagccgagatcgtgccactgcactccagcctggatgacagagcgagactctgtctcaaacaaataaaaatcaacaagacccaaacccctattccctgaggagctgattcagcaggcgtggagccagccgagcagcagagctttaagagagtgtcccatgtggtttagaattgcatgcttgatggaaagcctgtagtccaacacccctcaatcctagaggtgtacaacctggaggttaagacagcaagctctgtatggggatcctagctctaccactgagtatttatctaaacttgagcaagtcacttaaacccatctatatcttgtgtgcaaaatggggatgataataatgcctgcctgagagtgttgttgtgtaaattagacaaaacaagggcaatgctgagaataacactcagcctgtgtaaatgctcaacatgttgctgttgctgtggtttttcttccttgtataccagagcagacaccaaagcctggcattagctgacactcaatgttcaataattaataaatgcactagggccctatgatatgagcaaaaagaaaaaaaaatataagaaaagggaaggaggaaaaactaaggatggccaaggggatggaaataagtaggcatgatggcaagtccccagcagttgcctccaaaaaccctggaaatccttcctcattgttgcatcattcattctgcctaacaaaatgttggagaggtcttgaaccaaaatctgaaacccataggtttaagaatgatggtggccttccgcagttgtcccagatgaaccaacccgatgtgaccaagcttctgttggcagaggagaagacctatctttctgaccaccactgtgtgttttgctctgaaaatgatggctccaatcccgtataattcagacggcattaacttttggacctgtttttaaaaaaataaaaaatcctactactcagcctttgccttcttgactattcccagttgctggaagttgttgataggaatcttccacttgaagttagggttccttataatcccaagaactcaccacctttatttccctccccatgctttgatgcattctcttttctttttctttttgttctttttttttttgaaacagagtctcactctgtcccccagggtggggtgcagtggcatgatcttggctcactgcaacctccacctcctgggttcaaacaattctcctgctcagccttttgggtagctgggattatagacacatgctaccatgcttggctaattttttttttttttttttttagtagacacagggtttcaccatgttggccaggctggtctcaaactcctgacctcaggtgatctgccaatctcagccccctaaaatgttgaaattacagacatgagccacacgcacctggcctatgcatcctcttttctaattgtcctataataaatattctatcctctctctgagatgaccttatagaaacagcaatggtttggagaatctgtagtcctgggttcagattccacttctgccacttgtctagttatgggactcctgtagacctcagttgctcttatgtaagatagtttctatgtcatgaaagtgaaaatgggatcaggtatgtaaagtacctagcatagcacctgccaaagtatcaggggcttgtatcaatttagatttgtttccaccgctagtaacagagattagcaatagcaagggtttaaacaggatttacgcttattattttcctatgatctgaaaggagcttagggaaagcaatccttggctgtatggatgaacactgaagacacctagatcaacagagatctagactctttttctctggataggccatcatcctggaggtctccagccccaaagtcacctcatagtcacaaggtaaatgctggagctccagccatcacatacacatttcacccaggaaaaggaggaaagggaagaattaaagattgcctagctctcagctgagtcaatttcctttaagaatatttcccagaagaccagccaacaacaaccacttacatcttgttggccacccgtatctctgaaggaagctgcgaaatgtgtttcattacctgggcacaaagctgtttcccagaatgcaagtgtctgtggtattagaattattccttgtcccaccccctcacacccccaaagctgcaatgtggagcgttcaagggctgtgaaaatgcttcacagtctgttcatcatttgacacatttcagggcactcaatggacatacaatacaggaagcagtaaagctggtgaagtgtataagaagttaactggttaaagtctgaaggcctaagttccagaccaatccaaccacttcactgctgtgtgaccttgagcaagttttgtaaccactctgtttgaagctttttttatcatttgtcaaatggtctttgtgagcaacaactcaaacaatggatgcaaaatgcctaacacaatgcctgtatatattcgtcctcagcatatattaaagtcatcattactatcagctgggcgtggtggctcacacctgtaatcctagaactttgggaggacaaggtgggtggatcacctgaggtcaggagttcgagaccagcctggccaacatggtgaaacctcgtctctactaaaaatacaaaaattagcccagtatgatggcacatgcctctaatcccaactactcaggagggaggctgaggcaggagaatcacttgaacccgggagacagaggttgcagtgagctgagattgcaccactgcactccagcctgggcaacagagtgagactctatctcaaaaaaaaaaaaaaacttattattactatcatcaccaccatcactaccatcattattaccagtaagtgctgttgaattattagggtaaagtgaggaggtaccagacatctctcgagtctcttcctttcgcctatttacatcatcccttgccttcagcagccaccccagggatgtctggatttgcagtcagtgaagttgtgagagcctgggctgagtctggttcatttcattcacttccagccacccactcagggctagctgaatctcaggagcccctctcctttgcccctcaccagagtctagtctcccagctctgccttctgggataggctttcttctctgatcagatcaacttctaaataaatattaaattatgtctgatgtgtttccctattcctttcaaatctaagtaaatcagttcatccctttgttggaaatcccctagccctgctgaggcctccccactgatgtctcacattcttgacagtgacaagatttttctctagatattagaaggaaagaagttcacataggaatgaggcttcatattcccaaatctttgtaaaatatggatttctaagccctgttctccactcttctaggtaactttacttaagatttcataagaaattatggcacctgttcttaaagatcattagcttctcagctaatgatgtgccaaaaagagttccaagtgtgcaaatatgcaaactctcttgcccccagggtggccaggcagcccaggcaaaactccagggttcaagtctgttgtatattgctgtataatttgcacactgcacaattttcaccattcacactttccacgatcctatggcaccctttgtaattgtgcagtgcacagcctacccaactgcccatcacagccatgcccaggtcaatcatctctgtccataagctgccttatttttatattctattgcatattgcaccatacaaatactaccattttcttttctttggttttttttttttttttttttaagatagagtctcactctgtcacccaggctggagtgcatggcacaatttcagctcactgccatctccacctcccaggttcaagtgattctcctgcctcagcctcccagtagctggaactacaggtgcatgccaccatgccagctaatttttatatttttagtacagacggggtttcaccatgttggccaggctggtcttgaactcccgacctcaggtgatccacccacttcagcctcccacagtgctaggattacaggcgtgagccaccacacccggccaaattttgccattttctatctgtgccatgataaggagcttagaaagcactactctaactttggggttatttcttcctccagtgaacacttaagccctggccatgccagccatgtcctccacagaagcctgagccggcatgcctgggtgatgtctttcaaacaaggcctgttgtgttttcctaggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaaggtaggtgaacatgctgccctgacagcaagggctttctgttatttctgttattccggcttctttttttttttgagacagagacttgctctgttgcccaggctggagtgcagtggcatgatctcggctcactgcaacctctgcctcccaggttcaagtaattctcctgcctgtgcctcctgggtagctgtgactacaggcacatgtcaccacgcccggctaattttgtatttttagtagagatgggtttccccacattggccaggctggtctcgaattcctgacctcaggtgatcgcccacctcagcctcccaaagtgctgggattacaggtatgagtcaccgcacctgaccatttctgctgctcttgtaagctagcctgatatgttttgccatgagacatcttaacatctttacttcgactctacaaggacttccctcctgctcccaccctcacagagggaagaaaatctgaaggcaaatgttattcatagctcagcactattaccattggggtggggggcgggggtgctagacgctcagtaatggcaaaaaggacgaattgtctgattctatttcaaaaaagaaaaaagtactgttgaagcggacagaatcatcccactggcagcgtggctcatcattacttatgaattggaaatgcagtgattcatttctgtcttgccctaaattaagccgtcaggatggggaattttgcctaaaattcaagcacacagagcaaccctctcctatttgccctgttggctgaaacagcccatgaattctctctacatgattccctgtgtctgaaagtgccaaattcaggtcttcatgcttgaaaaaggtcaggttggagtggcggtaaaaaaaaaaaaaaaaaaggtccctttgggcacgtatcaagacttttgaaggctgccctggccatgtagtcattagacagggcttgctcaacccgggcctctcacctagactccccttggtgcaggtccattccttcctttctcaccaactcattacagcggtgacttgcagacaaagctgttacccctctgcaagacagaactgctgtccccttggtccttcctgaatgctgtccttgttatgcctgaaacacaggaatgattgaccaggggagcaggaacctcccaattgcctctaattgaagtcatttttttcccccaaagaatcagtgattctaggttatttcatctttgcagtagcttcaaaatgcaggatgtggctgggcgcaatggctcacacctgtaatcccagctctttgggaggccgaggcgggctgatcacttgaggtcaggagttcgacaccagcctggccaacatggtgaaaccccgtctctactaaaaatatgaaaattagccaggcgtggtggtgcatgcctgtaattccagctacttgggaggctgagacaggagaatcgcttgaacccaggaggtagagtaggttgcagtgagctgagattgcaccactgcactccagcctgggtgatggagtgagactctgtttcaaaaaaaaaaaaaaatgcaggatgtgttttctcttttttaaatttaatcagggtatgtgtttcacacagctcccctgctggacccagtggcagtcatttctaagcaatcttggggttccttgttattgagcatggaggtaaacctcatgcctcttacttcagctgtccaggccctcaattcttaaagtatcatccaagcaacattggcatttgcagggagtttgttacaaaatgcagattctcaggccccaccccagatctaccaaattagactctgcctttttacaagatcctgagtattttgcatgcacattaaatttgggaagcactggtctaggcaaccaccatgatccatcaaaattggcatgtccagtgaaataaatctgtttaatctggtctaagcttcccatctttcatgacttttgagttgacatttggggaaatggactaaattctgtctgtttgaatgcttggtcctcaaaagccaactgatatgttctgttcccctttcctttctgcagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacaggtgaggattctgccaccaaaggtgggcagtggctccctccagggtacttgttgctgtggggaacttgggaggaaggtctcccatcttatggtaggagaagcccatgggccataaagcccaggcagtgcagttggcagcactacagagtctagaaaagtagagagacggcagtacagagcagtcatgaggactgtttgaagatgtcccaaccactttcatgtccagtcagttgaaataactttataagagcccttcctaccccaacagaggaaagcagtaagaagcggggagagaatagggctctggtgtcagaaatacctggttcaaattctctctcttctatttataagccaaaggaccttggactagttgttcaatctctctgaactatagtttccttccctgtgaagggcactgataaaaccatcctacagagtgatcatgacaagtaaatgaacacagctgggcatggtggctcatgccacccacgtaatcccagcactttgagaggctgaggcagatggatcccttgaggtcaggagttcaagatcagcctggccaagatggtgaaacaccatctctactaaaaatacaaaaattagccaggtgtggtggtacatgcctgtaggcccagctactcaggaggctgagccaagaaaatcacttgaactcaggaaagcagaggttgcagtgagttgagatcatgccactgcactccacctagcctaggtgacagagcaagaccctgtctcaaaaaaaaaaaaaaaaagtaaatgaacttgtgtagttatagtctagtggatgatcatgaaatggtatctgcttgtgttattaacattgtcattactagagaagcaatgagtgagcgtaagtatcgagatgactgtaacccagttcctgacctccagaggctcatctggtgagagacatattcaaataaccaacgataatgcaaagtagaattaagtctttgctaccatataggtgtctgttcagttgtttatcaaaacgcatttataaagtggcactgtgctaagttctggggattcaatggtgaataagacaaataccgttctctcaaggtgtgtgtgtgtgtgtgtgtgtgtgtgtgcagattaattcagattttcaagattggcataatacagaagggctcatgtcaaaatgggcctgaagaattcatgggaccttggccggcagaagtgagctcaaggctgaaggaaggctatgaacaaatgtcataaggacataggaagtttggagaatagcatgaaaggaggggccaagaaaggcagattatctacttctctgtgataagtgagaaatgggtgaaatgaattagctgcgtgtggtggcatatgcctgtggtccaaactacccaggggcctaagtagggagaatctcttgagctcaggagttggaggctagagtgagctatgatcatgacactgcactccagcctgcgcacagagtgagaacccatctcacaaaaagaaatgaaaggaaaagaaaagaaaaagaaattggtgaaataagagtctctctccatccatccattcacccattcaacaaatatttgtatagtatttaaattgtactaaatactagagacacaatgggaggaaagataaagtccctgtcctcagggaaatgagcaaggaaatcaggatggctggatggttgggtggatggctggatggatggctgactggatggctggctggctggatgagtggatggatggatggatggatggatggatggatggatggatggatggatggatggatggatggatgggtaaatagatggataaattgatggatgggtaggtggatgggtgggtgaatggatggatgggtgtgtggatgggaggatgaatggatagatggatggttggtaggtaggtaggtagagagaaggggagagagagagtgagatccaaagagaccagggccccaaagggctaactttcagcaagcaggctggggccatctcacctgtttatgctttgtatagagaaacaataatgaggacccaagaccagaaccccaagttccagaaaactcacagctcttggtcatgggccaaggaggcatcgacactcaggtgactgaggccacttgtccatccccaaggcaggaatggaagcagcatctacctggagcacagtgctgccatctaagccccatgctgcagaaataaacaaacatccttaaagatcaactgtggccatgcattgcttcagtgacaagccccggacctttggaagtcgaacccagaatccccaagccccagaagcatctgggacctttcggacccggaagttatggccaagcgacctaggctaacatctgtaaaccctcctgtcctcctcccccgtgcctcatcgaggccctgccagggcttccccgcttaccccatgcttagcataacttttatccccgaaatcactgcagctgcaaattaaaataagtctcaagaaaacacacatatatagtattaatattaggtaatgatacatgatataaagatgaaaaaataggaagaggacatggagagcgatgagaagtgtctcctttatggaggggatcacggacggcctttctgagcaggtagtgttgatcagacatttatgaagtgcagggagagaggaggagtgttccagagacaggaaactgtgaatggggaggttgactaggcctaccttagccataggagagaatcctgccccacacagaatgtcccttccagaagcctggttggtatcagacaccttgggaatgaatcagccagagaggcaataaagagaaacccacagtgtgggctgaacagacatgtcccgctgccaagacgcaaacaaaatcatttcacagggcacagtcagcctcactgaccccctcagctacttacctggctctccagaaaaggccaaaaaataattagcagggttttctgaatagcaatactgcttttctcattccggtgtttcatggagactcaataaatgggaatcaaatcaagttgaactaagtccaacgaaattgaatccagaaaccattagagagtctaaaataaagggtggtgtcagagaagcggcgtgcacagggtggatgtcttcagtgggagccaagggagagaaggagccggaccaggcacagcccacgctcgggcagagacctgggagtggggatccaagtggagaacaccaaatcattctctgctgttcacatttggctcatctgtaaaccccatctaaattagtcttaatttgccacttaggagactagcagagtggctgaactcactgctcacaatgtaagcagaagaggtaattaagatgtagtcgggaggaacacaaagaacagaaccttttctctccagtacccagtagcagcaaaagaatggtggctgtttggagacagaactctctgaatgcaagtggcagctcctgaagccagagaagggtctatttgttctgcccaagaatgtgaggacaaaggaaagcaacccagagtactgactgggtaggagctcagagacatctgggcaggaacacaaattagcctccaggagcaggcggagggggcaagaagtggttccttctcacttacaggctgcaaagcagcactcttttgaacagttactttttaaggtaatatatggatgattgacatacctgtgatgaaaagatatgagaagaaagagtgtaaaagaaagactgggccaggcatggtggcttaggcctgtaataccagcactttgggaggccaaggcaagagtatcacttcagtctaggagtttgagaccagcctgggcaatgtagagagatcccatctctaccaaaaatttaaaagttagccaagtgtagtggtgcacacccgtggtcccagctgcttgggaggctgaggcaaaaggattgcttgagcccaggagattgaggttgcaataagctgtgattgtgccatggcactcttttttgagaccctgtctcaaaaaaaaaaaaaaaaagactgggagactacctcccaacaacctgcaatggcctagacttttccaattttagcatcccaggaaactcttccgtcttggacacactgggatctataccctgcccccagctctgccctattctgaggccagttctctctcatattagaacctgagtccatctcaagacaccacttcttggccaggcgcggtgactcacacctgtaatcccagcactttgggaggccgaggcgggtggatcacctgaagccagtagtttgagaccagcctgagtaacatggtgaaaccccgtctctactaaaaatacaaaaaaaattagccaggcatcgtggcaggcacctgtaatcccagctacttgggaggctgaggcaagagaatcgctttaacttgggaggcagagattgcagtgagctgagatcgcaccattgcactccagtctgagaaacaagagcgaaactcagtctcaaaaaaaaaaaacaaaaaagaaaagaaaagaggcactacttctaaccttgccaatcacttgctgtgtgacttagacaaatatctcaaccctttagagccacagtattttttgtttgtttgttttgttttgtttttttgagacagagtcttgctctgtcgcccaggctggagtgcagtggcatgatcttggctcactgcaacctctgcctcccgggttcaagcgattctcctgcctcagcctcccgagtagctgggactacaggcatgtgcaaccacgcccagctaatttttttgtatttttagtagagatggggtttcactgtgttagccaggatgttctcaatctcctgatcttgtgatcggcctgcctcggcctcccaaagtgctgggattacaggcgtgagccaccgcgcctggcagagccacaatttcttcatcagcaaaatagtaatgataataatagcagtcaccttatggggtcttgaaaactaaatgcatcatgacatgtaaagtgcctagcacagagcaaaggctaataaaagcacagagcaaaaaaagctaataaatgcattcattattttattttttttttttttgagacagagtctcactctgtcgcccaggctggagtgcagtggtacgatcttggctcactgcaagctccgcctcacgggttcacaccattctcctgcctcagcccgcggagtagctggaactacaggcgcccgccaccacgcccggctaattgtttgtatttttagtagagacggggtttcaccgtgttagccaggatggtctcgatctcctgaccttgtgattcgcccgcctcggcctcccaaagtgctgggattacaggcgtgagccaccgcgcctggctacgcactcattatttataagcagctatggacttggaggtggggagttcaaagatgaagagtgaggacactgcctttgtattattttctgaggtatgtggagaacggtctcccgatccaccttgaaatagattccaaccctgctctgaatggcattgctttagcaaagccccagataaaatttgagttcagtgaccctcctagacgtggcccatgatgatgcatatatcccctatccctttctccctgttgggtctttggctacgaaccccaggcacactttagcttaaagtcagattttgtaaagtttaatttacctaagtgaggaggaagacacaacctccttctcacatcatcctcttctcatatttacacttaacacctgaaggtgctgcactgacagcgtgttcagagggagaacgcgctttggcggtggataatcacacgctgtgaagaacgtgagaagaggagagtcatgagctattaggcggtgccacagtgccagctcctgcccaagcaattccctctagacagactgtttagggaggctgttaccagataacaccaattacttctaaaggaggaggggtgttgtgttgtctcagaaatgccttccgcagcatggagcggagtcactagaataaacatttccaaagggattgaggctcagaaaccagccatgttagaaaatttaaagaagaggaaagagggaaaggggagggagaggaagaggaagaaggggaggaagaggaagaaggggaggaagaggaagaggaagaaggggaggaagaggaagaaagggaggaagaggaagaatagaaagaaaagtaagaggaaggaagaagaagagaaagaagaactacaagaactaggacataaggattgctgttcatgggaatggccattgaaattcctggtcacagaggcaggagggctcttaacatcactttcacctcctcaagggatcctgagctagggagagagagatccctggaggaaaaagatcccaatgaggagagtcttctaaagacaaggccttctcagccagttgcggtggcttacgcctgtaatcccagcactttgggaggctgaggcaggtggatcacctgaggtcaggagttcaagaccagcctggccaacatagcaaaactccttctctactaaaaatacaaaaattagcggggcatggtggtgcgtgcctgtgatcccagctactagagaagctgaggcaggagaatctcttgaacctgggaggcagaggttgcagtgagacgaggtcacaccactgcactccagcctgggtgacagagcaagacgctgtctcaaaaaaaaaaaagaaagaaagaaagaaaagaaaaaaggacaaggacttctcttgcttttcttggaattccctacataccctatccctggtgaaagatgggacgatttgatgtggtatacagatgaagtattaagtaacaaaaaaacacagatggggagagatagtcccttttcaatgctctcttaattctttcaattcagaggagaaagtctcacttgatgctggtatgtatttacacctcattaacacttctttttttttctttttttccttgagacagagtctccctctgtcacccaggctggagtgcagtggcacggtcttggctcactgcaacctccacctcctggtttcaagcaattctcctgtatcagcctcctgaggagctgggactacaggtgcccaccaccaagctgagctaatttttttgtatatctttagtagagacgggctttcaccatattgatcaagctggtctcgaactcctgacctcaggtgatccacccacctcagcctcccaagtgctgggattacaggcatgagccaccacgcctggcctcattaacagttctaatctcccttttcaacagagagagcaggtctaagtctccctcagtggcaggtaacaaaatcaagtactctaatttaattgcttgactttgttttctttgttttaattttacagttattttctgtttacgccaagtaagcctactttcccattcatggtagtgacataaaatttattttttatttatttattttattttattttttgagacgaagtctcactctgtctcccaggctggagtgcagtggcatactctcggctcactgcaacctccacctcccaggttcaagcagttttcctgcctcggcctcctgagtagctgggattacaggcaggcgccaccatgccatgctaatttttgtatttttagtacagacacggtttcaccatgttggtcaggctggtctcgaactcctgacctcgtgatctgcccgcctcggcctcccaaagtgctaggattacaggcgtgagccaccgcgcctggctagaatttatttttttaatggatttacctaaatggaaaggcaaatttattttttaatcagtaaataaataataatacaagtgatacctagatatggcaaatatatatatatgtctatatgtatatatatgtgtatatatatgtatatatatttttagcaacaggtggccatgaatattcaaagttgagaaaccagtgctctccacccaggacctacctggtacatagtagatgctctgtaaatatatggctgttgccagattaaagccaggcttctctctgcttgatattaacgtactttttaagggaatttcaaacttgtattcttttttttttttttttgagacggagtcttgctctgttgcccaagctgaagtgcaatggcacaatctcagctcactgcagcctccacctcccgggttcaagtgattctcctgccccagcctcctgagtagctgggattacagctgcgtgcaccacgcccggctattttttgtgtttttagtcgagacgaggtttcaccatattggccaggctggtcttgaactcctgaccgcaggtgatccacccgcctcggcctcccaaaatgctgggattgcaggcatgagccacctcgcccggcctcaaacctgtttcttaaatggactattgttatgtgtgtagatgccaagtctttcaatgactagtctgtgcccaaggaaggtggatagatcaaagctcccagattccttctccttagagggttcttatatatccatatttttggcagcaatgtcaacgttaaatacctcacagtagtcccagggcagaaggtagttatgcctgagccccttcagaagtgtgttcttaggcacagacagatccactgtcacactactactagtcagggtagctcttgccacatatgtcctgtgctcattcattcattcattctatagatacttacggagcacctattttgtgccaggcattgttgtagggcctagggagacatcaatgaagaaaacaggtttttaaactccccatgctggtggagcttgccttcaccaggcaagctggagtgaaagagaccataaatacaataaatgtggaaatgacacagcatgttagaagaatgtgactgttgttttggggggacatgagcaaggtaaggggactagggattgcaagaggtggggatggggggtggcagttggggttggccttaccgggcaggcagagtctgagcaagactgaaaagaggagggagagcaagagaggcagaggatacgtttagggaaaagcccgctgggcagagggcctaccaacataaaggtggtgagatgagtgcatccctggcatattcaaagaacagcacagaggcaggagcgagggagagcatgggagatgtggtcagacaggtcgtggagagggcccttccaggccattagaaggactttggctttttcaatgaaagaagtggggagaccctggggtgctctgaacttctcaggaatgtcatgggcagctcctgatttttttttttttttttttgtgacggagtctcactctgttgccaggctggagtgcagtagcacgatctctgctcactgcaacctctgcctcccgggttcaagcgattctcctgcctcagcctcccaggtagctgggattacaggcacccgccaccacgcccagctaatttttgtatttttagtagagacggagtttcaccatgttggacagtctggtctcaacctcctgacctggtgatccgcctgccttggcctcccaaagtgttggaattacaggcgtgagccaccgtgcccggccagctcctgattgaaaggctcactcaggttgctgtgctgataaggaatgtggggtgcagagcggaagcatggaggccagttagacatccctcgggaggtgctgaactgagtagaggcagtggaagtggcgagaggagacacatactcaggacctattgtgaaagtaaaagtaaaggatttagctgcatgacccggcaattccacacctacacatacacacaagaaaacggaaaacaggctttcaaacaaaactttgtgcaggaatgtttatagcagcattattcataatagtaaaaaagtggaaacaggccgggtgcagtggctcatgcctgtaatcccagcactttgggaggccgaggcgggcagatcacgaggtcaagatatggagaccatcctggctaacatggtgaaaccctgtctctactaaaaatacaaaaaattagccgggtgtggtggcatgcacctgtagtcccagctactcgggaggctgaggcaagggaatcacttgaacccaggaggcggaggttgcagtgagccgaaatcgcgccactgcactccagcctgggtgacagagcaaggctcagtctcaaaaaaaaaccaaaaagtggaaacaacccaaatatgtatcaactggtaaatggataaacaaagcacactgcatgctccacaatggatgaaacttagaaccttaaaaacatcatgctgagtgaaagaagccagacacaaaaggccatgtatcatgggattccattcatgtcaaatgtccaaaacaggtaaacccatacagacagaaagcagtttgtgggaggggtaatgcagagtgactactaatgggtatgaggggctttgggaggtgatgaaaatgttctgaaattagtaatgatggttgcataacattgtgaatgtactggaaaccactgaattgtgcactttcaaatggtgaattttatatgagttttacatttttttttttaaagggaaatgattaggccaggcacagtggctcatacctgtaatcctagcactttgggaggccaaggtggaaggatcacctgaggttaggagttggagaccagcctggctaacatggcaaagccccgcctctactaataataatacaaaaatgagccaggcgtggtggcgggcacctgtaatcccagctactcaggaggctgagtgagtgtttcaaggcacggacatccaggaatctctattgatcagtgtggaaggagtctttttctaaggacctagaccattcagcagagggcaggacacttggggcaggtggcataattcccaatgcaaggacttgatgttggcctgtgtggcaggtggtcttactctgggcagtcagtaccctttcttggtttctctttaaagagtaggaaggctgggccgggcacggtggctcatgcctgtaatcccagcactttgggaggctgaggagggcggatcacctgaggtcgggagttcgaaaccagcctgaccaacatggagaaaccctgtctctactgaaaaatacaaaattagccaggtgtggtggcgcatgcctgtaatcccagctacttgggaggctgaggcaggagaattgcttgaacctgggaggcggagtttgcagtgagctgagattgcgccaccgcactccagcctgggcaacagagcaagactccatctcaaaaaaaaagagagtaggaaggctggagaaagcctctcatggtccagaggactctgctttccatctgtgtccagctcttggaaacccctttccatagtgagccagcctcagtgcagtggccccagtccaaaaggcctgcacaacagtaagaatcatcacttatccctccagtccatcctgtatatccagcctctaaacacactgcgtggcctgtgatagatgctcccttaaacacttgctaaataaaggagttgatatttattgagcagttaatgtgccaggcactgcgaaaagccttttatgtggattttctcctttgatcctcataacaacccaatgagaccgacacaattattatcccaattcatatctgaggaacctaaggctcagagtggggctgggacttgcccaaggtcacacagccaggggattcgaagctagatctgtcttacttgagcaagggtcttcttaatcaccacatggtggttatcaactgaccaagtttgatatctgcttcctaaaacccatgtatggaagccctgggtctggactcaggagacagtcataagctcttcctccctcccctttgggccctacacccaaccacccattttattttgttctctctttaagctctgctgctgctctccatccatcatgatttcagaaacctttatttttgttttccaccatagatgtgaaaagctggcttgtgatgtttggatttcagcttagcaacatcattcctggcttcccgagagccaaaatgtatttcgtgcctcctccctatgaattgtcagagagtcaagcaagtgagaatggacaggtaagcagaggttcctgccaagaatccaaatgattgtcatcattcccttttgcaaacagaacctcatgggagccaggggcatgtcagcgcaggaaaacattggagctgggtataaaaggtgcaggacacattgagacttcccaggaaagcgaatgtcagtgctgtcgcctgtctggcacagcacatatttcttcccaacttcgattattgccttaattgtggtatcattatctgttcagtagaatacctttgagtcactccttgattaacaacagcacagagaaatctagcagcaacctaccatctgcactgcctataagatcataaccctttcagcttttatgggatgtcataaaactgtggtttgcagtttctgtcccattaaagaacatttttatgccccacataaaacctcggcgctttatggccaagcatatacagattgagttttcagaacataatttgtgcttgggtctttctgcgatgaccgaggggtggtcagtttccatctgggtgcagctgagacctctgctacaatcagatgggaggcgttcagataacccctgctacagaaccggcgctcagcactatcaaagtctgaaaggtctcagctgctctgaataattgtccagattgtgtaactatagagaggcaaggaggagctgctgggtaattgagaacagcgttcactcagtcctgccccttggggaccactcagtggatgaatagccatcatttctctcatttatctaagtgccgttacctcccaaacgcagcctctcccattatcccagcctgtcccccaaccaccaattgagacaagttgtaatttgcgagtggagaactcaaggccaaggagataatggtgatttcatcccctgcagaaccagggcgaggatccaaaacaactgcctcaaagccaggggatattccctctggccctcaaagcctgactctctcagcctggtgcttctcaaatgttcatatgcacacagatcacccaaggcatcttgttcacacgtagcctctgactcagtagttctggagtgaggcctgagattctgctttttgaacagggcaggtcccagtgattcctctgctgctggctatactttgagtggcaaggtcttaacccaaggaagttaatgaatatccaagtcattggcctccaggaaatctagcttacagtggtggggttcgaggctgttcaaatcaacatcctgcccttcgcatcaggacattcctgggtctaaagcgggcaaggcagttgccaaccatcagagtacagaacagggcacttcccgagtggtggcatgacccggtaagtgtgtaggtccaggtgcccatgccagcaaagggtgaacctcctttaccatttttttagttagtggcaattgcaagatggacagaccacaccatcagagcattagtaatcaaccagccatccatagttcagagcactggtaatcaaccagccaaccatagttccaaaaggtaggactcccaacagctcagatctggatagacccaacactagttcttgcaggagagttccaagcctttctctttgtgactctttttgagagagctgcccagctcatcttctcagctttctctgttttcttatccccacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacgaataagcaaagaagaaaacaaacaaaaacaaaacaaaacaaacacacggaccaataaacaaagaagcgaagataagaaagaaggcctcatatccaattacctcactcattcacatgtgagcgacacgcagacatccgcgagggccagcgtcaccagaccagctgcgggacaaaccactcagactgcttgtaggacaaatacttctgacattttcgtttaagcaaatacaggtgcatttaaaacacgactttgggggtgatttgtgtgtagcgcctggggaggggggataaaagaggaggagtgagcactggaaatactttttaaagaaaaaaaaacatgagggaataaaagaaattcctatcaaaaatcaaagtgaaataataccatccagcacttaactctcaggtcccaactaagtctggcctgagctaatttatttgagcgcagagtgtaaaatttaattcaaaatggtggctataatcactacagataaatttcatactcttttgtctttggagattccattgtggacagtaatacgcagttacagggtgtagtctgtttagattccgtagttcgtgggtatcagtttcggtagaggtgcagcatcgtgacacttttgctaacaggtaccacttctgatcaccctgtacatacatgagccgaaaggcacaatcactgtttcagatttaaaattattagtgtgtttgtttggtccagaaactgagacaatcacatgacagtcaccacgaggagagaaaatttaaaaaataaaaataaaaacaaaaaaaattttaaaaattaaaaaaacaaaaataaagtctaataagaactttggtacaggaacttttttgtaatatacatgtatgaattgttcatcgagtttttatattaattttaatttgctgctaagcaaagactagggacaggcaaagataatttatggcaaagtgtttaaattgtttatacataaataaagtctctaaaactcctgtgga

SEQ ID NO: 1458 - DNA, 50595 bp, Homo sapiens
ttgtaaagattcaatgacaaagttttattaaataccaatactggctaggcacaattagacacattattatctcatttgctgtatctggtatcaaacaacaaagcctgaaagattaccatagattttgatggcctcattaacataattaatccgtagtgacattccctggataataaatacagttttatgtccgtgtgtcttctgtgtcttccaagttgctacagggctctatttgatctgagaaactgactgctgtttacatccaggtatgcaatgtgacattagaattgaagcagaaaggaagcaaaacaaaacagggttcatgaggaaaataatcttctaagaactaacatggcctggaggtaaaatgcaaatatatccggtaataagaagcccagattactgcagataaaagattaaaataggattcaattattcatctccatttgcaaatctacaaactaggaggaaggactaacccttttcctgggattagtaactaaatttaatgattacagcaaatataaagttcttttgtaaattattgttggttaaggattgacttgcattgacaacacactttagctctcgcccctttcattctccccctgcaagaacaaaggcaaaatgaacagtgaggaaaacctggaaacaggaccgagtgtttgctatcacttgattcctttgaaggagcaatgctttctcataatataggttttatagtatcatcaagtacatcagttaagcaaatcaagtgctttgtgttctgtatataaattacataatacaagagtctgtggcagttaagaatctggttctgcactttgggaggccgagatgggtggatcacgaggtcaggaattcaagaccagcctggccaagatgctgaaaccccgtgtctactaaaaatacaaaaattagccaggcgttgtggcacacacctgtaatcccaactactggggaggctgaggcaggagaatcgcttgaacccgggcggcagagattgcagtgagctgagatcgtgccactgcactccagcctaggcgacagagcaagactccgtctcaaaaaaaaaaaaaaaaaaaaaaaaaagaaaagaaaagaatctggttctgatcagaatccttaaaatactgtcttcttttttatcacaattgcccttttggatgtgagtgctggtctcaaaaagatttgcagttaaaagaggaacagcaaaaaagacttacaccaaaatagcaaccaactctaaaactattacaggtgagaggtagacagcttcataactcaatcttctactaccaggtgatgttaaaaaaatactttaacatcaaaatcacctacaaatattcctccactttcatatgctgagcaatttcagcttagagtgactaagtgttatttatctctctatcttcggcacctagcacatagtaggcagtcattagttatttgctgaatgaaggaaaaaaaccttcatctgaccaacgataaatttcactaaaattgactataataaaatctgtatgggctccacatgaaaactacatgaacttcacttccccacatacctgacagcctatacacttccttatgtttcatttctttaaatatactttaaaaattgcttatttacacaataaaaacaatgtccaccataaaaaaaaaagtctctagaactattggaattagtctcagaataactcatctgattggatttgatatgagatcattctcagattgttctgtggaatctcccaattccaataatgatgcttgcaatatcctttagctgtctatcagttctggtctttattcaggcccaaagagagaagaaagaagtagactaagataaaatgggtagtctgtgtattcatgtagtgaatatattcaagacataaatatgagacagaaaggtcacttctgcaacaaactaagtctgatcagagttaagttagcttccctctctgagcctttatttttctcatctctaagacagattcatcctagaagctctctggtcctttttagcttcaatgttctatgattggttctcatttaattgatgcaccaactgaaacactcactaatcatacattttgctggaggttgatcaatccttagcaaatcaggaagaaatgaatgttccacttacttcgtgcagaagctcaggaagctgggctctaaaggcccaagtttttgttgttgttgttgttgttgttgttttgcctgaagcaatgtatgtaatttaataatttaaatagtgtttaattaaatagtgtcttgtttaaatgctatataacattttcaactgcggctgcacaccagaatcactcaatgaactttattttactgctgcttgagtcccaccctcagaggttccttttaattgatctgtgtgcagcctgggcatggggacgtttataagctctccagatgattctaacctgagcaaagggaatgatgactggcatagagcaatgagtctcaaactttagcatgaatcagtcacctggaaggattacaaaaacacagattgtgagatgccacgctcagagtttttgattcactaggtctggaacttcttttttctcttctgggaacttgctttttgttttttgtttgtttgtttttttgtttttgagacaaggtctcactccgttgctcaggctagaatgaagtggagcaatcacggctcactgcacctcagtctcctgggctcaagcaatcctcccgtgtagctgggcctacaggaatgcaccactaatttgtttgacttttagtaaagacagggtttcaccacattgtgcaggctggtctcaaaactcctgagctcaagtgacccacctgcctaggcctcctagagtgctgggattacaggcatgagccaccatgcccagcctatgaacttgcttttctaacaagttccccagtaacgctgatgcttttgtcaggaccttgctttgagaaccacttccagtgagagaatatcattgatgctggcatctgaagtcctgagtttaaatcctgattctattattaccacctacataatcctagtcaagtaattttttctctcatttttagtctctttgtgacaatacttagatcccagagttatgagacatgaaataatgtaccaatcagagtttggtacagtccctggcatagaacacaataacaaatattaacttcctttttccattatacatggctagatggaacaattaagttaaatcgataacacataagttgaaacttcacaggaaaacaaagtacagctagttgaagcaaacaatatcttataattatacatgtaatacagaatgatagagaaatgttttaagtacttaaaaataccttcgttcaattttcaaaactttgaacgtaataatttaggtagtaggaacattagatgcaatctatagaagaaatattagactcaatctatgaagaacatgaatttttttacaacctataatggatcctgatacctcatctataattttagttttctatagaatcaataatataattagtgtacctgcttaaaactgtattacattgatcttcaatgctacttaatttctgagaaaacctaagttataagagtacatcagaatctctattatcaaccaaagcaaaacttctaccaacgacagaatggatactttttaaacaaatttacatataccaacaagcaaaaaactagagctttcattcctgcttgacatttttttcactttgtgtgtctcaaggctctctcaggaatcagtgtccaaaccatgaggtgaatcctgggaggtaagcaagcttgctgtagaagccgctgtacatgccttcaggaacagaaagggtaccagaggctgtgccctcctagtgtggctggttggagtgacaactagaatgttgtccgtgtttttctgtggaacctacaatgagtccagttgtctaagtgagtctcaaaggtattgaatagttgatgtcaaaaggcactttatgtcaggactgtttaaagcaagtttctccctataccagtagtgacccagaggcaaggtcttaccggacctcttattttcaaaagccttccctttccaattgagcctgatgccattatgtgacatctttttttccctgaatttctaaaagaaaatgtgatgattacctgcatatcttctttgttgctgcatcgtgttttgcatggtacccctttaatattgttttcaatacttagcctgctgatatacttttaacttctcacctgtttatgaattctcttaactaggctgtgaggcccttaagggtcttcaacttgtccctttcctccacgtaactttctcaaacgccccagttctcagtaacttttctcttttgctgtctgtaatataaacatgacccctacttacactgtcctacctatgtggccaataagagtgttgtcttcgcagttggaacccaaaagccctatgggatggaggatatgcactgtacttctttgtaaaagtgtcttgacaaagctgatgtccaatcaacatttaattaccagactgtccaagctagaaatgaaatacagttgattgcctgagtcctgataatcttgctaacaaaattataaaaggcctatagtatggccaatatatttggctaatggaaatgattttcttaaagccagaaaattcagctacccatagtgcttaaaaccagccttaaaagaacatgaacaggatggttcccaccttatcgagatcactggcattccatagtatccattcattcatatcctcctcctaggccgcatgaaacacctaccacatttccctacctcctaaagcaaacaaaactcttttcctccctcttgctgcaaaaaggtttattaaaagccgtatgtagtgtataaagcctttcaaaaatactagcaatccatgcctttctttttttgagatggagtcttgctctgtagcccaggctggagtgcagtggcgtgatcttggctcactgcaacctccgtctcccaggtcctggttcaaacagttctcctgcctcagcctcctgagtagctggaattacaggaacgcgccaccatgtccaggtaatttttgtattttcagtagacatggggtttcaccatgttggccaggctggtcttgaactcctgaccttgtgatctgcctgcctcggcctcccaaagtgctgagatgacaggtgtgagccgctgcacccggcctcattttaactaaatctgaagccagagttgatttgatgcccatcctgccagggaggcagttccttccctcaggtttgttagtagaaaccaaaaagtagcctgagagggttcaggtgccaccttggaggcactaccttatcttttgtccttttagagttttcttgctggggtgtttggctccagcactatagcccttaccacaatcattccacctggttcttcaataggactctgaggtatcaaaaaagtcactagggcagcccagagattggtacgatttacctttacacctcaaagttttttagatgtgagcagcgctggattatggcaatttaccttataataactcaccatagttggctgttataagaataaatattgttcttctaagatttttaattagttgcttcagttattacatttttttctattttttttttaaatagagatgaggttttgctatgttgcccaggctggtctcctggactcaagcaatctcccacttcaggctaccaaagtgctgggatttacaggcatgagccacctctcccagtctcagttattattttaataaatgagactgaacgtcctcttataaggctcactcccttgttcctactacatttgctctgtttaagtatctctttaaattcttcagttaagatcatcccttttatcagaaacctagacaccacaaagtagctttctcacctttaattctccatagggatcactattatactataatatttgcatacgtatgtgtatatatgtatttgcttttttaaaaaagtaaaaatgctcttctcactctttgtcgatataggcacccaggtacgtagttagaaattaaataaaggccacaataatttcccaaggaagatcattaaaaagaaaaatcctttcttcctctaatatcacatagctggcctttatggcatgccagctaagaaaaaaggtattgcctatggtgacaggaagactcaatctttctctctttgggttgtagctgaatttctatcaaaagtcctagtaaaatatataactcctcatttgttctaagccaagtcttttcttcagttttccttcaaacaatacctttactttcccattagaatatgaagaattggagactgtgaacagcaaggtttggggtgggtatcagtcacttcaaatctggctatgcagagagagggaaagacatggcagaatagcaggggtggagggtgagtgaaatgtatcttcattgggagtattgaaagagagcaagtttttcaaagttgttgccggtatctcatgaaagcccaggctgctaccatggtgagggcaaacactggcaccagcaccataaatatgggaataccacttgggtccccttcacctcgatgtcctataggtccattctgcacctgtaactggaagggaaagaaaaatgttaactctagtgactaatgtgtgtttgcaactgaaacgcccaggttgatacatcacctgggtttgtagactctagaccacccaaaactgtaacccccagcaatacctagcagaaggagtcctctctttgtcctgagctgatgcatcagtgtcacaggatctttggaaagaaaataggtctaatggggaggcatttaaccttgctgacctaaagggacccgtgagggcaagtcaggtaatttctgtttctgtactgcctctaccttgctatttgtgtatcgtatcaggaaaatgaagacatgagataaaacctatgatcttatagggaacttggatattacttggtgaggaagaagggggatctttctggaaatgtttacttagataatcagtcatcaaaatgtagtaagagcagatgtgggcaatgtcaacataggtgcaataccaacatacgtccaatgccattacttgaaaaatgctttccagatcccagaaggcacccaactccctccaaagatggggttttgcccttcatctgctcatttctaatactagagagagatgaaggtgaatctatatggaacagatgtaaaaaagcaaaaagaaattatatcctagtgcttataattttctattggctaagtgtttccttttgaggctggatggtcttcattttagtgatggttttcagggtagctcttcttaatatcaacttttagtggctaacttgcaataattatggcatcatcgtatttcagttaaactgcctcattacaactcataaaactgacacttcaatctgaaaggcaagactgcatgaaataccattataccctctattccacctctatgtttttcattcatttgctgatgagctgtcctgaaaggacatgctcaataagaaggcatggtttttagggctaggccaattgcctgaacataagggtcttttttattaggaattatttatggatgtttccttaaaagtgaacactggaaataacttctcacataccttccaaaagaattgtaatcatattgaagtgtgtccctatatttacttgtttttatctactgcacaaatgctcccatgctttagaaagagaagagccaaggcagaagcaactgatgaccaatattatctcttattaacctgttttctaatccattacacccagattctgcttgcaactggttgttttctcaggtatctttcacgttctgccttctctacttttttaggaactcctctaaatgttcttaagcttctaaatccttagccactgagtgaggaagagtgcacctatttaagaagtagcaaattgatttaatttaaaggcacatggaacctgttttgtgaatatgctcagaaattctcaatgctataggaggaattatatctacccaggcttccctttacatcatcatccaaattataaaacacttggaaataagaaacagatgcagggataggtgctgccttgactgaattctgaattccatttcctttttcctggagttctcctatgaacactaaagatttggttaagagggtcaccaagttgataaatgaagggttcatggcagtgacagggaaaagcatatagtgggtaccagaaaacccaccatctttgtagtgttttatccaatggttttataaataagttttcagcggtagacatatggttccttccctaccaaaaagtaaaattggctacgtttttttaccatctttttaattaattaatttatttattttccattggtccatgtcactcttaaaattttttatttatttttattattatttttttaagagatgaggtctctctatgttgcccaggctggtcttgaactcccgggctcaagcaatcataccaccttggcctcccaaagtgctaagagtacagatgtgagtcaccacacctggcttttctttaatcatctgttttaatttggttgtcaagctttatctttaaggcatattatcttgaagcaaggaccttggttataagccatactgttgtgaatttctcttttttttctctttttttcttttttttttttttgagacagggtctcactctcttgcccaggctggagtatagtggtatgatcttggctcactgcaacctctacctcctgggctcaagcaatcctcccaccttagcatcccaagtagctgagactacaggtgtgcaccaccgtgcctgaattttttgtatttttagtagagatgaggttttgctatgttggccaggctggtctcgaactcctggcctgaagtgatccgcccaccttggcctcccaaagtgttgggattacaggtgtgagccaccgtgcctggcctgaatgtccttcaatgataagcagaagtaccaatggacccctccctttgcctgagaaactcttcaggggagtgagggtaaaacaaaaagcaacactgaagattacacacattgggcttattcagaagtacagtgcaaaagcctggtgccaggtttctggctcaaagtgatacctaccctgtgctgcactctcagagacacagcatagcctgcattacgaaagaggtctacagcatcctggtgcagcaggttctttaggtcttggccatttacctgtcaaaacaccaaagagtagtaagaaaggaagaaggctattagaagtcaacaatttattttcaaatggccaaactttaaataacaaactccttcagagcaaattgcaaggactaggagtatgggcaaagttacttagagctcagaacttagaacttttttcattttcaaaactatgttttcctagaactgaagttccacaggccatctgaagagaacctatgtaaaataaaaagtggtctctccttcctcttagcttctatgcctgtctcgttttgacacttgggaatctgttaccgtattagcatttcttccatgagtgttaacctgcttccttaaagatagcatggtcttccaggttaccaccctaacctttatattcctaagccctggcattgccagctgcaactgtagaaatataactctatgaaactctccaccaatttattttgatgtcatataaatctatactagcccattctattgggcttttcatagtgaacaacttcctgtgattccacggatactcctatccattatatccaaattagtaaattagtcattttttaatcaaaacttagtaaaaaccatattcctgtgatgatataaatccttaaaaaaatttcagtgtaggtcactcctaccacttagaggtgagagatgtgaaggaatacttgtattaatactttttgcagttaggagtgacatcggccacaagtaataatctatctatcctatgctgtattcagtgacacagcacagcccacttagtgcaagattacatatcttttatacttgtcaatgtcatcgttaacagtagcagcaataagaacatctgatatatttcttttgataggttctgtactttacatacattatctcttttaattctcatgataaccctatgaggtagacattatttttatctcgtttccacagataaagaaacttgaagctcagtgagatttgtgctggagctagggctaggatttgtaaataatgaaagaaagatcaaagtgtccttgcatttcactgttccttctgcactgttattcttccatcttgactcaccaactatcctctgctcagctaatgctcaagtcactcccttactcaactctctcattttccttgtcgcaatcttccttctccaaggcactcataatcttccctctactctctctcttgccaatacagttggtgaatgaatctaccaacacttctgccctatagacagtctacctttgtaaaccaatagtttccaactccattccacttcagtcaccaattgacgtaaacttagacttcaatattagacatgcttcagctccaatatctcaaactcttaaaaacctgacaacaatttccactcttttcatactttctattcatctactgaatttcctccttgtaacctttttagactttacttgcatccttgcccatctaggagttcctgttgtaatttcaacaaagcacttggtaaatcattagaatcctttgtccccaagatcttctgccatctttccagtcctgggccatattctgcaatccttttcttgccatcattaagttgaatattctgggagaaaggtatattctcattctccaccatagacccatactagctgactccagctcatccttaaaaccgcttctactcatttgctgaactccttaataaacacgcagtgatagctgttccagacctttttccaccaccgtctccaaccccatttctacctctctccctagctgattcctttatcttttgtgagaacactgaggacttctgataaatgctttctacattttctttccttctccctcaaagtttctttatatcttctcactactcctttcccctagtctctgaattagatctatttccttttcaaggtgaaaccatccactgatgatcttgatcatacttcttctaacctccttacaaaactcacagacactctgtcttcttgattacttaactattatctttctctgctccttctctcaactaaaattatacacctctataaagaaaacaatacaactatttcttggaacgcattatcactctcctcccatcttctttcctctttctttgactgctaaatttgttctaagaactgtttgcatgcactacctctatttcttcagcattcattctctattcccctgtaatctcacaatgtatgaggtagaagggaagaacatgtttttctaaaggtcaccaataacttccaatcaccaaatcctatagccgtttttgtcttcagaccacctcctcccttttgtaattttctcctatcttggcatatgaacacttagcattctttgttcttaaattattcctttccggatttcctcttccctttctttctccttaaggtgagtcaaggtttttcagtatcaatcctctatcttctttctttctctcccactgtgagctttaacagtttcaaccataatctgtaagataactcccaaatttgtatccctacttgtacttctggatttgccagtttcttgctggatgcctacacctgtatactctgctagaccctaattcaacatatccaaaacctctttattacttcccacaaaaatcagaatacataccttgcttcttattgccactatcattccttcaaacttttttttttttttttttttttgagacagagtcttgctctgtccctcaggctgtcacagtggtgtgatcatggctgactggagacttgaactcctgggatcaagtgattctcctgcctcagcctccgaaagtgctgggattataggtgtgagacattgtgccccagcccaggctaaaattttaataatagttttaaactctctctgctgtcaactttcatatacaatagattgccaaactccacagtctaacactatgacatctctcatacagtattttctttcctattgcctattttaggctgttgacactaaaaacaaaacaaaaacttgggaccccaatccaccatgtcaagagaaaaaattaagctgcaagctgagtcatgcaataaactgcttttccttttgttcccaagcagatagctacagataacaggttaaatatctccacaggtaattactctatgttcaccttatcttatgtaaagtcccaacttactaagcaaaagaaaatacgtaattgactattcccttgcctgctcctttcctctggcaacatgtggattaccataccttccctctttgctcttcagcctactttaaatattaaagccctcaaaatcatctttggagaaaggaacatacctgtctcccaggcatgtccttaaccttggcaaaagaaacttcaatcaatttagaagactcttggtttaaaatactcttagttgaactactgtgatcacttctctctgatttacttttctctaggttggaaccgattcaaatactaggtctccagattaatcttcctaaagtacaattctgttactaccactttactgctcaaaaaacaaaaacaaaactggggagcaaggaaagagtacatacctcgtttcttatgctgatatggaaagtcttccaggaaatgactctaacctatcttctcaggttaatttctatttcctttcctatatcctatactctagctaagtcacataactcactgactgggacataaaacatattttttacctttatacctgtgctcaaactgtatctaccacctaaatgcccttcccttttaaaaaattctatttatcttccaagattgatctttaaaaaggatcagtcctgctacctacagtgtagaaatgaatacagttttctagtcgagggactttaatttcatgttatgccttggttttcttgttagatatgctgtaggaaaagaacttcaggatttctataactatcacaatgaattctcaatgactcaattttctagttaactcctgacagaataggtgtgagattgctgactgtcatgggaatgctcacttaagtaatctagcccatgtgatagctctatttctcattataaagaaataagtactttctttagaggcagacaagtaagttaatgatgcagtcatgtcaatgaatgccaaatgatgtcacagctcaatatcagagccaaggtttcatagtaatataaatgcaaatgagataactgggtcactatattaaatggtagaaatactgggcttaaaataatctttgccatagtagtcagtaataattgcagagaattattgaacataaccatgtctggagctgtctgttcatcttacatgtattaactcatttagtcttcacaatagttctgtaagttaggaacccctattttataagtgataaaactgaagtgtagaaaggctatcaatttatctgtgagcaaacagaatgaaagcagcaaagccaaggattcaaactcaagcaggctggcccaaaagccttcactttaaaacactaatctatatgaatttacatggcaagcaaggattttatttcagcaacatattactgcctatcacatatatgttgtaaattaaatttttattggttttgccatttagtttgtatttaatgttacacatttaaaaagtgttaagagttgaggccaggcatggtggctcacacctgcaatcccaacagtttgggaggccaaggagggcgaatcatgaggtcaggagttcgagaccaccctgaccaacatggtgaaaccccgtctctactaaaaatacaaaaataagctgggcgtggtggcgcacacctgtagtcccagctactcgggaggctgaggcagaagaatcacttgaacacaggaggcagaggttgcagtgagccaagattgtgccactgtactccagcctgggcaacagagcaagactctgtctcaaaaaaaaaaaaaagttagagttgaataaaaacaaggtatttatatattaatattactattcatttgtatatacagaagtagcattaaaattaaaaaagcaatttagttaggtgccacttcattgacaaggcctttctagataacgtcactagatatgactgatttacttctttgaatactctgtaactctgaatactatgcaactatatactttgaatactgtgtaactctcttaaagtccaaattgaactctgcctgacaccactttgcattctattgtaacttcaacatgtatctcagctgatcattataactctacaatacctaagagaactttgtacacttgagcataataaatagcacatgctttcctgaagtttggctgcagagtgcaccctgaaaaagccataaatacacaaagcctgactgacataatctcagtactacataaagctgcaaggcctggattctaatagtagctttacctgccaatgattcagtgtgtaatcctgcccctccatctgagtctccttctgctaacagggaagaaagacattggtacatcaggcaaaagaagatgttataaagggcataggccagttaagccaattatgcctttcaaccctcctagttaaggctaaaggtattctaatttaagagacgttattctaatgactactttaaaaccccaaataagagaccttttagaaatgcaaagataattctttcttaaagaaccctttcgcatcctttacccaaggtaaaccagcccctaaaacatgtcatgattacgactttctcccttgacaatatcatttctactccaaaattgaatttgctctccaatactgacatcctctaagcatttttagattccagctgctcagtgactaaccaccaagttctgtagatttcacccttaagtatctgtggaatccactctttttattaccatccttactaacatagaccagtggttctcaaagtgtggtcccaccaccagcagccttagcatcacctgggaacctgttaaaaatgcaaacgtttaggcctcatcctagctgcactttaacactccttcaaagtgattctcaagtctgagttagttcttacctaatctgcctgaaacagtcttttaactggtctccactcccagactacttcccctatttaatatacccctttctacatatcccttgcatctacagatttcattagtacttttccattcactggagtagtaatttttcaaatattgtgaaatcaatccagtgggtcaagaccagttgtttggccgggcgcggtggctcacgcctgtaatcccagcactttgggaggcaaaggcaggcggatcacgaggtcaggagatcgagaccatcctagctaacatggtgaaaccctgtctctactaaaaatacaaaaaattagctggacgtggtggcaggcgcctgtagtcccagctactcgggaggctgaggcaggagaatggagtgaacccgggaggcagagcttgcagtgagctgagattgcgccgatgcattccagtctaggtgacagagggagactctgtctcgaacaaaacaaaacaaaacaaaaaagttgtttattttttaaaaagtgaaattagaagaaaacaaaatatcaaaattcatcacatatagaaaagtattgttgtgttaaacttttgcttcaaatacacacacacactcatttgacgaataggaaatgtatgtcattcctgttataggttataatttaaaaggtctgaaaaacacttgcctacagcagtggttctcaaactttactgtgcacaggctcaccacgggatctcataatgcagagtttgattctgtaggtctgggaagggccctgagattctgcatttctaacaagctcccaggtgatggccagactgctggtccttgaacctcacttttagtaccagaagctactcggctgagtaatcccagaattaacttgctacttcagcttccttaactcatgacataataaggtttattgaacctaagatatggcagatttgcaatgtgctagaaaatttcgctgactctgaagtttcagagaatgagcatggtgttgttctagttaactgatgaggaaacatacttttttttactttaactctggttgttagcatgttaaaatgtgtttcctatttcctgccttatgaaatcagctgagttaaaattagttttctttgattaagaattttgaattgcctcaggatattctaaaacaagatctctgacttgtaaatgtagagacatagagaaagaatgggctcaatttaatacgcaatagatgtgagaatatactctggatattgtaattttttactaagatcctgcaatgaaccacattttttggtctcttttttcatcaatttttgaagaaaccataaaaatagattatttagatccaatccaaaaaagtcagtgtgttataatgcaggggttaattcacggaactaacttattagatgcttactcagggccaggtacaggactagatgctggagataaagagatgataaggcaaagatccttccctggaggtattttatttaaagaatgctgctgtatatttcaacatctctgcagctgattggatgagggtttctgctgggtctttctcactgatttctaaggtaagcgcagagaccagtgtttcatttcctttgtaactttcccatagcacttggcacagtgctctgaaggccattaagtacaatagttgataaatgttgatgactaaccaactctttcattcaccaaattaaaaactgtactcacacagaatatgaaatgaagctggctaatggctcaatctgtgccattttgttatataaggggtttgttccatgttaaaatggaacattcaactgtgtagtatgaccagctacgtcacccttagcttaataaaaatgtcatgttcactgaggaatgactattcttcacctcccttcatttaggcagacacacaaggaatgagaaacttagttcacttttctaaaaataaaaattaaattattccaggttccataatggtttattctaataataaaccattctcgccagcatacacacacaaaatgaaccatgggtgaggaatttccagccttcgtaatagccatttttatttcatggttgtcagatgcaacatggccttaaaaatcatttactgtcattatttaagaaaatttttctttcttaagtttaaatcatctacagtgatcataaaaaatgaaatttcacttttgatgagaaagaggaaactatttttttttttttttgagatggagtcttgctccattgcccaggctggagtgcagtggcgcgatctcggctcactgcaagctctgcctcccgggttcacgccatgaaactacatgataaaccatgcagttacttaattttagaacttgaaagcaagataatatgtgggaattacttggggagaatgaaaaggttaaattaatagctaataataactctaggaaatttacatgtcacataatgttacttaaatcagctatctaaaataggtatgtgctaaggaagagatacatttttagtttatctagcaaacattactagaggaaaaatggggcatattttataacatggagaaataacctatgcgtggagcataggaaaatacataaaaactaaatgagaatttagactaatacataatttagcatcatttttacagagacttcaaagccaataataaatgaatacttaagtacatttcatagttatggcctagaagttcacttaaggacagagagggaatacgatgtcacgggtaagtgatggaacaggctgtttcatagtatttcttaacgaatgggatctagaaagaagaattttgaagcaaactcttgtaattctcacatgtcatgggaaggacctggtgggaggtgactggatcatgggggccacttccctcatgctgttctggtgatagtgagtgagttctcattagatctggttgtttgataagtgtctggcacttccccctactctctctctcctgccaccttgtgaagaaggtacttgcttctccttcaccttaaaaacatgattttaagtttaaacttaaaacttaaaaccatgattttaagtttcctggggcctccccagccaagtggaactgtgagtcagttaaacctcttttctttataaattacccagtctcacgtagtatctttatagcagtgtgaaaacagattgatacagcccctgatatgtcttctatctctgcctctccttcccctggcttttcccctctcttctttggatgccttttccttaaatggccaaaacataaacatatcattccttgtaacatatctttgtaatatttaatatctttttacatctttatatttcttatattttggtaaagtaaaatcttctttgctataaatttagacatctacttttctcttcattgacatttatctcccatcatttatcagcagctccagcccttttttaaaacttgagaggcctttcaataatttattttctctgtgaggaaatggtccacataaggttctcaacttgtatctaataatcttctttacattgaggtttatttccttatttctgattctaccctttatagaaagacgaatttcagtttttatcttattttatttttattttattttattttattttgagatagagtctcactccgtcgcccaggctggagtgcgctggcatgatctcagctcactgcaacctctgcctcccaggttcaagcgattctcgtgcctcagccccctgagtagctgggggactacaggcgcgtgcaccaaggcgcgtgccaccatgcccacctaattttttgtattttttttttttagtagagacggggttttgccatgttggccaggcaggtcttgaactcctgccctgaagtgatccaccctcatcagcctcccaaagtgctgggattacaggcatgagccactgtacctgggctaattttagtttttatataaaaccatacatgcaatctactattaattcaccatgtaactttgtctttaggataactaatcctagctcctcatttaccttttaggaggcagtataacagtataacatagtggtttaaaaaaaggctacaaattcagacaaaccagtttgagtcccttgctgcttactaattgtgtgaccttgggcaaatggcttgggcacaataatcatgcccacctcataggattactataatattaaacaaaataaatttcaagttcttagcatgttacctgacatttagtgctcaaatacttctcaccattctcattttgcaataatctacgtttaaccaaagcttttaaaataatacagctctcttctttctcttcttaactcctatactattcttcatccacagagcccaggttccagtgttctgaggataatgtaatttatgtgtcaaaatattaagctgcatagattctaactaaatgctacacctttattttaacaacccactctcagcattccttacagtaccactgccaagttgattcatattggatgaatgtctttccttgggagctaaaggaaataatctgcttctaaacttttcactatccttttgagaagacaggtatattatcactgtctccatctcactgattaataaacagggtctaggagaagcttaatggactgaagagaggcagaatagtcaatgagaaggactgaaatactgcagtgcttgatactatatttatattatggatcagcgaggacacatgcttagacattcttgagctaatttaggtggctctaatagctacttgttctgattttctttctttttgggggactaagtggagtcacagtcttcctgaagaggcattcagaaccatactgctgagcctgatcactcaaatactcagatgccaaatgaagaaaaggtggatgttctctctctcttttcctttgtatctctgccttcaggttctgctaccaaatgggcttcatggcagagaggtgttcaataagctgacaactaagaagagcaagagatttcacacatatgacctttaatcactaatcacctgaactgcatgagaagtaatgtgaaagggaaaattcaaatgaaactatatagcaaaaaatttttaagggatgaagctaactcattatagaggtaggttcaaaatcatgtatctgagaccaatacttaattctgccaatcaagacttctcctgtctgtacttcattcatttatttcaacgttttcccaacgtggccatcttgccctattcagttctaaaagaaaacagggaatagttttctcctcttcggaccatgggcttatggcccatctggagaggatagggctccgaagccctatcctatttcaatttccttttatttaagtctagccctttgaagccagctctcccaagaatattctagataatatctcaccccctcagcatttttccattctttataccaatcatctgcactgtttccatacaagtaataagctggccatttttcactagtcctgaagattaataaaaaaagaaattctacagaataattatctccaactatactcccttatcccccagcaaactgatagtatcataggattactgtggcccatggtaaggtagagaaatgaacaatagggccagagttatattttgcattttaatagttttgactgtatgcttgttctaatttattttaagacctgaggtctgtgggcccatatttatcagtcaacctttttaggtttgcctgaatttcttaacttgttcatttcttaaacattattaagcactgtgctatgattcaaaaggttaaaaaaagatcttaggccgggcccggtggctcacgcctgtaatcccagcactttgggaggctgaggtgggcgaatcatgaggtcaggagttcgagaccagcctagccaacatggtgaaaccctgtctatactaaaaatataaaaaattagctgggcgtagtggcaggggcctgtagtcccaactactcaggaggctgaggcaggagaatcgcttgaacccgggaggcagaggttgcggtgagccaagattacgaccctgcactccagcctgggtgacagagcaagaatctatctcaaaaaaaaaaaaaaaaggatcttttcactgcccttgaggaaatattctggaaaatagtaagattaataattaccatgtagtatgtcttcgtagagacattagcaggatgaaatgggaacacagcggacaggtacccaaatcaactgcattccaaattttcatgttaataatgggtgaaaaagggctctgagtctgaaaaggacacttaactccaaccttccttctttctgttttgtgatgttaaatccaattataagggctgacattcccccaaaggaagatacacattagtgttttaatcaacaaaaggaggtgataaagtaatggatgaaagacaaaatttgtggattttaaatctcttttccccatatgagtccctcgctgcttcctgccttgtgctttttgaacaagtaacttcacattctgggcttcacattctcatctatcaggtgagcataatgttgccctccatgctcaatgatagggttggaaagaatgactgatcaaagttgttcccattcaactctacaacctgtatatttccagatccaaatcttttcaaggaaaagggatagggaggggtaggacctagggcttagggagcaaaggacagtgaaggaggccgaagcccattctcaccgaaaggatcttatcaccctcctggagccgcccatccagggccgcagccccattttctttgatgcggctgacgtagatgccactgtcgttggagacatactgctgatctgtcccaccgacgatgttgaagcccagccctgagaaaatcatggaggagtaaaaagatgggggtgaagaagaaagaaagagattagagaagatgaagagaaagggagggaaagcctactggggaggaaaggctgatggagaggagatgctggcgagtcagcctgtgatggagctggtgaatggtcatgaacaaggtcagccatatcaagagtattgagttgctcactcaaatgaggcacgactgaaaatataaacacagtgatccacctgttttgttcaatatataaagaaagatctatatagaacttaaagaataatggtgattactctaagttcgttcttctttttctttttttttttttttcagagtcttgctagtgggcatagtggtgggcgcctgtaatcccagctactcaggagttcatagctcagttgcccaggctggttatgagctcctggcctcaagcaatcactattgccttggcctcccaaagttctaggattacaggtgtgagccaccatgcccagcctagatgtaagttcttctactcacatttagttttgatcctgttgatggtattcaaaggacccaattcctgacattcctgatattactacagcagggttagctgtgttcatcaaaagaagctatgcatttttaccaattatcaaatgaactgttcctaatttagtgtgagagatttctaaccataccttcccttccacactttccttctcccaagcttctggagaatttatgtatgatagtgctttagaaaaatctcttgagagtttctttttttttttttttttttccattttggtggtggaggcagtggtgtaggtattggcagagaaacctcagaaccagaaaggtaactgctatttcatggtaggactaaatcaccaaatttactctcccttccttcgctacttcaagtacaaccatatataggttgagtatcccttatccaaaatgcttaggaccaaatgtgttttgaattttgaatttgggggattttggaatatttgaattaaacttaccagttgaatatccctaatccaaaaatctgaaatctgcaatgcttcaatgagcatttcctttgaacgtcatgttggcccttaaaaaattttggagttggaagcatttcaaatttcagatttttggatttgggctactcaatctatacttgggcatagtaattgacaacttttattcactgtagaaaaaactgactactcgttgattagcaactccccagttcctcttccctaagtccttggaaaccaccattctaatatttgtttttatgagtttaactattttaaatgcatataattttagttatgcaagatgaattaagttctagagatctgctgtacaacattgtgcctacagataatactatatcatacactgaaaaatctgttcggagtagatctcacgttaagtgttcctaccacagtaaaacaaaatattaaaagaaagaaaaaagagaaggaaagaaaactgagtaccaaagtgctatttctatggaccaatgactaagtgctggaaaggattttactgtacagaaaccgttgttaggaaaggattttacctatgcataaaaaaataaaaaggaaaaaggaacttctctagggctttcttaatgtcagctactggtagaattcaggggcacagtgtaagacaaaggagatagtttggaaacaaaccaaaaatctagcggtgcaattggaaggaataaccataatcaccagcctacactgttctcaatagaaaagatacttaaagagacatatgcggggggccgggcgcggtggctcacgactgtaatcccagcactttgggaggccaaggcaggtggatcacaaggtcaggagatcgagaccatcttggctaacacagtgaaaccctgtctctactaaaaatacaaaaaatcacctgggcatggtggcaggcacctgtagtcccagctactcgggaggctgaggcaggagaatggcgtgaacccgggaggtggagtttgcagtgagctgagattgcatcactgcactccagcctgggcgacagagcaagactccatctcaaaaaaaaaaataaaaaagagacatatgcgggctttctgaaagttctccccattggtgggagaaaagcttacacctgaagctcacagtattaacataagcactagcaaatcaatttgtaatttaaagaaaaacatgaccaaacaaagacacaacaggaaacatttaagttaaaaagcataccttagccaggcatggtggctcacgcctataatcccagcactttgggaggccaaggtgggtggatcacttgagctcaggagttcgagaccagcctgggcaacgtggtgaaaccccgtctctaccaaaaatacaaaaaattagacacgcgtggtggcacatgaccaacattgggaggctgaggtaggaggatcatttgaccctgggaggcagaggttgcagtgagccaagattgtgtcactgcactccagccagggtgacagagtgagacccccatctcaaaaataaaataaaatacataaaaagcataccttgtgcataaaatctctgcagctagataatagaaagaatttattctctaaaataatatacataatagaaagtgctacttctggagtttgtgacctggctgggcaacatagcaagaccctattctctaaaaaaataaataagaaggtgctacttctggaagatgctattttaacttccttgaagggctgggtattaaaaatagtagcttaacttactaaatgattttcttagagcaccctcaatttgtatcatagaaggtaggaagtattggagaaggtacagaaatgtaagataaggtggaaaagcagatggaacaagattatcgaaggttttgaaatgacttcaaaactgtgacagctttgaacaagggggccaaggccaacccacctctcccaagctggaacaaactatgtagaaaaatcttttgatgaaatccaacaccctcatcaaatgctacagttgcctctggtgatcttgggaacaggaagcaaatgttaagcagctgaatgcaatgtagtagttagcaacagaaaggactttgctactggttattcaaagctaactgtagaaaaaaaaggaagagtagaagaaattttaccgagatttaccataaacaaaaaagagccgtctactacacaccccatcgaagtcatattatataggtacatttataacccgttgctacttctgttgtaaatgaaccaaactatttaacatgagaactcctggactgacctgaagccctttgttcagccagaatatttacagaactgggtgtatctataagccaaagcattgctgcaataaaagagtcaccacagcattaagtagtggcatgaccaactgaacctgggctgtacggatacctacataatccccagttcacttgctcagtaaaaattactgattgaatcttatgtgtaagatgttgtgttatcatctgaggaagacataaagttaaactgcacactccctgctttgatcacaaactggagtttttcctttttcctgtccctttaagatattgcagaagcaaatcaacatttactatgtgttaggcattacgttatgctctgaggaagatataaagctaacctggacagttcctattttaaccacaaacccaaatttatccttttccctgtcccttttagatattgtagaagcaaatcaaagtcagaagacttggttctaagtttataacttaccagatatgtggactgaagcaagtcagtttacctctgatcctcagcttccttttctacaaaaataagaattataaattctgccctgtctacatcaatgggtaagtgttaggggccaataacataaaatacgaaaaaaaatcttcataaactacatagtagttgctctattgggataaggcgctaggagtagttgtcaataaactaatggctgctaaagctccaaactagatagtttgacagagaaagaatgaataaatatacagtagaaatgcaaaatctcctaaaaaatgggaagacagattttaaaattccacccatctataaacaggaactcaaacttattaagtacgtctatggcatgtgacctagaaatcccccttaagagtagtttctagcaagtgtgatatctaaactctgcggcaatcatccagcatatggaccaaccaattgaaacagatgtcagttggaaaccaccagaaagggaaaggctattcaatacgtatcttgctaatcattggctatggcccagaaaaatcttgcataagtagggtgaccacatatcccaaaagcaattgccacaaaagccaaaattgacaaatgggatcaattaaagagcttttgctcagcaaaagaaactatcatcagagtggacaggtaacctacaaaatgggagaaaatttttgcaatctatccatctgacaaagggctaatatccagaatctacaaggaacttaaacaaatttacaaggaaaaaacaaacaaccccatcaaaaagtgggcaaaggatatgaacagacacttctcaaaagaagacatttatacggccaacaacatataaagaaaagctcatcatcactgctcattagagaaatgcaaatcaaaagagatgccatctcatgccaattggaatggcgatcattaaaaagtctggaaacaacagatgctggcgaggatgtggagaaatggggatgcttttacactgttggtgggagtgtaaattagttcaaccattatggaagacagtgtggagattcctcaaggatctagaagcagaaataccatttgacccagcaatcccattactgggtatatacccaaaggattataaatcattctactataaacacacaggcacacatatgtttactgcagcactgtttacaatagcaaagacttggaaccaacccaaatgcccatcaacaatagactggataaagaaaattggcacatatatatcatggaatactatgcagccataaaaaagaatgagttcatgtcctttgcagggatatggatgaagctggaaaccatcatcctcagcaaactaacacagaaacagaaaaccaaacactgcatgttctcactcacataagtgggagccgaacaatgagaacacatggacacagggaggggaacatcatacaccagggcctgtcagggggtggggggtaaggggagggagagcattaggacaaatacctaatgcatgcggagcttaaaacctagataacgggttgatagtgcaggaaaccaccatggcacatgtatacctatgtaacaaacctgcacgttcagcacatgtatctcagaacttaaaattaaaaaaaaaaaaaaagatttgaaaccaaaggaaaaaaaaaagatccttaataatatattcttagtttttcattaactcacaggaaaagtctgaccacccatgagacagaaacctattacagctatttacaaggtaaccaggcttgtaaaaatataaaaatgtaaaaaaaaagaaacatggagttttaaaatgtaatgttcatattcataacacaacacctccctataaataaaaacatacacacaaatattaactatttacaaaaatgcatgcatatttaaagaaatataaagacacattagagtgggtacttatggggagaaagatacaggatagagtttaggtatgaagggtgaaaaaagaacctgagaggaacatactgatgataacagtgtactttggagctaaagggtataattaattcagctcttagcatttaaggtccaaaaggagttgaggggagaggcaggaagaaaaaagactgggattcaacttttttttttttttttttagtgaatgaatgaagagcttagtgagctctggttataatgtgccaacaaattttaaaatatggcaagattaaaatgggttgctgggtgtctattttgcagtctaaatgcaaaatagtaaaggtagcataagaatgacaccactataggattaagagagaaagaaagtgtgcctaatagaagaaccttggaaagttaaacaagaaatcccttcttttgaactcctgactataggtctggaccctaagcctgtttaaaagagcaatggcagaagcaacagctaatgtttaccaagaccttattatgtaccaaataatatgctatgtactttatatatattatctcatttaatcttcttgacaaacacaagtactcatttttcaaagagtttaaaaggtgaggcatggacaggttaagcaactttacaaaaatgtcacacagctctttgcaaagccaagacttaagtcaggctgtgtgattccaaagcatgaatttttaaccattttgctacaatacatctttgcagaaaatataaactgctttaagaaaaaaagtcttctaagcattgctggctatcttaggagctaactggtctccaggctggctctgaacaagcaatgctgggataatggttgtagaacaatctccaagggtaatatattctagaggaagaattcaccactatagagttttgtaactgttgtcaaggttcctattatttaccttcagaccagaaaaggaaaagcccttcatttcattcagattcttatctacaaaatctaaaagttataaagtaaatgaccagtgttaacctgttattctagaaataacaattctggacataattaaaatgaaacaaaatagttcattaacaccaaggattatagccacttgttgagttatgaagactagagtaacaaacaccctattttcccttttctttcccaagatcaatccgactaattttctcccagacatcaatcaaactccattggatacacaacccccctgtctgtcttttatgaagactagagtaacaaacaccctattttcccttttctttcccaagatcaatccgactaattttctcccagacatcaatcaaactccattggatacacaacccccctgtctgtctttatctatatcatggtaaaataaacttaacataaaatttaacattttacccatttttaaatgtataattcagtggcattaagtaccttcacaatgtcgtataatcatcaccaccacctatatctggaactttttattcaaataaaaactctatacccactaaaaaatagctccttattctcccctcccccaaactctgacaccatctattatactttctgtctatattaatttgtgtattctaggtaccccatataagtagaatcacacaatatttgttattctgtgtcttgtttatattgcttagcataatgtcttcaaggttcattcacattgcagcacatttcagaatttcattcttttttttaaggctgaattataatcttttgtatgtacataccacattttatttacctattcatctggcagaggatatctgtgttgtttccacatttggcggctgtgaacactggtgtacaaatatctgttttgagttccttcctgcaattcttttttttattttttgagatggagtcttgctctgtcgcccaggctgaccagcagtggcgcgatctccgctcactgaaagctccgcctcccaggttcactcattctcctgcctcagcctcctgagtaactgggattacaagcgcctgccaccacgcctggctaatttttggtatttttagtagagacagggtttcaccatgttagccaggatggtctccatctcctgacctcatgatctgcccgcctcagcctcccaaagtgctgggattacaggcatgacccaccgcgcccggtcccttcttgcaattcttttgggtatatacctaggagtggaattgcagaatcacatggtaattatatatttaataatttgaggaggtgataaacttttccacagtggctgcaccattttacatcctcacaaacaatgcacagctaccccaatgatatgtgtgtatgtatgtatgtatgtgtgtatatgtatgtatatatatgtatatttatatatatatgtatgtgtatatatatatgtatgtatgtaaaatagtcatcctaatgggtgtgaagtggtaacaaattgtggttttgatttgcatttccctaacagctagtgatgttaaatatttttttcatgtgcttattggccattggccatttgtattaccttctttggagaaatgtctactcaggtcctttgctcatttttgaattgggttgttttctgtcactaagctgtaaaagttctttatatatgctggatattaacttcttagcaaataaataattggcaaatactatctcccattctgtgggctatctttaactctcctcatagtgtcctttgaaacacaaaattttttacttttaatgaagcccggtttatcttttgttttgttgcctgtgcttttggtatcacatccaagaaatcatagccaaatcgaaggtattgaagctttttccattcttctaagagttttatggttttagctcttacatttaggtatttaataaatttctagttaatttttgtacataatgttaaggcaaaaatccaactttcacatacttctgcatgtgaatatacagttttccaaacaccgtatgttaaaaatgtgtactctgctgttatttgatgatgtgttctatatatatatatacgcctgttaggtctaatttgtttatagtgttgttcaaatcctctctttccttattgattttctgttggttgtcctatccattactgaaaatgaggatactgaggtctaactattattataaaatggtctacttctccagatcaatttttcaacatttgcttgatacattttggcactctgttgttttgttatgggaactttggggtgtcacttttctggcaggagacctctgtgtggctgctgcagcagggtgggcagctccaggtgctggctctctgcaaggctacagctggaccaggcgtagcgcgagcagcttctacagctggcactggggaacacgatggcatctggaagcttggagatgccaggaaccgtagggtcccaaggagaaagtcacagccctggctcagggagctcccaggtctcagatacatgaagggttgcagctcttctctctttctcttcacccacaatgtggcaagcaaggggcatgtctcagccctgactgtgttacagctctcttagcctcaccattcgatggatcctgagttcttgtccagcaaccaggaagaatgagatacacagacaagtggagtgtcagcaagtcaaagaggagctttactgagtgacagaacagctcagaggggacctgcagggggcagctcctttcagcatccagggtgtgctgatgagtgttcggctcctagcagagacagtagctcttctctgctagggaggtcatcccaatgagtgttcaactctcagcagagagggtagctcctctctgtaggcaggtcatctcaacaagtactcagttctcagcagagagggtagctcctctctggagctggtcatcccatcttctctgctgtggctgaacctggggcatttatgggcctcagagcagaagtgtatgccgactggtccatgggcagccacagacagcccagaaaaggcaccacatgtacccattccagtctgtgggactagcagcccagccctcagccttcaggcccaccttggcctgaaggtggggcctcaccagggaccaacccccttccacccaggagactgtctgcctcctgccaccatccatggcgaccagcctgtttgtgccaaggggcacctgcaggccagtgctgagctgccctcagcacccccaggattcccctcatgcttgttggtgcccaaagtccagagagggctgaggcagcaaggggctggtgtgtcagcactgccctaagtgtgtacacactgggccgggctttgacagcactcagattggcccaaaccctgcactgagatcagagcaggcactgggagcagggagaggccaggcagcaggaaaagacacccctgagcctgtgggtgcagggggaaccttcctgggcccctgagggtgaagagtgcagaaatgcctaggtctttgcacctgggagggcagagctctcatctgctccatgaagtgtgcagccagcactagctgtgcctcctcacagcctggggtgggggctccaggtcctcattgggccggggcaaatattcagagcaggagtgacatcaccacaagctccctgctgtcgccctggcgctgaggggtggcctgggactcactgtcgcttggctcacagccctgcctatagggggcctctaggagcagatagggggcctccaggagcagatagtgggccccagtcctggccatcacaagtgtcaggctcggaagtcacccagatgcagggtggaccccggggatgcggccccgcggaggctgctcccaaggtgcaagaacccactgcagtgcccgtggtgggtgggtgtggtgggtgctccgctggccaggtccccaaagcaggcgccgctcccacttcccaccctggggccccaacgtgcggccccagctctgcacccctggcccagcccccatgctctgtgtagaagcgtggcactgccccaggcccaccctggcctcacggcccctctctgctcgaccacactgctcacctgctggcgcccatctcggcctcgccccatagcgcagcccccagggcagcaggctccagtggggttcctgcttgtccctggctcccactggctccatggagcaaggcactgcccggggcccagccctgcctcctccccacactctccctgcagtggcagcaggcaagagaggcaatgcagggccagggtctggagcaacagaggctccggacctggggatgggtcctgcctggccatgtgagggtgggggacacacagttggctgcctcagggacgcaaggcataggggacccaccactgccattgctgctcccgcagccactcctgctgtcactgcccacgcctccccgctgcagccagtgtgatggcactgccatgaattccccctctgaagaggaacatctaactgctgttaagatagggacgatgactgctcttaactgcttcatgctgacagagggtgttaatttgtggaaaacaggagattttctctcaggatcctatctaagggtcagcttcatgctgattggtgttgttttggggaaaacagcagatttcctctcagggtcctacctaagggtccccagtaaaagggagccatcatccgaggctccatttccatgaccatttggagtttgacagcccaccccttttatttcttttgagctgcagtcagagatcactggttggttcacccctacaattgtcaaaagctgcaaaaaagagaaaagtttccttgactctgaaatacaaaacaaatgagcagcaatgttccaagcaaaaagtcaaaaaggattatttcagtcttccattagttcagatcactcagtcaactcctgttcacaatctccaaagttatcagaaacctgtactcaaggactataatccatcttttgaagaggatcaaaacaagacaacaattgtctgtgaatgccaaaatatcctaaggtcgtttcattcaaaaacacaaatgactaagaaatttggtaacctctgtggattacaataacccaatacgataaccctaattatgattgacagcatatactcagacatttggatttttgaagtcccatacaattttggaacatacacaagtattattcaccaaaatataacctgaagaagactaaaccctatctttatcttgacaatccctttacaaatttttgttaaagagtagaacagtgcctttagaaacccttgtggttttattcccaagttcactttataaaaaaaaacaaacaatacccttttgaatttagtattcccacacagaattttgtttttaagattaacctttacaaatcttccacaacttgtttaaacatttagctttatcttacctaatttaaaacaatcatttaaccccctaaactaggcaaaaatgtatattcccatgccttcttatacttttactaaagacacgttttacattctttacacaccttgcatgtaaatctatcctcagtagtctcaattacatgttataatggtaactgttagcaattcttaattttgatgaaaaatctggtaagttattttaattatttacttagatgctgataaggtctatttctaacatagctaggggtgtggcatatgttccccagccttaccaaactgtaaagcaggcaagttgaagaattttcaaaagccaaagaagcagtttatgacttttgaaaagtccgtaaattatgaaaaattaagcttcaaaattcgagtgctctttttagaaacaccagcatgacttatatataacacttatgggacatcctcttgtaaatatctaggaaagtggactcacttaacttgggatgctgataagcagcaacagccaaaacagggatcctctgaaatgtataaaataattcatttgcaagcacaagagggaaaaaaaaagctggttttagaaccgtacaaactgaatgagagacctactttataattgtcttggttaaaatctgataataagagatttgaaaagattattttttagagttctctggtcagaagtcagcttacttagggctgggcatggcagctcacacacctgtaatcctagcactttgggaggccaaggagagaggatcacttcaggccaggagtttgagaccagcctgggcaatgtatttttttttaataaaagaaaaaaagcttaattaaaagtaatatttaggctatcttttgtgggggggaaaggactttctgcttttttcctctcttggatcctggttcttggctttttttttttttttcagtcaattgagacccctttttaaatatgtttgataccttgagtcttctgtttgtttccaatcttgctggcataatttttgctgagaaaaatataaaacttcactggccttttacaaaatttaaaatctccaggctcttgctctgttgcccaggctggagtgcagtggcacagctcactgcagcctcaatcgcccaggctcaagtgattctcccacctcagcctcccaaatagctcggactacaggagcacaccaccacacccagctaatgtttttcttttctttttttatgtagagacagggtcttgctattttgcccaggctggtctcaaactcctagctcaagtgaacctaccacctccgcctcccaaacagttaggcttacaagcatgagccactgttcctggctaaacttgttctatttctttccactctgctcttccttccttttgttattttgataccacaggaagaaatctaaaggagacttctaacgactcagacccctcaaggaacgctgaaaaaacacaccattcactccctttttggggtattctgtcttcttgtggagtctgaaaagtcatggacaggttcctctcaggtctaaaactctgctctcttccatactgcattacttgttggcttttgagagtaccagagattactttgtactgtgaaagagacctttgtgtatgttatggctggtaagtcactgacaagagctacagtattggaggtgactaacagcagttgtttatggtgaatggttattactataggcagctactcattttattttattttttaaacatttaggtaagaaaggtgtggcttaatgtctttgtagtgaggtgcgctgtggaggtttgtgtggcctggtatcatggcattttgctctttgtggagacccaagattcacgtaaaagtggtttccttgatttttaaagatccagatgcactgccctgcaaatctgcctggtttttagacacttaatatcaggccctgaggcagtcctcactgggacaacaggtggtgcacctgtagtcccagggaggctgaagtgggaggatcacttgggtccaggagctcaagaccagcctgggtaacataatgaaagcctgctttaaaaaaaaaaaaagaaagaaatttttaaaatatatatctattaggccctggaaactgcaaatactttcctggtcccattcatgaaagggctccactttgaagtcagtaatctaatcaagaaacgaactaagtatctaacaagattatagtctccaaaatacaactttctagcacttagctggctactttgaaactctatgtaaaataaatttacttctataaaggaaatctccatttgtaaggacatgcccctatacccaagcagctagaaatttttacaatgggaaagacactggcttaaagttgacataacaaaccttacctatgtttaaagatacttttcctggcaatcttatcttgactgattctttttgtttcagcaaataatggtatatagatataagttctatgcctctaggggtatcaattttcacctaagagtaatgtttgcaatttagggttacctagctaaacaactgtttagggcaatggaataagtaatcaaggaactggtagtctaaacagggagagattatctgcaaactggcaaatgaagaatcttataaagctataagatctgtttctgtcactgtgtctgtatgtctctatgtttatgtgtcatgtgtatgtgatacttcactaccaaaatacatgaaaacattctaatgaatttgtcagaggcgtttaaaccagagcaactccatcttgaataggagctaggtaaaataaggttgctgggctgcattcccagtaagttaagggattcttagtcatggcgtgaaaaagaagtttggcacgagatacaggtcatgaaaaacttgctgataaaacaggctgctgtaaagaagctggccaaaagccaccaagatggtgatgagagtgacctctggtggtcctcactgctacactcccaccagcgccaagacagtttacaaatgccatggcaatgtcaggaaattaccctatatggtctaaaaaggggaggcataaataatccaccccttgtttagcatataatcaacaaatagccataaaaatgggcaaccagcagctctcagggctgctctgcctatggattagacattcttttatttgtttactttcttaataaacttgttttcactttatggactgcctcaaattctttcttgcgtgagatccaagaaccctctcttcgggtctggatcaggacccctttccagtaacaaaatggctttaaaggtaagcacttaaatcaagtattttatcagaaatatagaaagtaactcaaatgccttttagttcacattacaaaaataagactactttgttggtttaatgaaaatggctgtttcttctgatcagcaaaatatgcatgtatgtaacgtcagggtttctttcacaagctgtggaaactattaacaaagaaataacttgaggccaggcatggtagctaacatccataaggccaggagctcaagaccagcctaagcaactggcaagatcctgtctctacaaaaatgaaaaattaaaaaaaaaaattagcagggcatggtggtgcactactgtaggcctggagtgagccataatagcaccactctactccagcctaggtgaccgggcaagaccctgtcttaaagacaaacacaaaaaaataagtaacttgggatgacggccagctttgtttaatgatctatacaagtctaacttttaaaaatgaataaattaaatgaatataaatggtataaaagtgtataagcaagtttttcataattttaagaatctttttcagaaacttaaaatcatgttatgctaaattaagtaacagataattataaaatgtctgagtcatttacatggtatagaaaagctaaatatatttagatctgttaacaaacagattgagaaggttatctttctagaaattatgaaatggttctatctacaaatactggtataaaactgttcaaaattaccttacttcctaggttcttcactggaaattagggttactaagagttaaagttaccgtcaatatatacaattaaaactactgaacacaagagaaacaattctaaatacagtgcatataaagaaagtaagatgtgaagaaagttgacaatagagatcacttttctttacatggtaactttgtgtggacaaaataaggaggaaagaaatgtaaattaaataaggagggccaggtatagcggttcacgcctgtaattccagcactttgggaggctgaagtgggtggattgcttgagtacaggagttcaagaacaacctgggcaacatggcaaaaccccatctctacaaaaaatacaaaaaattatctgggtgtggtggtgtgtgcctgtagtcccagctattcaggaggctaaagtgagaggatcatcaaagcccaggaggatgaggctgcagtaagctgtaatcacaccactgcacttcaagttgtgtgacagggtgagaccctgtcagtcaatcaatcaatcaaatcaatcaatgataggaaagaaggaaatgtaaatttctgtcttaaggtagaatgccaatatcagaaagtcagtataggacaaaactaaagatttaaacaggttgtagaatgtctacggaaaaaaataaatgaatgaatgaatgataatggggaaataaatgtataataaatttctgtcctaaggtagaatgccaatatcaaaaaggaagtataggacaaaactgaaggtttgaacaggttgtattaggttggtgcaaaagtaatggcaaaaactgcaattacttttgcaccaacctaatagaagttttgtggaacatgaatcttatgaattttgtgagtgatcaagttggctaaaattagaaggggattatttcactttttaaaaaactgagcatcaaaatcaaaattgagcattaatatcaaaagcacactgatgcaaggccagactcaaaataatgggttttgggggccactgatctgctctttaatagattaaaaaagggttatgggaatcttgtgtgttcaaagctgattgagattagatggatttgtttattaaagttagctttagcattaacaacatactgatgcaaaggtagaatatggttctctcttttaaacaatattttcatatactaagagataataaaagacttgttcaccttttgagtaatctacaaaaataaaaagagaaaaagatgtgttggtcttgtgctgtctttattaggtcttttgattgtttgggaaaccaagtctcctttctattcaagagtaaaggtctttgctttcaattatcaccttgacttaattaatgactattatttattgtgtcttgtgatcctgtttagattaagtgttttcaacctgcattatttgacatgctttccaaaactaaatttcaaattctaactttaacccttttccaaaaggaacccctggaagtccaacagatacgtattaggcttatatgttaaaatcatattgttatagtaggtagccagtcaggcataagcagggcaggagggggcctaccaccacacacacacaccaggaacgtcaggttacctttgcagaataacacacccaacaactacaaaataaactttatatttaaaatgcttatgaaactgcctttccaaaaattgtaactgagaaaattatgatggtgaaagagatctgacctaactgactccatcttgcttctaatctccaattgtccttgttcattcctgggtgtaggccaaactaactttgggaggaacttagcttacagtttaactttgaaacaaagataacagccctttgctgaaataaacccccttcttgcttggggactatactgccgttgcaggactaacaaattagccacaagattagaaattatgatttaggagtcatgcagctggaggctgcaagattctgaacttccccgaattgctccaggggataacatcgcgattgtaaaacctaagatcagtgcttctgatattttgcagaccctgcactcaatggatcaggcagcaccacttagatctataaactaactcatctagtctttgtagtgcccacccaagaaacaacacagcacaagaggacagcttcaactccccatgatttcttctctgacctgaccaatcagtgatccccactttccaaccccccacctgacaaattatccttaaaaaccctgatccctgagttttcagggagactgataataaaactccagtctcctgtacagctagcgctgtgtgaatgaaactctttctctattgcaattcccttgccttgataaattggctcagtctaggcagcgagcaagaagaacccattgggtgattacacctgcacttcattgaatgtgaatcatgcctcaaaaaagttgagatgaacctggtgattatgtacaaaaatgcaagcattttaaacatttattaatgactcctacttattaggttggtgcaaaagtaattgcagtttttgctataaaaaatggcaaaaaccggccaggtgcggtggctcacacctgtactcctagcactttgggaggccgaggcaggtggatcatgaagtcagaagatcacaaccatcctgactaacatggtgaaaccatgtctctactaaaaatacaaaaaattagccaggcatagtggcaggcgcctgtagtcccagctacttgggaggctgaggcaggagaatggcgtgatctcctgggaggcggagcttgcagtgagccgagattgtgccactgcactccagcctgggcaacagagcgagactccgtctcaaaaaaaaaaaaaaaaatggcaaaaaccacaattacttctgcaccaacttagtcaataataaaaggctaaagtttctcaaagcaccaattttgtgttaattaagcaaaaaaaaaatttgttatagtatcctccttacagtagactttttctactatttcctatgcaaatatgataaaatgatttttaaataaattctaagtatatccccaagataaaatcaaagtaaaaaaaaaaacatagaagatgaagtttaaactcaaaatcaccataatctacctttctagccatctttggacattctctactttgcattatacagtaaacaaaatttaatatttgctatcgcttttcaccctatcatccccgcccacagctactgcttatctccgtgactttggatgtcttcttccctttgcctgaaaacatgaaattacttgtttaattgtctcattaccctattgcaatattcgttcctagaagacaatgtaattagcttatattcatttttgtacctcctgtgccaatatagtacctagtacatacacaaagcccaactggtgtcaattgactattattggaattgaaaattacacctaggtcaggaatttctaacatttccagttctagggaaatctcacaaggttaaaaatgtttctgggagcttctaacaggttttttttttttttggaggagggggaaggactattgcagtaatagggtttttttataaactaaggcataaaaggagggaaaaagagaaacagaagccccatatccctgaaattactgacacagcttaccctacccttcctagatgactcaattcttgccccataaagtctactccccacatagcagtatccttaaagcacttcaatgaattaaatgagttgttttgtggtaaagtgcttaagacagtacagaatcgtcactacaaattatttataaaacaaaaatcggacaggcgtggtggcttatacctgtaatcccaacactttgggaggccgagatgggtggatcacctgagatcaggagttagaaaccagcctggccaacatggtgaaaccccatctctactaaaaatacagaaaaattagccaggtgtggtagcgggcgcctgtaatcccagctacttgggaggctgaggcgggagaatcgcttgaacccgggaggcagaggttgcagtgtgctgagactgcgccactgcactccagcctgggcaacaagaacaaaactccgtctcaaaaaaaaaaaaaatcattgaatcctcacaactctataagtagattctaataatactctcatattatagctgaggaaactggggcagatagaagtgaggtgacttgcacaaggtcacacagtgagtgagtgatagagtaaggatttgaactcaagcattctggcactttttcttttttgagactgagtctcgctgtatcgcccaggctggaatgcagtggtacgatctcaggtcactgcaaccttcacctcctaggttcaagcaattctcctgcctcagcctcccaagtagctaggactacaacaacctcgaactcctgggctcaagcaattcttccacttcagcctcccaagtagctaggactacaagcatgcaccaccaaacacagctaatgttttgttttgttttgctttgttttgttggcagagatgggagtcttgctatgttgcccaggctggtcttgaacttctggcctcaagcagtcctcctccttgatctcccaaagtgctcggattacaggcaagagccacaatgcctggcttgaactgcaaaattcttaaaaatggggatcatttcttattctttattctagtgtccatgattcctaatcatagtgtaggcacataataaatgctaaataaattttaaaaaatagttttactttacttttcagtcttctgaaaccagcagttctgaccctatcatctaagtatagtttggctatttttccctcaataaataattgtgtacttatcacatgtaatcattgaccacttttctggctagtcacatggcttcgcaaaatgtttctgcagttgaacatctatcagcttgcctttctatttccccaaagtaattcctagatattttactgtacagtttttctttagtattgttttgaaaagatcttaatactgatccttgaagcaatctttagagaactgttccatttacctgactctctccaagaggtgttccatctactccttctccttgtttctgatatcttagccagtttcctatccatcataatacaatgtgtccatcctcattctctctttctcaaattgtatttagtgaagaaccatgtttaccactttttgaaagctgaaacagatcatgttactgcttctctttatttaaaacatcccattatggcaggcacagtggctcatgcctggaatcgcagcactgtgggaggctgaggtggaggatcacttgagcccaggagtccaaggcatgactgggcaacatagtgagatctcgtctctacaaataattaaaaaaaaaaaaaattagtcaagtgtggtggtgcatgtctgtagtcccagctactcaggaagctgaggcaggaggaccacctgagcccaagaggtcgaggctgcagtgaactgtcatagtgccactgtactccagactgggggacagagcaagaccctgtctcaaaaataaataagtacattgggtgtggtggctcacgcctgtaatcccagcactttaggaggccgaggtgggtgaataacttgagctcaggagttggagaccagcctgggcaacatggtgaaaccccgtctctatgaaaaatatggctaataaaaacattaatcaggtgtggtgacacacacctgtagtcccagctacttgaggggctgagacaagaggatcacttgtactcaggaggtcaaggctgcagtgagccaagatcgtgccactgcactccagcctcggtgacaaagtaagaccctatgtcataaataaataaatataaaaacattccattatattattatgatatctatcagtttgctcagtcatttaatgaacacttactgaccactgtgtgtcatgcactagacaaagcattaaaaaaacattaaagacacatgcatgcatgtgttcactgcagcactatccataacagcaaagagatcgaatcaacctaaatgcccatcaatggtagactggacaaagaaaatgtggtgcatatacaccatggaatactttgcagccatgaaaaagaacaagatcatgtcattcgcaggaacgtggatgcagctggaggccattatccttagcaaactaacaaaggaagagaaaaccaaataccacatgttctcacttataagtgggagctaaataataacacatagacacacagaggagaacagacactggggcctacttagggtggaggttgagaggaaagaatcaggaaaaataactaatgggtactaggcttaatacctgggtgacgaaaaaatctgtagaacaaacccacatgacactgtttacctatataacaaacctatacatgtacccctgaacctaaaataatagttaaatgaaagaaaataagaaataaaatatatgttctttgactcagaagagctcaaagtgaagtagaaggaggagacataagtgagaaagcatatagaaaaaaaaagttatttataatgattcagggcttggaattttaagtcacacagacctggatcgaaatcttcacttaaagagttgtataatgcagaagtcaaggtttcctcatttctgaaatggggataataaccatttcatctcttcctttttacaaggggacaagatacagtgcttagcttggcaatacatgggaatacattacaggcaatctgtaaatgatgtataatatagacaataagagaacatctatcctaggtaaagcctgcttcctggaggagctaactgttgaactgagtcctaatcaatggctaggaagtagaaagaatccagatagaactttagagaaagattaagtttccatactaacactaaagactccataatctgatctccacctactcaggttactactcagctacctcttctctcttgaatctcctaaaggaaactttccttctgtccaggctggtttactcactaacctcagaatatgctctgcttattttcttctctctattattgcttaggccatactcatccctgactctggccctagcctaaagcctgtccattccagaagacccacaagttccacgttcttttaattgaccattttaatggttctcagcagtgtctgcattcttgaactttcccaacacagggtcagattaccatgctcctttccgcacttcctttgccctcccactaactacctcctcatcattttccttaactatctgcacctttgcagtgagatttaatttttcatatgtgaacatcatatctctattggattgtaaactccatgaaggcgagactttgtgtaagcaagagaaaatagggcaaggatatagcatttagcctcacatctatttgatatgtgaagaaaggaatagatcagaaaactgctagcaacagtttcagttagcatgaaacccaaagcctatgacaggtctacaaggcttaaatgatagaacttaatggggcatcttgattttaggtactcaccttgatatgccctcagctctatcaagagcaagcaataaaaactttccactgtaggttgtattagtcatttaagatgcctcaaatgcttctgggaataaggcatgatataataaaataaaggtcaggggaaaggttggcagtcaacttcttaaacatggctactgcagtggaaagtagtatatggtatagcagaattaacacacctgggttaaaaatcctttgaaatttactggcattagaaactgggcaagtccttaacctccccaaggcaatttcccaatctaataatgtggattaaatatttattactcagggttgctgtgaagattaaatgagtatgtatgtatgtatagtatatatacagtatatatatgtatgtatagtatatatacagtatatatacagtatatatgtatgtatagtatatatacagtatatatatgtatgtatagtatatatacagtatatatatgtatgtatagtatatatacagtatatatatgtatatatagtaactagcacactaccggaaagacaatacctcctttagtattcattattaaaacactgccatcaacccatcatcttttccaaggcctttaaagaaagtaagaaaataaatattctcttccctctttaaagatggcatatcaggagtaacttgctgaaacccattgaggactcggacctaaaaacaagattcctaatcatagtactcaatgtacagtaaggttgtctttatggccaatctcttacctgttgcagtgcaaaaaaacatattaaacagtcttgtcacactttttagagtaactgagttttgagacgcattaagagactttcaatttgataaagaaaaagtgagagccttagatactataatcaagctggactcctgtagaaaaaaacaagattccactaaagataaaaggtaaactgttcaacccttgaagacatttgagattgtagccactgcctttgtaattcttcagctcatactattagtctaaaatggcaggaaataaaaacaaaacgaagttccaaatggtaggaaacataaaataacataaataatcataaaatgagccaaagaatgaactcttagagatggaagagacctctgaagtcatctagcccaagtcccttcttacagttgagaaagcagacaacaggagagattccatgctattaggttggtgcaaaagtaattgcggttctgccattgaaagtagtggtacttatggctgggcggggtggctcacgcctgtaatcccaaaactttgggaggccaaggcaggtggatcacttgaggtcaggagtttaagaccagcctggtcaacgtggtgaaaccctgtctctactaaaaatacaaaaattacccgggcatggtggcaaatgcctgtaatcccagctacacaggaggctgaggcaggtgaattgcttgaacctgggaggcagaggttgcagtgagacaagatcgtgccactgcactccaccctggtgacagagtgagacgcgtctcaaaaaaaagaagaacaaaagaaagtaattgtacttttgcaccaacctaatacatgtcaagcttcttttgcctcttcactctgttgtcataatttccccaagatttcattacttcccttgcagtaagcagatcagtcaggaacaggttcgactgccttataatatgggcccaaacactggaaatatccacaattcttgtccctgacagaacacaaagggggaatggtacacatgttctcggatctgattaaacatcaggttcctgagtacacagctatacaaacacaaagagtgggcaatgctgcctacaaaagaaatgcatacttagaggattttcatatttcttccatagatagaaagatccttatgggaccatcaaaattatgtggaagtttctagtggtgattagtttctagtggtattttgagacagtctcctccctatatatcttcatgatgataccatgaagaaaagctgaattagaccctgagaagaagagtatcacatactaggaaaccagttctggtaagtgattaacatgaacttgaaacctttctttgttaactgaaccaaccaaatttcaaatgactgttttcacccaagttcattcctaaacttgaggctttactctcccagtaagttcactgacttatataattaatacatggaaatgcttatgaaaatttaggaagccactgagtgaataaatacattcatttgtaataaatatgtgatacagaaatcaaaccatttttgggtgaaatatattagctagatataattattccctttaattagtccttgaagcttgtccgaatgccaatgttttgggaaaatactaacactaggaaatttatgactacaaatgccaaaaaagatgaagtgatattatactgaattttaaaaagatttcatctttagaacaagagataatatcagggtcctgctctgctttagacaggagatctgaaaatactttggatgccagagcaaaaggactatgtcaaagtacattaaattcttaagcaaaaggcaagaatcaaatctcaaacatctcaagaggtagtaaaataaccgaagatatttaggataaagaagaaagaggcaaaacaggagcagaacaactagagcctttaaataaatacttgcacagcaatcagaaaaggaactagcattgttttaattggtcctaagagaacaagttatcaatggatgaaaagtacaaaaaaacagattttgattgaaaagtaactttctatgttagcctcaaaagtcaataaatattaacagtgagtgaaggatacatttatataaaatagcaaaaaaatgaatccaagaaacttgggcataccaaatgagcctttgacaaaagtttaggcgcacatatggagcatgacactaatccattaagattagtgataggccaggcatgatggctcatgactgtaatcccagcactttggaaggccaaggcaggaggactgcctgagttcaggagttcaagaccagcctgggcaacaaagtgagacctcgtctctaaaaaaaaaaaaatattaataatggtattagtgatgagttatattccgataagtaaaaccaacttccaatttttaataatagaaaggaaggcagggcacagtggctcacacccgtaatcccagcactttgggaggcagaggtgggtggatcatttaaactcaggagtttaaatgagaccagcctgggcaacgtagtgaaacatcgtctctaccaaaaatacaaaaaaattagccgggcgtggcagtgcacacccatggtatcggttactcaggaggctgaggtgggaggattgcttgagcctaagagggagaggctgcagtgggctgagatcgtgccactgcactctagcctgggcaacagagtgagaccctgtctcaaaaaaaaaaaaaagaaaagaaaaagaaagaaagaaaagaaaagaagacacaaagtatggataattctgaaagttatattttataaagaataatctatccatgattaagctactgcagaactgcagatgagaaaaggtgatggactgtcctaggtagtggcaagggaaacaggagtgaaagaatttcaggaacatttcagagatggagctcagagtacttgatgatttattagagactcttggaatacagtattagtaggatttactgtgtcagtttagctatttatccattaacagtaacaatagtaggaaacacatactgtttaccataggtcaagcaatgttgtaaacattttacatggattaactcatttcattctcacaacactatgaagtatatttataaccatccccattttagagatgataaactaaggcttacatcagttaagttagccaataagtatcaagaatcagtaagaggttagatacaagatttagacccagatactgtaattccaaagctaaagagctcttaattgatcaactaaatagttgtaaaggaaagtaaacaaagtcgaaagcaggcagaatgtagtaatgtcaagagcccggtttaatgaagagccacagtgggggaagaggatagcagtttggctgctcaaaatcacatgaggtgttcataaaaaataaataaataaataaaataaatctgtattaaatccaaatccctgcagatgggagataagatttaactttttattttcttttttttttttttttttaaagccctgggtaattttgtggcggaaccaagtttgggaacctgtgtaataaaagatttctaagggctcttcctgctttaacattctagttgacattgtaaatgaagttcccagaaatcaaaggagcgagggagggatcctagctgcaggaaaacggctatgcattcagagtccacaccgtttatgctcccattttactaaacggtccctcatagggggagggatagaacaggcaacggaaagaaggatgtggtatccacgataagcaggctaaaaaagcaggcttttaaaaaggcttttctagcacgatttgcacaaagaaccccttcttgactatatatatttgtgttcatccaactggattttgaggtggattcctcagacccgtatctggctaatgatggatttcaatatattttctctaagcaccccgaagcgttgcacgaaacctctaggttgtggcctgcccgccccgaggccaggtgaatccggctcagcagcagaggtgtctgcaattacaccctctaatcccctactgtcagatatgaccctttccgcacatacctgagggccctctggtaagattgatctcttcctcagtgaccaaataatccactcttccgttcatgttttacagctcgtctggcttcctacttgggtcagctggagtgcagcacaggtgaaggtgaatcaatctcggcgctgcgcccacagcacagcggtttcggtttcagcagcctcgagacccggaaaag

SEQ ID NO: 1459 - DNA, 92010 bp, Homo sapiens
tcaacttaatttactttttattaaaaccaacctgctgaaaagaatacaaattttgactaggaggagaaagggggagtggatttatgattttatggcaattataacaggagtgtttcaatggagactttaggcaactagaactcagcatgaaaccagaaggtagaagctgataaaggcaggggtaaaaaggagaaaatgagttcaaaacaactaactttcggccaggcgtggtggctcacacctgtaatcccagcaatttgtgaggccgaggtgggcggatcacaaggtcaggagatggagaccatcctggctaacgtggtgaaaccccatctctactaaatacaaaaaattagccgggtgtgacagcatgtgcctgtagtcccagctactcaggatgctgaggcaggagaatggtgtgaacccgggaagcagagcttgcagtgagcagagatcgtgcccctgcactccagcctgggcgaacagagcgagactatgtctcaaaacaaaacaaaaacactagagggcaattttgcatgcaaattatgctaaggcataatttttagtattatcttagtatttctcaaaatgtagtcatctatggatttactgaacaaatttgccatatctgcttataatcatacactacttcataatttttgacaaccataaataatataatttccttgacatgttaatggtatcattgtaattatcatgtgatgctttggagactgattatcatactatgtgaggcattacaaagaaaatcaagactcttagcagactgtgatcatttttctttccctaatagatatgagagaaaattactgcttgattttactgtgagaatttggatccagacctactgtcctcattaggaatcagaaatcagagaatcagaaatcagaatgaaatatcaaaatgatgccctaatggctattgcaaaaggaatatgtgggtagttggagagtggaatacgtgactctgtttttggagcagtattcacattttttatttcgaggtgtaaaatatacgtggccaacattgttactttcatccacagatggaatagctgggaagtataaaaacctgtacatgacctttagtgaagattatttgtcatcaaattacccatatccaagtttccatgggcctggaatttcctttccacttgatagaagtatatattaggaagtccagttaataatatttttatttaaaaaaaaaaaaaaggaaaaaagaatcagcagagtcaagttgtcttagtcttaaggctttctggatttcttccttggaggaggtcaggatcttcccaaggcctgggtcctcgaatattcttccagtcatcaaacttggagtctttgattttctatagaaccacaaaaaattaaagtataaatattagtataagagcctgtggctttgattaggacacaactaactcaatgaataaatgagtagaaagtatccgataggtcctcgattacaactgtagcaaataaatcaactacaatcattgatgaaatgtcatcttaagatttagaacttttcatttgttactgatgttaatgcctatcttacgccaccttaaccgtaaaactattaaaatagagaaagagtctacatgccttatttttgagaggacaaggaaaaggctgaagctgggaaaacaaaagtacaaatctgaaggctgatccagcacagtgactgaaagggttatcagggatgatggtagaaaataagaagaaaagaacaaagggtggagaccctaaagtcttctacaaaaaagaaaagagaccaagatcatttgtcttacgcctgggcttaggaatgaaaagactttcctacagctatctatcataagcaaaacacttttgggcaactgaaactaactgcaactacattatggatcatcctaccttcatttagtctgaagtacctctcaagcacaaaaatagttggaataaaagggaagaaataaatgtttcttcacctttctcctactgaccaccactctgacattaacttttacatatctgctgttttggttgttctgaaataattgagtaagatggaaaaaaaaagctgtgaaaacataggatagcttatatccagagacagggaaaatggaataaatttaccttgacacttggatactaagcattactctcttactaactagctatataacctttggaaagtaatttaagccacctgggcattaactctctcataagtaacaatgaaaaggttggaccaaatactctacatttgagagtcttcagctctcaaattctacaggtcctagaagaactagaaggaaaatctactcccagacaaactcttcatagcatcattactggtatagcacttgtagaactacaagttagcaagttacaggatttttttttttaatcaatgggaaagtagtaaatgaaaatactgttcacttatagttttaccaggagtctgtattacatatatacatgaaggaacaaaattcaactaatttagcatacaagaagaatttagattatttcataagtatagttatgaaatgatctaaagttattaaaagattttaataaagaataatggccattatccaggtaacgtaagatatgtatgcttaacagaactgaagaaaattcttaaataacaagttcatgtaaaagtagtctagcctttacagatctttggtgaaggagattccttgtagaattctacaaaacgtgcacagtggctgaagaatgggctatgtaaatgtgctgagaaaaaccacccaagacataacacttcacagccaactggtataggcctgagtgtggaacagcgtcaagaaatgctgagaaaaaacagtgtcaagaatatggagtttccaggcctgccagagtggagacctttcttttaacattttgttgctaccctgacatccacctaagacaccaaaaggactgttcttcaggagtaaaaattatgcctgagaataagatttttttttttttttttttttttttgagacggagtctcgttctgtcacccaggctggagtgcagtggcgcgataagattttctttagactcaccccaacaaagcttaaagccaagccttgacaagattctctggggagatagtctggagattgagtcccaacaagggagaagggccaaggaaagatagctagcccttcaacagatacttccctacaaagcacaaaatgaagtttaaggtgattagctaacaattaaattgtcaaaataaaaatcaacactcttcagaattttcttcagtgtattattcacaatgactacctttcaatacaaaatgaccagacatatacaaagaaacaggaaaatataatccagtcaaaaaaatgacaaactcaaagacatgaagaacatcctcaccacatcccataatatagcgtgctgttaaactccttgatttttgctaattagatgggtgaaaagtgatacctcgttagactttgacattcctattatgataaattgagcatctcttcatatgtttaagaatgatacttatttccttttgtccaaaagttttacatgctatgctttcccatgttcttactgaacaaatgaattgttgaactttttcacattgatttggagatggtcttcatatttaagtaaattaatgtgccatgataagattaaactatatctgtaggatttctcatgtaatctgtgactttatatacttttttcattcttaacttttgaatttgtatgtatgaacccattgatctttacttttagagcttctgggttttatatcacatttaaataggcttttttgactcaagacaacaaacaaaattctccatttatattctcctagtactttcagcattttgttttttactttcaaattcttgatccatctggaatttatttatttgtagtatattaagtatggatccatctttttatttgcttttcaaatgattatagtttatcaaataccatatatattcaacgtaatttttttctgtactactaatacttttaaggcagataaaaccagtaactgattgttataagacagagactatattaacataccgtacctcatattccgactctaaagatattttattctctttcagttttttttcaagctcaggatccatctgtagaaaaggaaaaaaagtaataagttatctaagtctgtttgttagactcaattttcaattttaagttatagaagagatggctgaaatactatagccaaatacaaacacatggcaaaatctccaccatctactctgatcacataatgataactaatgtactactgccagcattattcaactaaaaagagttaatatctactgattacttgttatgtgagaggcattttgacatatattatcttgtttcatcctcacaaaatccatgagatctgtattatatgtaaggaatatgggacacggggtttgaataacatgtcaaagaagcagagcttggctttaagtattagttctctgcctccagagttcacactattaaccaccaatctaaattatattatggagaaataacaaaaatactaatataatgctgcacttgaaaacaaaaaggaataccttccatgggccagaagtagatatctaccaaaaaaaaaaaaaaaaaatccatagaggtaaaaaggagctaatgctatattaactgtataaaaagcctttctgtatgtggcaaagccttcaggaaaaagagtatgatggctgaaatcaataaacaacaactacaaaaaagcaaagatcaaataagtaaaatagaagcataaccagaggatttcactggaataatgcatgaagagataaaaatgagatgaatgaaaaaaagtattttacaaaagctagacctaaaagttctaacacatagctagaagttccagaattagaaaataaaggggagggagagcaataattaaataaaaatagcaaagaattcaccactacatagcaatgagtcctcagactgaaagaacatcataagaaataagcacaacaaaacaaaaacatttttaatcaaagtgaagttgattaagagaaaaaagagaagtcacaaataaagagtatttagatgaaaaggtcaacagcacaaattctataggcaataaagagtataataatatgaataattttatgccattaatttgaaaacttagataaaatggacagattaatagaaaaatacaactttccaaaactgacaaaggcacaatagacaacctgaatagttttacaatctataaagaattaaatctataatgaataacctcacacaaagaaaagtccagggtcagatggctttgccagtgaattctcccaaggaagaaataatgccagtgtaacaaacactctgtatgaattatgtggtaagcataaccctgatatcaaatttcacaagaaaataaaaataacaggccagcttcatatatgaacacaaatgcagaattcttagtgtaaaaagaattcagcaacataccaaaaagacagcataccatgatcaagttgaatttattccagaaaggcgaagttaatttggaaatcacaatgtaatttgcaaacaaactaatgcgacagaacagagaatcctgaagcagacttaaaaacttatatgaacagttgatttatgacaaattaggcacagaagagcagtcacgaaacaatgcgattgtcaatatttgatgattgcacaatttcttatctattaagagaatatattcctcacatcacatacaaaaaaagaaaaaaatcaattccacatagaatgtagacccaaatatgaaaggcaaaaatcaaaacttatagtaattcacatagaaaaatatttatactttggagtagggaaaatgtttcttaaaaatcataaagtaaaagaagaataaaatatattgtattgaactttttttctttgagatggaaatctcactgtcaccaggctggaaagcagtggcacgatctcggctcactgcaacctctgcctcctgggttcaagcaattcctctgcttcagcctcccgagtagctgggactacaggcatgtgccactacgcccggctaattttttgtattttagtagagacggggtttcaccatattggctaggatggtcttgatctcttgacctcatgatccacctgcctcggcctcgcaaagtgctgggattacaggtgtgagccacggcacccaaccaagtgtattaaacttaagaaaatttgtttatcaaaagataccattaagaaagtgaagactaaaaggtttataatctggcatgcataaaaagactcctaaaaaatagtaggaaaaaaacccaataatccagtagaaaaaaatgagcaagaggcctcaatagacacatcacaaaaatgaatatacaaaatagaatacaaaaatggccaacagacatataaaaagtgattaacttcatcggtcaccatggaaaatttaaattcacctcataattggatagcaattcgtaacacacccaccagaatgattttaaaaaacaaaacaaaattaaactgacaatacaaagtatttggagccttaacaataaattgctggtaacagtatagatggatagtcattctgaaaaacagtttggaattatcaaataaaattgaagtatgatacaacaccctataatctagcaattcctttttgtacatgtacaggagaaaagcatacaagaatgggaatgttcaggatgtcaccaagatggcagaatagaaggtaacctgctcatatccccccatagcaacaagaatcctgcacctatccacagtaaaaagtcttgctgcaggaacctcagaattcaggtaggaggttgtcaaaccctgatggagccaaagacctaggaaggtcgttttgaatgcattcacacctaggtggatgatccactgagcttgcttctaagttcaagcctggaaacagcccagtccttcaacgggcttagctatagccccatttggccttcagtctacaaccaaaaccagctgccaagaggtccagaaggactcatacatgctagtgacttaacagaaaggcttgtctgcctgatgatattggtcttgacagtgagcctgaaagtgaccctgtggctctgctccagccttcagctgcaggtcccagctcagagctgtttacacaaggacccaaagggagactcaacatatctggcagcccaggagtataggcctcccctgtgggcttgccaacctcctgtcacagcagatcctgagggggcccagcgtcagctgcagcccctcttgctgtagttgagaaacgatcctgtctgcgcaggatcctccagggagacaagtgccccacttgagccaacaagatccagctctctagcctccaggccacagcagatcccaggggggcccagtctcagttctagcctctcctgccacagttggggaactatcctgtctgtctagggacctgctgggaaatgcacacccacctgagccaatgtgacaggcatgccatcctctcttctacagtagatcccgaggcagctcagtctcagcttcagcccctcctgtggaagttgaggaactaccccactgatgcagtgacctgccaagtgacacatgctcatccgtggcaatgagaggggatcatcagccttcccacagcagatccagaaggggtccagtctcaactccagtcccttttgctacagtcaagaacccatcctgcctatgcagagaactgttgggaggcatgcttgtctggtacgctgagacagtcttctggactcaagtacctggtcagcattcccacacagccccagtacctaccttggatcttccacagatccatttgggccaaaaagccatgccaaccttggagccttcataagactcacggcaagcctgggctttgggcactctctagggctgaggcagctcaggtggacacaggctcagggaagacaacagtcagtgtgcttagaatccctggaacaccctctgaagaaggacaggcacaaacaaaaccagacttgcacagactaagataaatacagaggctctcaatgtgcacaaactgtcacatttccttgagtatcagaaacatttaggaaaatatgacctcatcaaatggacaaaataaggcactggaaaccaaccctaaaatgatggagatgtgtaatctttcagacaaaaaactgaaaatggctgtttcaaggaagttaaataaacttcaagaaaagacagagagccatttagaaatttatcagagaaattgaacagagaggttgaaataattttttaaaaatcaaacagaaatcctggagctgaaaaatacaatgaatgaaacaaaaaatgcactacaaagcatcaacagaagaattcagcaaacagatgaaagatcagtgagctcaaagagaaacgatttgaaaatacacagtaagaagagaaaaaaggaaaaagaatgaaagtaataaacagctcacaggatctatggaacaacataaaaacagcaaatattcaggttattggagttaaagtgggaactaagaaagacaaaggagcagaaagcttattcaaagaaataataacagaaaactttctaaacctggagaaatatataagtatctgggaaaagcaaggtaaaatgtcaccaatcagattcaacccaaataataccccaagacatattataatcaaactctcaaacaccaaagtcaaagataagaggctaagagcaataagagaagtgaagcaaatgatagaaggggcatccatatgcctggcagcagacttcttagtagaaactataaaggccagaagagagtgggacaatatatttagagtgctgaggaaaacaaacaaaaatactgtaacaaccaaaaatactgtatccagcaaagttatccttcagaaatggagagatgaaagactgccaaacaaaagcagagggaatttattgttactagacctgtcccaaaagaaatgctaaagagagttcttcatactaaaagataagaatactgcatgatatactaatactgcaatcatgatgtttaaatcacttttatctttagtaagacaaaactattaaaaatagtaactgcaacaatttgctaagagattggcaatacaaaaatgtaaattgtggccaggcgcagtggctcacatctgtaatcccagcatcctgggaggccgaggtggatggatcacttgaggtcaggagttcaagaccagcctggtcaacatggcaaaaccccgtctctactaaaattacaaaaattcatcggttgtggtggtgcgcacctgtagtcccagctacttgggagtcttaggcagaagaatcgcttggaaggcagaggtggcagtgagccgagattgcaccactgcactccagcctaggcaataaagcaagactccatctcaaaaataaataaattgtaacatcaaaaattcaacatgttgggggaaagagagttaatgtgtataggtttttattttggtttttcctttttctgtaatcaaagttaagttggtatccatttcaaataagttgttatatctataggatgttttctgtaagccttgaggtaactgcaaagcaaaaatccgtaacagatacactaaaaataaaaagcaacaagttaaaatatactaccagataaaaatcagttaatcacataaaaaggaatgaaaaaaggatgcgaggagttacacaactagaaaacaagcaacaaaatggcagtagtaaggccttacctatcaataataacagtgaatgtaaatggactacactctccagttagaaaacagagtggctcactgaattaaaatataacacccaagtatatgctgcctataggaaactcacctcatctataaagatacacataaactgcaagtgaaggaatagaaaaagatattccatggaaatgaaaaccaaaaaaagaacagaagtagctatacttatatcagataaaatagacttaagtcaaaaactaaaaagagacaacgaaggaaattatataatgataaaagagtcaattcagcaagagaatataacaacagtaaatatatatgcacccaacagctgagcacccagatatacaaagcaaatattaacaaatctaaagggagacagactgcaatacataatattgggggatttcaacaacctacttttggcaatggacagatcatctaggtacaaaatcaacaaagacacattaaagttaaactctaccctagaccaaatggacctaagacaaatttacagaatgtgtcatcagactgctgcagaatacactttttctcatcagcacatggaatattctccaggatagaccatatgttaggccacaaagtctcaacaaattcaaaaaagtatcaatcatatcaagtgtctactctgaccaaaacagaataaaaatagcaatcaataacaagaggagctttggaagctgtacaaatacatggaaattatacacaacgctcctgaatgaccaaagagttaaaaaaaaaaaaaaaggaccaaatttttaaaatttatggaaacaaataaaaatggaaacatgaacatagctatgttcatttgtttacctttgtctatgactgccttttgtactacaacagcaaacttgagtaaatgcagaagttcaaatttactatctggctctttacaggaaaagcttgctgatccctgacttagatttgaagcacaaatgaatttcacatatataatattgaataaaagaagtcagcacaaaagaatatatataattccactgatataaaattcaaaacaaagaaaattaatcaaaggttttgggatgtattctaaaatggtaaaaccaaggaagtaattactataaaaagcacagtagggccaggtgtggtggctcatgtctgtaatcccagcactttgggaggccaaggcaggtggatcatgaggtcaggagatcaagaccatcttggctaacacagtgaaaccctgtctctactaaaaatacaaaaaattagccgggcgtggtagcatgcacctgtagtcccagctactcgggaggctgaggcaggagaatcgcttgaacccaggaggcggaagttgcagtgagccaagattgcaccactgaactccagcctggaccacagagtgagacttcgtctcaaaaaaacaaaaaacaaaaacaaaaacaaaaaagcgcagtagtgtttatgctagggccaagaggaagacatggagcggcaggaggagagattaggaagcagcacacagaatgggtctggaatgcttaacaatttttactttttgacacagatggtggttacttgggttttcagtttatgataatttattaaattgtacatgtatgttcaatatactccttggtttctgtattgtgtttcacaacaaaacaacttagataaataaaaataaaataatgaattactatattaataattgcatgtatgtaaaagggataaaacacaaacctacaatacaagttaacttcctcatatgctttcaactaagaaaacagcaaatgacctactgttggtgggcacgaggaactgactgtattattgagagatatatctgtactttgtgtgatttaaaagaaatttttagtgctaattttgattgtgtgaaatttctgccttaccagcatacattaaaatcaaacctctacctaagatgctactctattgtataatgctttgataaactttcttcctgtatctttattttctgtacaaaatttatccaataatctaaaatttatccaataatgtcaaagtaatttgcaaaacaaaataatcaaccaaaaaatgctattactgcagtctcttggagtttaagagataaagacccactaaaggaagggttccaaaagagcttagagttgaaagcccattttttccctggaaacccttgacacacctggtaaacccataggataagaacaaaggtttgaaaccaggcagatggctgctactggaggtcacagaaaccaccacacagggctataatgacaaaaagtagagatcaaaacatgcaacagttttgaaattctagaactgcataagatagaagtataccactaggttgaaaattctctgaaaagtagagcagaatttcctggagtatcaatttaaagccatgtaggtccatggacattatttataaacaactatagaggttccagatgatattgttttcctccaggaaaggcttatccttttttctgcaatacagacagattgggggctaggaatagtgaagaaacagagaggatagcctaagtcttaattaactgaagtcaagccaggacctggctcactcctggatgatagtaagatggagcagccctcaatctatctgcattgcagaaaaaaggataagccttttatggaagaaaacaataccatctggaacctctataattgtttataaataatgtctagtatttaatttaaaaattatgaggcatgtttaaagatagaatcatataactgaaaaaacaagagaaaaataaagcagatctatagtgatccttatgttggagacaggccttttaagtaacaataatttgtatatgttcaagatatcaaaggaaaaaatagattaaaatatggcatcatagaagatttctccagactactagaatgtgtaataaagaattaaatgcattttaaaactaaaaaatatagtaactgaaatcactaaatcaagggatggcttcatgtggagattgaacacagcaaaaaagaggtttagtgactagaagataacacaatagaaaatatacaaaataaagtacaaaaaaaaaatgaggggaaaacaaaacattgaaaaatcataatagaaatgttgggcatgaagaatataacacacatctgattggtatcccataaagaaaactcggcaaaagcaacaactgacaagataatgaacaatttttggttttacattttctgtggtttcattaaaatcttcaaagaaatcagaagataatttggctttttgggtctcttgtttttttgagacagggtctcgctctgtcacccaggctggagtgcaatggcacgatcacagctcactgcagtctcaaactcctgagctaaatcaatcctcccagatcagcctccgagtagctgggactgcgggcacgcaccaccacgcctggctacttttttcattttttgcagagatgaggcttcaccatattgcccaggctggtcctgaactcctgattcaagtgatccaccaaccttggcctcccaaagtgctgggattaacacatgtgaaccaccatgcccggccccagaagataatttgaaagtcaattttttctaaatcaagtacctaagagctaaggtggacatttcttggtgccatttttctgtttagcattgatatactatagaaagcacgatccttggtaaaatttaacagtatacataggaggtcaacaaacctggtaccagtcccccttttgttcacccataggatattttagtagttctaacctctgaatcagaaaaatgtcactttagtcagtttcatagagcaatcaagagaacaatatgataatgcatgttctcactggtatggtatacacaagctaactcagcagctctattttagactgagtatagtgttgtattttggggagatgagtaaacttatgattgatttataagtacttgcctgcctcatcgtggacctgtgagattcagtcttcatatctgttttcacattcctgtctccaccatgcccaatctaatttcttgtttgcgtattgtgcagtatgctccgttttggttatttaactccttaatccagttgtatgtgtccttccatatgtcattaaagtaacagagtcatttagctttccttttcagtgatgtctgaatcatactggcactgatattataattgttctcattttcattatctaatcttagaaaacacggtcacaatatttataatgttaaaaattaacaccatctgttacaaagcacaacaggcaggcaaagtcgaagacttactgctcgcaattgcaatgtacttatattgcacacttaaatcacatcttttggtgtgatccaacaatgtatgacccattattgtggatccttggtggttagaatcagcactcatgagaaaaaaacagcaacagccactagggacagcagataaactattccaaatcattttctaaaacttgaaagctgttgcttccagcccttacttttttaggcttatactttcccatgaactttgcacatccattactgagaagcaagatttttttttcctgggatgccaaactttcagtacaaaaatcaggactgtctcaagcaaacaatgacggttggtcaccccaaatccatattgtgctttctacatccttttccaaacttctcaactgaacccatcctctcttgatccaatttgttcctttagaccacagtgtcaaccccccttgacctcagcaatttaccctcttgaccaccctaacctcaatctctcaacccatgcaaccactatcagcctcaaacaatcttatcctttcaatcctgaagaacaaaactcaacctcttaactcctctcaacattacctcatcctctctacctaactggaactcaacctcacccaaacactgactcttgatcacctgagtttgacttttcaacatcatcaaccaacctcggcctctaaatgtcataagccttgtcttctgatccttctcacctcaaccatgtcctctcatcttcctcctacagaccttaaccatcctccttcttttaacctcattcccttgacttcaactgaccttgtcctcacaacttcaatcaacctcattctcttaaccttacctaatcttgttccgtttactttgactccatttcctaaacctcatctggtagctcaacctcccctgttctccttaactgggtgatatggtttggctgtgtctgtacccaaatcttatcttgaattgtagttcccatgtgtcatgggagggacctggtgggaagtaatcaaatcatggacgtggtttcccccatgctagtctcatgatagtaagttctcacaagatctgacggttttataagggatttccccctttgttaggctctcatttctctctcctgccgccatgtgaagaaggtcatgtttgcttccccttctgccatgactaagtttcctgaggcctccccagtcttgtgaaactgtaagtcaattaaacctcttttctgtataaattacccagtcttgagtaggtctttattagcagtgtgaaaacagactaatacactgggttattggcaccaccatttacctagtcctcaaaaccaaaaccttgagacatcttagatttattcatatttttgtattacatacattagtcatcaaatactatcaatttgctgctaaaattattgctggaactcattaatttctctttatcatcgttgcaaatattttatttcaggttccattattgttcatctatgctactgccccagaatcctaacagatctctttacttccaacctaaacaatattttctcttctctcttgctcccccaatacccatccacctgtactccactgccagagagttagttctaaaatgaaacactgaccatgtgcccaataatccctctaccttatagaatataagtcatttctatcatttagctaattcctactcattcttaaagcctaattcaaaggctaatgcctttagaaaactttctctgattctccttttccaagttaaaactatacacctctccttgaacgtctagtaatggcattttactggcattgctatattatatgtctgggtacatttttttaattagctgtcttccagcctcaattataaactttataagtactagtttctgaatactttacttgcagcatctaacaagtattaacacatgaccactattcaattatttttcaaatatatacttattttctcccttccaaatgtcatatactaccataattttcatcttaaagggaaaaagaaaaaaattccttgataaaataattgggatgctaactgaaagcttttaacacagttaaattgaaagttgctaactgaaaattaagtaaaattcctcattaaataaaattgttctaatccttcatagaaagtacacatttttttaaatttaaaatttaccctaatacctactgtccttaaaactagctgatgttggtttctctaaaaccataaaattaactgaggaaactgaataggactttatactctacttttctatcaatattactgaggtctgctaataaaatacatatattacttgagaaaaaaactacaaatatcagatatgtgccataaacaaaagctatgtacttctgaatgaaaaaaccagagttcttatgtgtcctgaatttcacaattgtgtgattagagggtgagaatcctagctctacccctaagtagccatgtgaccttagccaacttagataagctttatttttcttcagttttttcaagtaaagacccactatagttaatgtatagaccccctcagtttcctcacctgtaaaataaagacgataacatatagccccaacttgcaatgtttcaacgtacgtttcttttactttacgatccatttaatcagatattaaatgcattttttacttatgatattttcaatttacaatgagtttagcaagacataaccccattataagtcaaggatcatctgtgtgtgtgtgagtgtgtgtgtgtatgaactaatatagtcctactacaaagtagatactataaatgtagctgtctttatttatactgaaaaatagttttccttttagtaacagttattaaagatacatatcaatatactttatacaattactgatattaatattaaattaagagaaataaaataaagcaaaattattgacctctgttttttaatcccttctaaattctaaaaacagctacatcagatcatattttgtgggagaatgctaacaacattgcaaatttcctaatgaaataagaaagattactagactgggcacagtggctcacacctgtaatcccaacactttggaaggccaaggcgggtggatcatttgaggtcaggagttcaagaccagcctggccaacatagtgaaaccccatctctactaaaaatacaaaaattagccgggtggtagtggcgcacacctgtaatctcagctactcgggaggctgagacaagagaattgcttgagcctgggaggcagaggttgcagtgaaccaggataggccactgcactccagtctgagcgacagagtgagaccccgtggcaaaagaaaaaaagaaagattacgaaattagttacatttcatgattcactgccatgtgatcactaatgttattttaaagaaaaaaacaaagatcacatcttagtgttgaaaagcaagacaaactcagactacttagtatactgagtatacaattctcctaaaccagaacatacatatagacagacacatgtcaaactctaattatatttcttactttactcttcacagcatcatatcggatttgagaaaactcacgaagaccaaaagaacctccaacaatcagcaactaaaacaaagaaaggaaacatttaagcaaaacagaagaccagaattcaaattcagcctatctatagattgcttttctaaacaacaatagaggcacattatacaaaaattctatagattatttttcctggtgagtcaccattcatcttttagagtaaatgcagtatatactggctaggaaatcattatagcacatcattaccaaataccaaaatcgtcaccctatacctgtatttgaccttatgatttaaatgacatcataacaagcattgtattatctgactcttacaatagacctatttttgttttttgctaagaaaaaaacaaaaacaaaaacaaattcaacaaatgaggaaataaaagcacagccagctaaatgacttgtccattgttaacttaaattttgcccagggatgtctctgtaattccattgctatgcgatcttccttagtaagtaatgaaattgaaacctgatcaactgatcagaccatgtccaaataaggcagatgcctagctataaccaaccaagctatttctgtacttcactttcctgttttgtctatactcattgcccatattgcagaatggagctctctcaacttctggttctgagtgctgcctgattcatgaattttctttgttcaaataaactctataacattattgtttttttgtttaaggttttccttcttttcgtactatgattacacaaggtaaacccagcagtaaaacttgccattttttccttcaagaccagaattcttttgattttatgatttttcaaaataaggcaattggagttctcattaccttaccaagtgataaagaaatctcatgaaaacttgctgcagaatattctgtatatcacattgtattcccagggacaatatggctatacaggtcacaggtaaagaaagtcttcaaattcttactatatagtgaaattctgaaacatcatcttaagatatacagaatcactttcatgtttttgctggcacctatttgaggcacagtattttcaaaagatttaaacttcataataaagaattgtaaccaccgaatgggttcaccttgcgtgctacctagacagagctgatttatcaagacaggggaattacaatggggaataacaatggggaattgcagagccagctgtgtggaaaccggagttttattattactcaaatcagtctccccgagcattcagggatcagagtttttagataatttggtgggtaggggcttgggaagtggggagtgtgctgattggtcagtttggagttggactcatagggggcaaagtgagctttccttgctgttttctgtcactgggtgggatggcagaactggttgagcccaattacccgtctgggtaatgtcagctgatccatccagtgcagggtctgcaaaatatctcaagaactgatgttaggttttacaatagcgatgttatccccaggagcaatttgggaggttcaggctcttggagccagaggctgcatgacccataaactgtaatttctaatcttgtagctaatttgttggtcctgcaaaggcagactggtccccaggcaagaagggagtctttttgggaaagggctattatcaattttgtttcagagtcaaaccatgaactgaattccttcccatagttcggcctatgcccaggaatgaacaagggcagcttacaggttagaagcaagatggagtcagttaggtctgatttctttcattgtcataatttcctcagttataattttgcaaaggcggtttcagtattgctacaaaagttaatgaccacaaggagaaactcactcaccattacttattgtgtgtcgctcttataaaacaagcttagaatggactttggatttcagaagacacctgtagatttccctgacatctcagagcagggatgaatagtgtaagattctccctgggacctgaaagcttaaggagatgaacaactcatcccttctcaggcccagtcccaaggcacaaggctacttgtaccagcagtgtgcaccagcaagatagcagaagcaggaagagagccggccggaaaatacgtacccctgaagattgagaaagaggccatccaggtacaacagagcaattatgtcagactaggacacttcctgtttacaggagactataaaacctttgtcccatcctcacttggggctgatgccattttaggcctcagcccacctgcacccacgcgctcatcaaaacagcatgttgctcctcaccacctcatgttgtctgttggtgcgctctcagggttccaaccgatacaagaaccgtacatctggtgctgaaacccgggagaggttctggtccacgtcccctgtgaacctacccctccaccccagacagcaggccacagcagccagacaaaggaagctcctcgatctccagttgcctctctgtgcatgcacattggtcactgatcttgcttactggtaagtttcctcaggggcccagttagcagggaaaattcacacggcctctcttagtttctctggtccgaatatccagtgttggtccaagaaggcgccggcgtgtgccaggcactcgctgatcatctggtcttagggggatgcctctaagccatttgatcgtgttccaggaacgaaaaaggcagcggtgacagttgctccttttatcatctccctccaggatggtctcctttttccctgttctcctgagcctaccctctgttatgggaaactccggtcctccattccaaacaacagccctctaggctgcttcataaaaaacctgcaaaccttaggcctcaggcaagatattcgctctaagtacctgtcttttttgcaatacagcctggccacagtacaaattaaataatgggtccaaatggcctgcaaatagaacattcaactttacaattttaactgacttaagcaattattgccgacgactggaaaaatgggaagaaattccttatgtccaggcctttttgcactcagttcacaacccaacctctgcaattcttgcttacctgttcaaatccttcccctccattctcaccgccctgatcgcctttctcctcccgaccctacctcatttttctcgttcgatccaactgactgctatccacccctcccaacccctaccttttcctctcaaccatcttttttaaccccccaagcctcctcgttgtcttctcagctgccatcttcccagctgccatcttcccagtcagctgtatccacttcttttcctacaccatcccctcctcgggacaattctagtattgcctgtacccattctcctcccccactgccctctcctaaagcttgtaaactcatcccgccaccttacgcccctgcctatcctccactgcctgttaaccctccttcccccttcaaaccctcagaacgaaccattatcttaaaccttcggttcatctcccaatccacccccgatattcggtgcaagcttcagaagcttgatgatggccctcaaacctcacaagaccgtcttaatttagccttcatagtctttaacaatcgtgatagggaaagtaaaaggcaaaaacaggcggagtttcaaatgcttgcctccgccatcaggggccctgcaggcccacgggtccgcagctccacacggaagcctcctagcaacctacctccacttggcaccttttcaagtgcggcaatgaaggccactggtccagacaatgcccaaatccaggtaagcccaccaggccatgccccctctgcagaggaccccaatggaaattggactgtgagcggcccctgcaagggcggccccatcacttcctaagccggccaaaacctcctacttggatctcattggccttgccgctgaagattgatggtgccctggaatggatgccccggcaactaccatcgcttcatccgagccaagggtaaccctgatggtggcaggtaggccagtattttttttttaattaataccgggcaaactactctgctttacctaatttttcaggacacacccagtcctcccttttctccgttgtgggaattgacagacaagactccaaaccctgagccacccctccacttttctgctccctgcacaccttttccttcagtcaccctttcttagtcctgccctcataccagagacatcctttcaaaactccacactactctccacttgcacattccccatagtacccaacgcatcaacccagacccctcggggcatctaactttcttctactcctccaacctgccaccttaaaacatgcaactttaccttatcccccatccgtagttaaccccgctgtttagaatatttccacaccttcagtcgcaaaacaccacacccccgtccgcattacccttaaagagtccacccagttcctatcacagaagcagtatcccatcccccaagcagctctcataggcctaaagcctatcatttctcgccgcctcaccagtcacctactccacccaagaaactctccttttaacacaccagttctacctgtttaaaagccagatggaacttatcacttagtccaggacctcaggctcattaaccaagctgtactcccagtatgtccagtagttcctaacccatatactttactttctgcaattccctccaataccacccattttcctgttctatacctaaaggatgcttttttccacaattcctttacaccctgattcccaaaacctctttgcctttacatgggaaaaccccgacacccacctttcacatcagctcacctggtgcgtactacctcaaggtttcagagacagcccccatctttttggacaggcccttgctcatgacctctgtaccttatccctaaaaccgtccactctccttcaatgtgttaatgatctgctcctgtgtagcccctctcaaagagactgcaacgcccatgctatctctctcttttaaacttcttggcagaacggaggtatcgggtctcccctaagaaagcacaaatatgagcccccttagtcacttatctaggcctggctcttaccccatgaacccgagggctcacaaccgaccacatatccctcctccagtctctcccacctctgcaaactaagcaagaaattctctttcctaggactagtgggatatgttaggctctgggttccctcctttgctctacttgccaaaccattataccaagacactaaaggccctctccatgagccttcaaaccctgcatagcctattacccaacctttccatctactccagaagactctcatctcagcccccatcctcactctcccagacctcaccaaacctttctccctctataccaacgaacgtgtagagttgcactaggtgttctaacccagtctaagagacccaccctccaggttatcgcctacctctccaaacagcttgaagccacagttctcagatggtctgcctgcctccaagcactggaggcagctgctgtcttcatccttgaaagcctaaaactatctctccatgccaacctaacagtttattcaacccataatatcaaagacatgctagctcaccacagtgtactaagtctcatctctgccccacggctcctccaactgtatgctctgttcatagaaaccccccaaatcaccgtgctaaccagctctcatgtaaaccctgccatgctctttcctgaagctacaaccgcccaataccctacacacttctgtgtgaacactgttcaaacctttcttacaccttttccaaacctaacagcccaaccccttccagatgcctcctttacttggtttgtagatggcagctccttcctatgtcaaggatgccggcatgctggctatgatatagtgtcaccccctcacacacactactgaagccaatccgctcccccaggcaccacctcccaaaaagctgaatgcactgctctcactcaagatctcactctagtaaccagacaacaaattaacatatattcagattctcattatgcgttccatatagtacactcacactcgtctatgtggaaagaacaaggttttttaactgcaaaaaacactcctgtcataaatggctctcttaccagcaagctccttcaagctgccagactcccgcagaaagctgccttcattcattgcaggggccaccaaacccgggacaatcctatatcggctggaaatgcgctagcagatcaggtagccaaacaagtagccctgcaacccatgcaaggccagtttctgtccctgtccttgttctctcctctttactcctcagaagaaaaggaggacttctgagcccaaaaccttcaaaagcaaggaccatggtatgtcaaggaaaggcacttcattcttcctcactctcaaagccttcctcatctccaaagcctccccaacactttccatgttggttacaaattctcttgcaacttctccgccctgttctcacttgtcctcacctttccagctatgttcaagatattacccagtcctgctctatctgccactcagtgtcaccccagggctccctccggccaccgccttttcctacccaccaagcccggggccagatacccaggcacgattggcaagtaaacttcactcacatgccgcccaataaacagctccgctatcttctagtcttggtctgtaccttctccaggtaagcagaagtgttcccaacaacttcagaaggtgcaaatgtcacacaaactctcatcatgcatataattccccatttcggcctcccaacatccatccagtccgatacaggcccaccttaatcagccaaattatccaaggcgtctctacgtccttaagaataaagtaggttctccacacaccctacaggcctcaatcttcaggcaaagttgaaaaaatgaactctgtccttaaagcccaactcaccaagctggctctaaaaacccagcagttgtggacaaaaaaaatctcccttttgccctcataaggctctgcgcaacaccaaaagcaccctctttttatagtccctttgcaatcatgtatggctgaacttttgtcttggggcctccacccttaccagactctgagcccttcaggaattaccttccctccttaatccagacagggtctttcatttgtgaagcagcaaatgaggccatgcctctccctgtccacaccgccttgtcctctcaacataactgtcttgcaggcacagatgtgtttccagacaatccagatgatgctcctgatacaacgacatggtggacaccagcccgtctctcaagaatacccaaaaaattaaggttttctttttccaaggtgcccacgccacccctatgtcacgcctgaagtagttattgagaaagtcatcccttttcccttttctataaccaaatagacaggaatgtaagattctccccggggcctgaaagcttaaggagatgaaagaaaaactcttcccttctcaggcccagtcccaaggctcaaggctacttgcgccagcagggtgcgccaggaagatagcagaagcaggaagagagccggccggaagacacacccctgaagacccagaaagaggccaatccagttacaacttagcaattacgtcagactaggacacttcctgtttacaggagactgtaaaactttcgtcccgtcctcacttggggttgacgccattttaggcctcagcccgcctgcacccaggcgctcattaaaacagcatgttgctccataccgcctcagtgttgtacattggcgcgctctcggggttcaaaccaatacaagaaccttacaaatagtcagctgggtcacctctcacctcatattgaagcaatacagcagtgacagctaactaagagttatcttctcctatgcaaagaaaacatatttacaatactgtcattgcatttataaatgtattctctaaaaacaacaacacacaaatgattttgtccaacttacacctaactatacgtgtttagtagaataacaattttaatgtttaatattttactttctgttctcctatcattttcccctaataagaaatataatttgagtacaattaaaaatgaacaaacaatagttcatccaattcatttggttaattcatctttttgtgcttttaggtcaatttgctatcttcagtgctgcaatgtattacaaaggtttatgttgtggaactttgttaataccaaatgctgtatctcaaagcagctaactgaaaacttctatagactggacttcaaatatttttgcatcagcctaactgtggaatttacacaactcagaaaaagcagacatacctgacattttgctgatttaacaaaagaagaaaataatattttcaaaagcttagcccttctactaaatgactgaagccattcttcaaggggggatgaaaggggtagggagccctcattagggtagtattttgcctgaactcaaagggtacaatttctatcttatttatgtctttccccccaatataaccactgtttccaacttattggttgtccttcaaaaaatcatcaatccatgtataagcacagacattttaaacataccacactctccctttaatacaaacggagacataatatgcatcgtgcttaccatcttgcacactgcattaatattttattaataaatacacacaaaagtgtatataaagcattaatttagagataataattgtaacataaactacaatgcattaactacccagtttaacaaatagaatactgccaacacatataccccttgcagataaaagggtaaccttcctctctttaccgttaacacaaaagctagattttattgcattcacttcttgattttcttctttactttaccatctatatataataactaaattctataattaagccttttctgtttttgaattttattaaaactattctttggtgtaactttttttagtgagaaattatgtattttagattaaagtatattgtatgcagctatagttaattttctttgctatatggtattccattataaaaacagaacacagtttatttactcattctcttgtttgatagttgaatgatttctggaataatgtcacagcttcaaggttttgttggtattcttaatttcaaaattataaaagtttatgttttatagtgttttataccttttaatatttaatcatttaattggtaatacaagtatatttatataaaaaggaaggtagggatcaaactttatttttttgcaaatggctagaactttcagcttcagaatgagggattaaagctaattagatttttggatgacatgataaagcagcaatgacaatttggggatcttttaagattactgcatactgggaagtgtggtaaatttcatgtgatttcttttttcttttgaaaaacctggcaatatttatttaagaagtgaagatgtcatttatttgacccaggaattgatacttacgtgtagtatataatactggtctgtacttttttatttatttatttattttttgagaccaagtctccctctgttgcctgggctagagtgcagaggagcgatctcggctcactgcaacctccgcttcccaggttcaagcaattctcctgcctcagcctcccgagtagctgggattacaagcatccactgccatacccagctaatttttgtattttcactagatacggggtttcaccatgttgcccaggctggtcttgaactcctgggctcaagtgatccacccgcctcagcctcccaaagtgctgggattacaggcatgagccaccacacccagtggagatctttttatatttgtatgtgtgtcatacatatgatatttttataactacatgttatataattatatatatgtaaacataatgcatattacatacattatttatgtgcactactcactcatacattttctaacacaaatatatttctttttttttcttttttttttttttttttgagacagagtctcgctctgtcactcaggctggagtgcagtggcgcgatctcggctcactgcaacctctgcctcccgggttcaagagatcctcctgcctcagcctcccaactacatttgtttttgtacacatatactggagaaaaaatatccagtaatggaatttctgggtcagataaatgacatcttcacttcttaagtaaatactgccacttttttctaaagaaaaaaagaaatctcatgaaatttaccacacttctcagtatgtggtaaccttaaaagatccccaagttgtcattgctactttatcatgtcatccaaaaatctaattagtttcatgcctgtaatcccagcactttgggaggccaaggcgggagaatcacgaggtcaggagttcaagaccagcctggccaatacggtgaaaccccatctctcctaaaaatacataaagtagccgggtgtggtggcacgcacctgtagtcccagctgttcgggaggctgaggcaggagaatcgcttgaatctgggaggtggaggttgcagtgagccaagactgcgccactgtactccagcctggtgacagagtgagactctgtcaaaaaaaaaaaaagaaagaaaaagaaaaaaaatctaattagctttaatccatcattctgaagctgaaagatgtagccatttggaaaaaaataaagtttgatccctacctttcttttaatttaatttatatataattttatatatatatacatacacatatatatacacacacatatacacacatatatatacacacatatataaatatatatatatacatacacacacacatagagatagatagatagatagatatacacatatttttttgtgtgtggcagagtcttgcattgtcacccaggctggagtgcagtggtgtgacctcagctcactgcaacctccacctcccaggctcaagtaattctcccgtctcagtctcctgagtagctgggaccacaggcgcctgccaccacactcgactaattttttatattttcagtagagacagggtttcaccatattggccaggatggtctcaaactcctgaccttgtgatccacctgcctcagcctcccaaagtgctgggattacaggcgtgagccactgcgcccggcccctaccttccttttttttataaatatatttatataccaattaaagaattaaatattaaaaggtataaaacataaatgtttataattttgaagttgagaataccaacaaaaccttgaggttatgaatttcattttttttcccatcagaagattttatcatcagaggctataaatttcaaaaccaagtatatgtgaccacataaaaatttaaaacttctgggtgggtatggtagcttatccctgtaatcccaactacgccggaggctgaggtgggagaatcacttgaggccaggagtttaagaccagcctgggcaacacagcaagacctcctctcttaaaaaaacaacaataataataataaataaaacttctatgctgacaaataaatgaaataaaaacaacataaaatcaaaagagaacaaatcagaaaaaatatctgttatagataagcagctaatacctgcaatgtcaaaatgtaagatttgtatacgcaaaataacttttgtttcagtttcaatgaaaagatacaggcaggccatgctgaaaagtccagccatgtgactagagggctggggctttgagctatgtgatatcaacccaacctccaaacctcaagggagaagaggagagctggagacagttcagtcacatggccaatggttcaatcacccatgcctatataatgaaaccccagtaaaaattctggacagtgaaacttggttgaactccctggttggtaaacacatcaatgtgcaaggagggtgacatgccctgatcccatggggacagaacacagaagctctgcatgcaggaccctcctggacctcgacatatgagtctctttttttggctgttcctaatttatatcctttataataacactgtaatcataagtatagtattctcctgagttctatgagtagttctactaaattattgaacctgagggggtggcttaaacctggggttatgcctggtgtaggaagttaggggagttttgtgcaggactatgcatagagtgtgtgtgtgcgtgtgtgtgtgtgtgtgtgtggtgtttgaattgcactgcaacacttactgcctgttaccatagaatccacactcctaactaaatatcttcatttatctccaatcttctcttatctactgaaggacactgattcatcaattctctcctttcctgtatcatcaaaatcttgctcaccactgcaggatccagcataaaaatgctattatttctcctatcttattaacaaactttcctggacaccactttcccaccagataccaacctctttctttgttcctatatgcagaaaaatttctcaaatgagttgcctatactagctgctcttcctactctctcttagatccattccaaccatcaatgacatccacattactaaatctggtgatttacttattttcatctgatttcatgaataaaatttcatacaattgatcacactctcctcctcttccctcatatctggtttttcttttgccacagagtcactctttcttagtctccttgattgtttcctcctgtatacctcaactctccaatgttggcatacctcagggcacaatgttttctcttcttctctattcacttattttgtaatcttaatcaatcttatggctttaaaagcatatgttgattacaacattccatacagacatgatcaagcacgaatcccagtaccaccgggtgaacaaagcagaccagattagtactgcaaaatctggaacctaagttccaggaaagggagcccaaaatattatagtaggctactgcctacaagttaaacatgacgacatcctgctaaactagaagacttaaataggatatcatttcctaatatttaaaatgttcaagatataatacaaattccattgtcatgacaagaaccaggaaaataactttactcaagtttggatatttgaccctccaaacctcctgttgaaatctgacccccaatgttggagggaaggcctagtgggaggtgtttgggtcatggggacagatccctcacgaaaggcttgaggctgtccttgtggtaatgagtgagttctcactctattagttcccttgagagctggttgtcaaaaagagcctgccacctccctcccctctctcttggcatgtgatctctgcacatgctggctcccttttgccttctgccacaagtggaagcagcttgaggcccgcaccagaagcagatgctgtgccgtgcttcacagtatgtacagcctgcagaaccatgagccaaaagaaaattctttcctttataaattacccagcctctagtattcctttatagcaacagtggtccccaaactttctggcaccagggaccagtttcatggcagaccatttttccacagatggtggcgggggtggggggtgggatggcagtttggggatgaaactgttccactttagatcatcagacattagatctcataaggagcatgcaacctagatccctcacatgtgcagttcacaataggactcgtgctcctatgagaatctaatgccacctctgatctgacaggaggtggagctcaggcaataatgcccactcacctactgctcacctcctactgtgcagcccagttcctaacaggccacaaaccagtaccagtccgtggcccaggggttgaggacccctgctttctagcaacacaaatggactaagacaaacttgaattttaaaaaggctatggagagatgctaacacagagataaatcagagattagaattatctgacaaagatgacgaagacctcaaaggaaacatcataaaaatacttcaaacaacaacagattttcttgaaacaaatggaaaattagaaaatctcgccaaagacatagaagatataaagaagaaccaaagggtgatatcagtgacatggtggagtatctccaaaaatcctttcctccacaaaaacgagaatatttgtaaaaaattgtcaaataaacttttttagaactctgaaaattaagcaaaaacttgcaacaatgtgcacagtatttacctaagaaaaatgcctgaatctcaggaagaacagcttggtggcatttttaatttgtcatattctcacccctccacccaagctccgtaacaaccatgaaaaccaacagcctgcaaacatgatgtaaagcctggcaccaagtgaagagggtagagaggttggagctctttaaaacaccattctgtgagaaatgtcatcatttcaccagtctggtacttcctggaagatgctattcacaaagctctctgtagtttacctgacatggagctcaactagtatgaacagacttctcctaggaagcgtttgtcaaaaaaaaaaaaaaaaaaaaaaaaaaaaaaaaattcagaggtaattgtttaacattatgactgtctgatgtggtagataataggaataaggtgtccttagaggactctgaaaagctcaaatatattcctgagaatttagaaagtcatgcaaataactagaactgtgtacatgcccagagcaatgtatatgcccaagaaagacctgagaaggccctaaattctcaacttatgactaatttgaagctctgagcaagtaagaagtgaaggctatacatggagctgtaaattgcatggctgaatgttgaaagcatgcccaaaaaagcatgcagagcctctcgacaaagactggcagatttgttggttttgggttttaaagaaacctctgtccaataaaaggaaacatagtccaattaaaaaatgggcaaaggatttgaacagacatttctccaaaaagatattcaaatgaccaataaacatttgaaaagatgctcaacataataagtcgttagggaaatgaaaatcaaaaccacaatgaggtatcacttcacacctactagaaagggtaataattcaaaagatggacaataacaagtgttggcaaggatgtggagaaattgaaaatcatatcttgctggtgggaatgtaaaatgatgcagccactttggaaaacatctggcacatcctaaaaagttgaagagttaccatatgacctagcaattccacgtctaggtatattccctacctgagagaaatgaaaacatacttccacacaaagcgtgtacataaatgttcatagcagcattattcataatagtcaaaaattgaaacaacccaaatgttcatcaattgataaaatatatccaaacaatggaattatatccatcaaaaggaatgaagtattgatatatgttacaatgtgaatgaaccttaaaaacattctaagtggaagaatccagtcacaaaaaacccacgttgtattagtgtgttaatatgaaatgtgcagaataagcaaatttacgggtagaagtagattagtggtttaccaggccagcattaagaggcaggaagaaatgggaagtgactactattagttatgatgcttttttgggggcaatgaaaatgttctaaaattgtggtgatggctccataactaagaatatactaatatacgaatatattagtatactaatatcgaatttgctaaaaacaacaatttttttttttttttttttttttggagagacagaggtcttgctggtttggaactcctgacctaaagcgatcctcctgtcttggcttcccctaacactgggattacaggtgtgagccatcgtgcttggcccagatacttcaaatgggtgaatcttttggagattcctaaaatccacatttgatgaatgtggatttttcaaaactgtgtaaaatatccattacctttctaagatcacttctttcctttagtctgcttaaatggaaaagctggtaatttcatctgcgccaacattcatacaaaataaaaatatagtctgtatttaaaagcagcttttgttcatatgctttaattatttcatttactaacacatcaaggcttgctgaagcaaaataactggcccgtaatcaaaaagcaaataagagtcatctggatttcaactctggttgtcttaagccagcctcagcctgcatttcatgacatccttagggaactcagtgtggatatggatgaaaccatataaacacggaagctgttttcaacgtgctttagaaattataacacagcaatcattctggctacaatgtggcaggcaccgtactcaacactttattcacaaggtgttattagttcatcacaactctaagtattaagctaattcacaaactagaaagatgaaacagaaagataccaggaattcgtgcagttaaatggaatacatctagtcccaatgatccacagtatcgtcaaaacatagctaagttgggggcgaggaagcaagcttagtaatcatccaaacttggcttaaagtgtggttctgactgaattctctgagcttcaatttacttaactgtgaatcaagggtagtaacaatgaccgcgttcgacgatgggaaagacgccacgctcacaagcagacagatcctagtacacctgaaatccaaccgggagtgggggacagcggcggggaagtgggggtgtggaaaagactggtggaagagcttttaggaaagctctcaccccgtcgctagctccttcctagcccgagtgccagcccttaacttcacattttacagattccctcccaggtcttgatcctgccaaggaggagggtcccaccccttgcggaagatcctcctcactccactcaccaacatggggactccatagccgagagtcttgttcttgcgaaaagcacgcatcaccgcgggtgcaaacatgagtgaactcttccatcggctcagaactccaagcgggcctagcgcagactcccaaatctcagcagctcacgctctcaccaagacgagtacgtccttaactcacttccttttccttggttatttggtgctcggtccttagtgaatggtttccgctaggcaaaagcaatcgagccatcgtaacatacttgtgcgtccgcccagaaatgtgggcgtcagcgtttttggttccgtaacgtcggcgtgcaattgggatttagagatttgaatcggtttacgatcaccaccaaattgatctggaaaccagtacttcccacgttctgggtcctaactaacgtctgcttagaacactcccttaggcacatagccactcgataaaatcagctaaggaaaaaagtattttgaggccgggcgcggtggcctgggtgggtggcctgtaatcccagcactttgggaggccgaggccggtagatcacctgaggtcaggagttctagatcagcctggtcaacatggtaaaaccccgtctctattaaaaaaaaaaaatacaaaaattagccgggcgtggtggcaggcgcctgtaatcccagctactggggggccgaggcaggagaatcgcttgaacccgggaggcggaggttgcaatgagcagagatcgcgccatcgcactccagcctggggaacaagagcgagacttcgtctcaaaaagaaaaaagaaaaaaaagtattttgaagctggtactccagtctttatggctatttgtgggatgaggaatttgccagtttaatggagacttttaaaaataaatcgcttttgaaagattaggttgaaatgtaatcagtgtagtgtctcatcagtcattactgaacttttaatgctaatgattttactgtgagataacctgtaatctttagtcatttatgaatgtctatttaccaatgattcagcaaccatacaggccacctttcagcgtgtctttgaaagggttctaggaacacagataaaaatatatgatccttaccttaaagacactggcgatttcatgggcacagaaacaaacatgtgtgaagtactgggatagcttaggaagccgatcccccacgtgtcccatttaccagagtgaatcagagtgcaggtgatgcggaatattatcttccatgctattcctgaaatatttccatctgtccctgcctctctgttaccactgaaatgttcctttttttaattccttatcatcttttcacctattaaagtagcctcttaagtggtctccagaagagaagctccagatctactgcaggctactccagtgaaacttatccttttggctaagatcaagtgtagtatctgttcttaacagtttaatatttgacacattctctatccaaggaaaatatgttaaatgggtttttgaagcaaggagatggaataggagtttgctccaccactctacacatcaacctgtatttcaatacctccagaaacccaggaacggtgcatctctcccatcttatttacttccttttgatatttcaaaattcatgcagaccaggcatggtggctcatgcctgtaatacctgcagtttgggaggctgaggcaggaggatcatttgagcccaggagttcgagaccagcctgagcaacaaagcaagaccccatctttacaaataataataataataataaattagccaggcatggtggggtctcagctacttgggaagctgaggtgggaagatcacttgagcccaggaggtccaggctacagtgagccgtgatcatgccactgcactgcagcctgggtgacacagctagaccctgtttcaaaaataaataaataaatctcacgtggcatccaggttagttaagcgtatcacatctcctactttccctaagatcctagaagccaaaggcgctgctctaaaactctagcgttttcctacatcttcactacataaaacatcagcctactggatactactccatcaaaacccggcacctaagtagtagctaataatgggttaaatcgtatacatatattcaaaataatgctagagtcgataatcttacacttttcagataaggcatctatccaatttaaggcactctatgtctttagtatcttgtttgttcaatcactcaaataagcatttattgagaaccttgaaatggccctgaaggagtaactgtgaacagtaggaattacaggtatgccggcagattgtcaggggacaaaatctgtgacactgaggaatgtaagcacctatcaaatcatactacataggtggtaaattttaccagctatgcatagcgcccttcttaagcatcactactgtatacttcagtttttccatctgttaaatcggaatgagtgatatttgtcatcagtttacgattctcacaaaaagggaacacaaaatttcttaccagtatggaatctgttgccttcccagaaatatgactcaaattccatgtgtttccattgttaataaacagttaaaatgctgactcagctatcttaactgtaagaagttacaaaaaatgtatattcaggaaatggggcatctccaccatctatgccagtccctgaggactggtatgtacttgatatccaggcaggttatattatcctctagtatctgctctaccagcatttaactcatgcaagtacatgggagcgttgttataaaacaaaaacaaaaacaccagtcttcttgagagctttagtcctgaagttaggttttagaattatggccagaactggccagccacagtggctcatacctgtaatcccagcactttgggaggccgaggcgggcagatcacctgaggtcaggagtttgagaccagcctggccaacatggtgaaaccctgtctctactaaaactacaaaaattagccgggcatgaaggcgcatgactgtaatcccagctactcgggaggctgaggcaggagaatcacttgaactcgggaggtggaggctgcaatgagccgagatggtgccactgcactccagcctgggcaacagagcagaattatggccagaattcatggctatggtaatcgaaagattagttacttcatgaatctttgtttactttgataatgccattgaatctactaattgttttttttttttgagacaggttctgctatattgttcaggctggtcttgaactcctgggctcaaacaatcctcctgccttggcctcctaagtagctgggactacaggtgtgtgctaccatgcttggcttaccatctaatttgattcactcaaaaaccttatgataggggcagaacatgatgccagactcatcttataggttaacagactaaggctcagaaaagttaagaggcaaacacaaggtctcactttggaaggggtacaaatatcccaaacagaactaaatttcctgtagaattggacaatactgactatctccttgaaattctctcctcctgtggcttttatggaagtttcactgccatggctcctctccaatggtgagacttctttttgttgtcttcagacttacaaaccttaaactggagtccttagtcccattttttccctctgtctcagttactctcaaactttagtgtgcaccagaatccctgggagagcattaaaacagactgctgggccccatcaccagagtttcagatttagtagatcagggatggggcctgaaaatctgcccttctaacaagcttctgggtgatgctgctggtctgaggaccacactctgacaaccactgctccatcctctttccctaggtaaactccactttcacattggcttcaaattttatcacagcatggaagacttctggtacacttccaggagcctgaacgattttctaacacctcaaggtcaacatgccaccaaggtttattttaatccttttctccattcaatctaatttctatggctagaactagagtagctaagagttggtctagttcagtccaacttgaaaccagttaaaattgtccttgatattgttcagccagaaaatcaactgtttcttctttaatgcactttctcttatgatagtgatcatgaacattccaagtttagaattattgctgtatttgccttattactttttatggagtataagatatggggtaaacaggaccatgcctaatacatttctgttttccatgacttccttcatagtacaaaaccacaatgcataattttctggaaaaacaaatgaaatgacaggagcagccaggagtggtagctcacatctgtaatcccagaactttgagaggccaaggcgggaggatcacttgaacccaggagtttgagaccagcctgagcatcagagcaagaccctatcttaaaaaaataataataataaataaaacaaaccaacaaacaaaaacaaggaaatggcaggatcttcccatatcatgctatacagtgaaggatgaagaatacatggctcactgcagcctcaacttcccaggctcaagtgatcctcccacctcagcctcccgagtagctgggacaacaggtccatgtcagcacacctggcgttttttgttttttttttttcattttttgtagagacgaggtctcactatgttgcccaggctggtctcaaattcctgggcgcaagcagtcctcccaccttggcctcccaaagtgctgggatttcaggcatgagccaccatgcccggccagtaattctcaaaccaaacaaaaatctgctttgtaacactttggagagaatcaaaggtaactattccatacaaaagtgctagaggtctcttctatacagacagacaaaagaaaccgaaaggaattcaaagacaacggcaatgtcctaaagtacactattacttggattacaaatttcatcaggtagagcaaagcaggaactctagcctgctggttgtcacagggttaagccctatctgaaagctttctgtataaatattgttaattaactagggtttcctttttgggtaggtggatgggtgcttttgtaatataagtcagtggtgaaacaggattttatctattgaactttatgttaaaaaaaactttacagaaacacttatatttagaaatatgaagacaaatgtttgaattgagagcaagtgaagtgcacttttatctcaagataaacttcctggaaaggaaaccattaaaaaatgtcctgtctgtatgtgtgttttgtgttgttttaaatgcttgaataacatctattgtctaccactggttttaaaaaaaaaaaagattagtcaaataccattgtacacacaaagtttcctataaaacaaaacacaatgcacatccaatagaattggaacttgatgcctcaaaaatgaatctatttcctaaaataatcacttccaaatcaaacaacattttgaataacccccaaactgaggaggatatcaaaatagaacttatgttacatggcagttaataaaaaggaaaaaaacttcatatgaagtcctatgattgcacataactgaaaacaaatatccaacttatgaaaaggaaaagtacaacaaaaaaaagcccaaaaccaaaaacacaaacaaaggaaagcataacgagggaattaaccaaaataaaagctaaactaaaaaaataggaaacaagcaaaaatacaagaattgattagtaaaaccatcccaggtgatatcagcagaacaaatagtcaattgacagaatcttttaaaaaattattaatatgctttaagccacttaagttttgcagtggtttgttacataattggtaactgacacacctttgcctatcaagaaagaacatggccattctatacatactgtagactaccaatttgatttcaggcctgaactgcttaacatgggtgacggagcaatgatgaccaatgtaaactgccttttctcttcatatcaaagtcagctgtatgcaaactaacttagaataaaggtcaacaatattcagttctgacaagtcctttttcatgctgtggcacaaacccacttctgccttctatgtatcttataaggctttgggggatgaaggggatacaagtaagatggtaaatgttggcaactgcttgcaaacattgcgaataaatacacaatgatactgctactgctattatagaacatttaacctagtgcagtcaatttcctgttatccataatggaaggatatgatagcatggttgaatcaaattgagtatagtaaaccttaattttctagaatagtggaagggcagtggactcattggcttgaagtaaattcccaggtctggaactgactagttatgtatcttgagcaagttattaacttctttaagcatcaagttacctcccctataaaaatggaatattgacactgccttgcacagatatgagaatttggcattaagttatacaaaagggcagcctaatgcagtgcctggtaccatgggaagtagagacagtaaggtgttatagttatgaatgcaggttttgaagccagattgcctgggtttaaatcacagctttggcacttagtagctgtataacttgggcaagttacttaacctctctatgccttttatctataaaatgaagataacaacagcagttatcttaagagttgttttgaggcttaaataaatattatacatgcaaaggccttagaacaaaagctggaatattgataagagctccataattgttaacaggatatcaatgtcctgttccttatctcctatgtcaaagcctcaaactgatcatttagatttcttcctctttccacaattctgtcagaggtgttaccctaagaatatctagtacatagtaagcacttatcagatatttgctgaatgaaggaaaaaaccctcatctggaagaaaaaaaaatgagatatttaatcaacggtcttcaaaataaggtgaaaaaagattgtaaagattcaatgacaaagttttattaaataccaatactggctaggcacaattagacacattattatctcatttgctgtatctggtatcaaacaacaaagcctgaaagattaccatagattttgatggcctcattaacataattaatccgtagtgacattccctggataataaatacagttttatgtccgtgtgtcttctgtgtcttccaagttgctacagggctctatttgatctgagaaactgactgctgtttacatccaggtatgcaatgtgacattagaattgaagcagaaaggaagcaaaacaaaacagggttcatgaggaaaataatcttctaagaactaacatggcctggaggtaaaatgcaaatatatccggtaataagaagcccagattactgcagataaaagattaaaataggattcaattattcatctccatttgcaaatctacaaactaggaggaaggactaacccttttcctgggattagtaactaaatttaatgattacagcaaatataaagttcttttgtaaattattgttggttaaggattgacttgcattgacaacacactttagctctcgcccctttcattctccccctgcaagaacaaaggcaaaatgaacagtgaggaaaacctggaaacaggaccgagtgtttgctatcacttgattcctttgaaggagcaatgctttctcataatataggttttatagtatcatcaagtacatcagttaagcaaatcaagtgctttgtgttctgtatataaattacataatacaagagtctgtggcagttaagaatctggttctgcactttgggaggccgagatgggtggatcacgaggtcaggaattcaagaccagcctggccaagatgctgaaaccccgtgtctactaaaaatacaaaaattagccaggcgttgtggcacacacctgtaatcccaactactggggaggctgaggcaggagaatcgcttgaacccgggcggcagagattgcagtgagctgagatcgtgccactgcactccagcctaggcgacagagcaagactccgtctcaaaaaaaaaaaaaaaaaaaaaaaaaagaaaagaaaagaatctggttctgatcagaatccttaaaatactgtcttcttttttatcacaattgcccttttggatgtgagtgctggtctcaaaaagatttgcagttaaaagaggaacagcaaaaaagacttacaccaaaatagcaaccaactctaaaactattacaggtgagaggtagacagcttcataactcaatcttctactaccaggtgatgttaaaaaaatactttaacatcaaaatcacctacaaatattcctccactttcatatgctgagcaatttcagcttagagtgactaagtgttatttatctctctatcttcggcacctagcacatagtaggcagtcattagttatttgctgaatgaaggaaaaaaaccttcatctgaccaacgataaatttcactaaaattgactataataaaatctgtatgggctccacatgaaaactacatgaacttcacttccccacatacctgacagcctatacacttccttatgtttcatttctttaaatatactttaaaaattgcttatttacacaataaaaacaatgtccaccataaaaaaaaaagtctctagaactattggaattagtctcagaataactcatctgattggatttgatatgagatcattctcagattgttctgtggaatctcccaattccaataatgatgcttgcaatatcctttagctgtctatcagttctggtctttattcaggcccaaagagagaagaaagaagtagactaagataaaatgggtagtctgtgtattcatgtagtgaatatattcaagacataaatatgagacagaaaggtcacttctgcaacaaactaagtctgatcagagttaagttagcttccctctctgagcctttatttttctcatctctaagacagattcatcctagaagctctctggtcctttttagcttcaatgttctatgattggttctcatttaattgatgcaccaactgaaacactcactaatcatacattttgctggaggttgatcaatccttagcaaatcaggaagaaatgaatgttccacttacttcgtgcagaagctcaggaagctgggctctaaaggcccaagtttttgttgttgttgttgttgttgttgttttgcctgaagcaatgtatgtaatttaataatttaaatagtgtttaattaaatagtgtcttgtttaaatgctatataacattttcaactgcggctgcacaccagaatcactcaatgaactttattttactgctgcttgagtcccaccctcagaggttccttttaattgatctgtgtgcagcctgggcatggggacgtttataagctctccagatgattctaacctgagcaaagggaatgatgactggcatagagcaatgagtctcaaactttagcatgaatcagtcacctggaaggattacaaaaacacagattgtgagatgccacgctcagagtttttgattcactaggtctggaacttcttttttctcttctgggaacttgctttttgttttttgtttgtttgtttttttgtttttgagacaaggtctcactccgttgctcaggctagaatgaagtggagcaatcacggctcactgcacctcagtctcctgggctcaagcaatcctcccgtgtagctgggcctacaggaatgcaccactaatttgtttgacttttagtaaagacagggtttcaccacattgtgcaggctggtctcaaaactcctgagctcaagtgacccacctgcctaggcctcctagagtgctgggattacaggcatgagccaccatgcccagcctatgaacttgcttttctaacaagttccccagtaacgctgatgcttttgtcaggaccttgctttgagaaccacttccagtgagagaatatcattgatgctggcatctgaagtcctgagtttaaatcctgattctattattaccacctacataatcctagtcaagtaattttttctctcatttttagtctctttgtgacaatacttagatcccagagttatgagacatgaaataatgtaccaatcagagtttggtacagtccctggcatagaacacaataacaaatattaacttcctttttccattatacatggctagatggaacaattaagttaaatcgataacacataagttgaaacttcacaggaaaacaaagtacagctagttgaagcaaacaatatcttataattatacatgtaatacagaatgatagagaaatgttttaagtacttaaaaataccttcgttcaattttcaaaactttgaacgtaataatttaggtagtaggaacattagatgcaatctatagaagaaatattagactcaatctatgaagaacatgaatttttttacaacctataatggatcctgatacctcatctataattttagttttctatagaatcaataatataattagtgtacctgcttaaaactgtattacattgatcttcaatgctacttaatttctgagaaaacctaagttataagagtacatcagaatctctattatcaaccaaagcaaaacttctaccaacgacagaatggatactttttaaacaaatttacatataccaacaagcaaaaaactagagctttcattcctgcttgacatttttttcactttgtgtgtctcaaggctctctcaggaatcagtgtccaaaccatgaggtgaatcctgggaggtaagcaagcttgctgtagaagccgctgtacatgccttcaggaacagaaagggtaccagaggctgtgccctcctagtgtggctggttggagtgacaactagaatgttgtccgtgtttttctgtggaacctacaatgagtccagttgtctaagtgagtctcaaaggtattgaatagttgatgtcaaaaggcactttatgtcaggactgtttaaagcaagtttctccctataccagtagtgacccagaggcaaggtcttaccggacctcttattttcaaaagccttccctttccaattgagcctgatgccattatgtgacatctttttttccctgaatttctaaaagaaaatgtgatgattacctgcatatcttctttgttgctgcatcgtgttttgcatggtacccctttaatattgttttcaatacttagcctgctgatatacttttaacttctcacctgtttatgaattctcttaactaggctgtgaggcccttaagggtcttcaacttgtccctttcctccacgtaactttctcaaacgccccagttctcagtaacttttctcttttgctgtctgtaatataaacatgacccctacttacactgtcctacctatgtggccaataagagtgttgtcttcgcagttggaacccaaaagccctatgggatggaggatatgcactgtacttctttgtaaaagtgtcttgacaaagctgatgtccaatcaacatttaattaccagactgtccaagctagaaatgaaatacagttgattgcctgagtcctgataatcttgctaacaaaattataaaaggcctatagtatggccaatatatttggctaatggaaatgattttcttaaagccagaaaattcagctacccatagtgcttaaaaccagccttaaaagaacatgaacaggatggttcccaccttatcgagatcactggcattccatagtatccattcattcatatcctcctcctaggccgcatgaaacacctaccacatttccctacctcctaaagcaaacaaaactcttttcctccctcttgctgcaaaaaggtttattaaaagccgtatgtagtgtataaagcctttcaaaaatactagcaatccatgcctttctttttttgagatggagtcttgctctgtagcccaggctggagtgcagtggcgtgatcttggctcactgcaacctccgtctcccaggtcctggttcaaacagttctcctgcctcagcctcctgagtagctggaattacaggaacgcgccaccatgtccaggtaatttttgtattttcagtagacatggggtttcaccatgttggccaggctggtcttgaactcctgaccttgtgatctgcctgcctcggcctcccaaagtgctgagatgacaggtgtgagccgctgcacccggcctcattttaactaaatctgaagccagagttgatttgatgcccatcctgccagggaggcagttccttccctcaggtttgttagtagaaaccaaaaagtagcctgagagggttcaggtgccaccttggaggcactaccttatcttttgtccttttagagttttcttgctggggtgtttggctccagcactatagcccttaccacaatcattccacctggttcttcaataggactctgaggtatcaaaaaagtcactagggcagcccagagattggtacgatttacctttacacctcaaagttttttagatgtgagcagcgctggattatggcaatttaccttataataactcaccatagttggctgttataagaataaatattgttcttctaagatttttaattagttgcttcagttattacatttttttctattttttttttaaatagagatgaggttttgctatgttgcccaggctggtctcctggactcaagcaatctcccacttcaggctaccaaagtgctgggatttacaggcatgagccacctctcccagtctcagttattattttaataaatgagactgaacgtcctcttataaggctcactcccttgttcctactacatttgctctgtttaagtatctctttaaattcttcagttaagatcatcccttttatcagaaacctagacaccacaaagtagctttctcacctttaattctccatagggatcactattatactataatatttgcatacgtatgtgtatatatgtatttgcttttttaaaaaagtaaaaatgctcttctcactctttgtcgatataggcacccaggtacgtagttagaaattaaataaaggccacaataatttcccaaggaagatcattaaaaagaaaaatcctttcttcctctaatatcacatagctggcctttatggcatgccagctaagaaaaaaggtattgcctatggtgacaggaagactcaatctttctctctttgggttgtagctgaatttctatcaaaagtcctagtaaaatatataactcctcatttgttctaagccaagtcttttcttcagttttccttcaaacaatacctttactttcccattagaatatgaagaattggagactgtgaacagcaaggtttggggtgggtatcagtcacttcaaatctggctatgcagagagagggaaagacatggcagaatagcaggggtggagggtgagtgaaatgtatcttcattgggagtattgaaagagagcaagtttttcaaagttgttgccggtatctcatgaaagcccaggctgctaccatggtgagggcaaacactggcaccagcaccataaatatgggaataccacttgggtccccttcacctcgatgtcctataggtccattctgcacctgtaactggaagggaaagaaaaatgttaactctagtgactaatgtgtgtttgcaactgaaacgcccaggttgatacatcacctgggtttgtagactctagaccacccaaaactgtaacccccagcaatacctagcagaaggagtcctctctttgtcctgagctgatgcatcagtgtcacaggatctttggaaagaaaataggtctaatggggaggcatttaaccttgctgacctaaagggacccgtgagggcaagtcaggtaatttctgtttctgtactgcctctaccttgctatttgtgtatcgtatcaggaaaatgaagacatgagataaaacctatgatcttatagggaacttggatattacttggtgaggaagaagggggatctttctggaaatgtttacttagataatcagtcatcaaaatgtagtaagagcagatgtgggcaatgtcaacataggtgcaataccaacatacgtccaatgccattacttgaaaaatgctttccagatcccagaaggcacccaactccctccaaagatggggttttgcccttcatctgctcatttctaatactagagagagatgaaggtgaatctatatggaacagatgtaaaaaagcaaaaagaaattatatcctagtgcttataattttctattggctaagtgtttccttttgaggctggatggtcttcattttagtgatggttttcagggtagctcttcttaatatcaacttttagtggctaacttgcaataattatggcatcatcgtatttcagttaaactgcctcattacaactcataaaactgacacttcaatctgaaaggcaagactgcatgaaataccattataccctctattccacctctatgtttttcattcatttgctgatgagctgtcctgaaaggacatgctcaataagaaggcatggtttttagggctaggccaattgcctgaacataagggtcttttttattaggaattatttatggatgtttccttaaaagtgaacactggaaataacttctcacataccttccaaaagaattgtaatcatattgaagtgtgtccctatatttacttgtttttatctactgcacaaatgctcccatgctttagaaagagaagagccaaggcagaagcaactgatgaccaatattatctcttattaacctgttttctaatccattacacccagattctgcttgcaactggttgttttctcaggtatctttcacgttctgccttctctacttttttaggaactcctctaaatgttcttaagcttctaaatccttagccactgagtgaggaagagtgcacctatttaagaagtagcaaattgatttaatttaaaggcacatggaacctgttttgtgaatatgctcagaaattctcaatgctataggaggaattatatctacccaggcttccctttacatcatcatccaaattataaaacacttggaaataagaaacagatgcagggataggtgctgccttgactgaattctgaattccatttcctttttcctggagttctcctatgaacactaaagatttggttaagagggtcaccaagttgataaatgaagggttcatggcagtgacagggaaaagcatatagtgggtaccagaaaacccaccatctttgtagtgttttatccaatggttttataaataagttttcagcggtagacatatggttccttccctaccaaaaagtaaaattggctacgtttttttaccatctttttaattaattaatttatttattttccattggtccatgtcactcttaaaattttttatttatttttattattatttttttaagagatgaggtctctctatgttgcccaggctggtcttgaactcccgggctcaagcaatcataccaccttggcctcccaaagtgctaagagtacagatgtgagtcaccacacctggcttttctttaatcatctgttttaatttggttgtcaagctttatctttaaggcatattatcttgaagcaaggaccttggttataagccatactgttgtgaatttctcttttttttctctttttttcttttttttttttttgagacagggtctcactctcttgcccaggctggagtatagtggtatgatcttggctcactgcaacctctacctcctgggctcaagcaatcctcccaccttagcatcccaagtagctgagactacaggtgtgcaccaccgtgcctgaattttttgtatttttagtagagatgaggttttgctatgttggccaggctggtctcgaactcctggcctgaagtgatccgcccaccttggcctcccaaagtgttgggattacaggtgtgagccaccgtgcctggcctgaatgtccttcaatgataagcagaagtaccaatggacccctccctttgcctgagaaactcttcaggggagtgagggtaaaacaaaaagcaacactgaagattacacacattgggcttattcagaagtacagtgcaaaagcctggtgccaggtttctggctcaaagtgatacctaccctgtgctgcactctcagagacacagcatagcctgcattacgaaagaggtctacagcatcctggtgcagcaggttctttaggtcttggccatttacctgtcaaaacaccaaagagtagtaagaaaggaagaaggctattagaagtcaacaatttattttcaaatggccaaactttaaataacaaactccttcagagcaaattgcaaggactaggagtatgggcaaagttacttagagctcagaacttagaacttttttcattttcaaaactatgttttcctagaactgaagttccacaggccatctgaagagaacctatgtaaaataaaaagtggtctctccttcctcttagcttctatgcctgtctcgttttgacacttgggaatctgttaccgtattagcatttcttccatgagtgttaacctgcttccttaaagatagcatggtcttccaggttaccaccctaacctttatattcctaagccctggcattgccagctgcaactgtagaaatataactctatgaaactctccaccaatttattttgatgtcatataaatctatactagcccattctattgggcttttcatagtgaacaacttcctgtgattccacggatactcctatccattatatccaaattagtaaattagtcattttttaatcaaaacttagtaaaaaccatattcctgtgatgatataaatccttaaaaaaatttcagtgtaggtcactcctaccacttagaggtgagagatgtgaaggaatacttgtattaatactttttgcagttaggagtgacatcggccacaagtaataatctatctatcctatgctgtattcagtgacacagcacagcccacttagtgcaagattacatatcttttatacttgtcaatgtcatcgttaacagtagcagcaataagaacatctgatatatttcttttgataggttctgtactttacatacattatctcttttaattctcatgataaccctatgaggtagacattatttttatctcgtttccacagataaagaaacttgaagctcagtgagatttgtgctggagctagggctaggatttgtaaataatgaaagaaagatcaaagtgtccttgcatttcactgttccttctgcactgttattcttccatcttgactcaccaactatcctctgctcagctaatgctcaagtcactcccttactcaactctctcattttccttgtcgcaatcttccttctccaaggcactcataatcttccctctactctctctcttgccaatacagttggtgaatgaatctaccaacacttctgccctatagacagtctacctttgtaaaccaatagtttccaactccattccacttcagtcaccaattgacgtaaacttagacttcaatattagacatgcttcagctccaatatctcaaactcttaaaaacctgacaacaatttccactcttttcatactttctattcatctactgaatttcctccttgtaacctttttagactttacttgcatccttgcccatctaggagttcctgttgtaatttcaacaaagcacttggtaaatcattagaatcctttgtccccaagatcttctgccatctttccagtcctgggccatattctgcaatccttttcttgccatcattaagttgaatattctgggagaaaggtatattctcattctccaccatagacccatactagctgactccagctcatccttaaaaccgcttctactcatttgctgaactccttaataaacacgcagtgatagctgttccagacctttttccaccaccgtctccaaccccatttctacctctctccctagctgattcctttatcttttgtgagaacactgaggacttctgataaatgctttctacattttctttccttctccctcaaagtttctttatatcttctcactactcctttcccctagtctctgaattagatctatttccttttcaaggtgaaaccatccactgatgatcttgatcatacttcttctaacctccttacaaaactcacagacactctgtcttcttgattacttaactattatctttctctgctccttctctcaactaaaattatacacctctataaagaaaacaatacaactatttcttggaacgcattatcactctcctcccatcttctttcctctttctttgactgctaaatttgttctaagaactgtttgcatgcactacctctatttcttcagcattcattctctattcccctgtaatctcacaatgtatgaggtagaagggaagaacatgtttttctaaaggtcaccaataacttccaatcaccaaatcctatagccgtttttgtcttcagaccacctcctcccttttgtaattttctcctatcttggcatatgaacacttagcattctttgttcttaaattattcctttccggatttcctcttccctttctttctccttaaggtgagtcaaggtttttcagtatcaatcctctatcttctttctttctctcccactgtgagctttaacagtttcaaccataatctgtaagataactcccaaatttgtatccctacttgtacttctggatttgccagtttcttgctggatgcctacacctgtatactctgctagaccctaattcaacatatccaaaacctctttattacttcccacaaaaatcagaatacataccttgcttcttattgccactatcattccttcaaacttttttttttttttttttttttgagacagagtcttgctctgtccctcaggctgtcacagtggtgtgatcatggctgactggagacttgaactcctgggatcaagtgattctcctgcctcagcctccgaaagtgctgggattataggtgtgagacattgtgccccagcccaggctaaaattttaataatagttttaaactctctctgctgtcaactttcatatacaatagattgccaaactccacagtctaacactatgacatctctcatacagtattttctttcctattgcctattttaggctgttgacactaaaaacaaaacaaaaacttgggaccccaatccaccatgtcaagagaaaaaattaagctgcaagctgagtcatgcaataaactgcttttccttttgttcccaagcagatagctacagataacaggttaaatatctccacaggtaattactctatgttcaccttatcttatgtaaagtcccaacttactaagcaaaagaaaatacgtaattgactattcccttgcctgctcctttcctctggcaacatgtggattaccataccttccctctttgctcttcagcctactttaaatattaaagccctcaaaatcatctttggagaaaggaacatacctgtctcccaggcatgtccttaaccttggcaaaagaaacttcaatcaatttagaagactcttggtttaaaatactcttagttgaactactgtgatcacttctctctgatttacttttctctaggttggaaccgattcaaatactaggtctccagattaatcttcctaaagtacaattctgttactaccactttactgctcaaaaaacaaaaacaaaactggggagcaaggaaagagtacatacctcgtttcttatgctgatatggaaagtcttccaggaaatgactctaacctatcttctcaggttaatttctatttcctttcctatatcctatactctagctaagtcacataactcactgactgggacataaaacatattttttacctttatacctgtgctcaaactgtatctaccacctaaatgcccttcccttttaaaaaattctatttatcttccaagattgatctttaaaaaggatcagtcctgctacctacagtgtagaaatgaatacagttttctagtcgagggactttaatttcatgttatgccttggttttcttgttagatatgctgtaggaaaagaacttcaggatttctataactatcacaatgaattctcaatgactcaattttctagttaactcctgacagaataggtgtgagattgctgactgtcatgggaatgctcacttaagtaatctagcccatgtgatagctctatttctcattataaagaaataagtactttctttagaggcagacaagtaagttaatgatgcagtcatgtcaatgaatgccaaatgatgtcacagctcaatatcagagccaaggtttcatagtaatataaatgcaaatgagataactgggtcactatattaaatggtagaaatactgggcttaaaataatctttgccatagtagtcagtaataattgcagagaattattgaacataaccatgtctggagctgtctgttcatcttacatgtattaactcatttagtcttcacaatagttctgtaagttaggaacccctattttataagtgataaaactgaagtgtagaaaggctatcaatttatctgtgagcaaacagaatgaaagcagcaaagccaaggattcaaactcaagcaggctggcccaaaagccttcactttaaaacactaatctatatgaatttacatggcaagcaaggattttatttcagcaacatattactgcctatcacatatatgttgtaaattaaatttttattggttttgccatttagtttgtatttaatgttacacatttaaaaagtgttaagagttgaggccaggcatggtggctcacacctgcaatcccaacagtttgggaggccaaggagggcgaatcatgaggtcaggagttcgagaccaccctgaccaacatggtgaaaccccgtctctactaaaaatacaaaaataagctgggcgtggtggcgcacacctgtagtcccagctactcgggaggctgaggcagaagaatcacttgaacacaggaggcagaggttgcagtgagccaagattgtgccactgtactccagcctgggcaacagagcaagactctgtctcaaaaaaaaaaaaaagttagagttgaataaaaacaaggtatttatatattaatattactattcatttgtatatacagaagtagcattaaaattaaaaaagcaatttagttaggtgccacttcattgacaaggcctttctagataacgtcactagatatgactgatttacttctttgaatactctgtaactctgaatactatgcaactatatactttgaatactgtgtaactctcttaaagtccaaattgaactctgcctgacaccactttgcattctattgtaacttcaacatgtatctcagctgatcattataactctacaatacctaagagaactttgtacacttgagcataataaatagcacatgctttcctgaagtttggctgcagagtgcaccctgaaaaagccataaatacacaaagcctgactgacataatctcagtactacataaagctgcaaggcctggattctaatagtagctttacctgccaatgattcagtgtgtaatcctgcccctccatctgagtctccttctgctaacagggaagaaagacattggtacatcaggcaaaagaagatgttataaagggcataggccagttaagccaattatgcctttcaaccctcctagttaaggctaaaggtattctaatttaagagacgttattctaatgactactttaaaaccccaaataagagaccttttagaaatgcaaagataattctttcttaaagaaccctttcgcatcctttacccaaggtaaaccagcccctaaaacatgtcatgattacgactttctcccttgacaatatcatttctactccaaaattgaatttgctctccaatactgacatcctctaagcatttttagattccagctgctcagtgactaaccaccaagttctgtagatttcacccttaagtatctgtggaatccactctttttattaccatccttactaacatagaccagtggttctcaaagtgtggtcccaccaccagcagccttagcatcacctgggaacctgttaaaaatgcaaacgtttaggcctcatcctagctgcactttaacactccttcaaagtgattctcaagtctgagttagttcttacctaatctgcctgaaacagtcttttaactggtctccactcccagactacttcccctatttaatatacccctttctacatatcccttgcatctacagatttcattagtacttttccattcactggagtagtaatttttcaaatattgtgaaatcaatccagtgggtcaagaccagttgtttggccgggcgcggtggctcacgcctgtaatcccagcactttgggaggcaaaggcaggcggatcacgaggtcaggagatcgagaccatcctagctaacatggtgaaaccctgtctctactaaaaatacaaaaaattagctggacgtggtggcaggcgcctgtagtcccagctactcgggaggctgaggcaggagaatggagtgaacccgggaggcagagcttgcagtgagctgagattgcgccgatgcattccagtctaggtgacagagggagactctgtctcgaacaaaacaaaacaaaacaaaaaagttgtttattttttaaaaagtgaaattagaagaaaacaaaatatcaaaattcatcacatatagaaaagtattgttgtgttaaacttttgcttcaaatacacacacacactcatttgacgaataggaaatgtatgtcattcctgttataggttataatttaaaaggtctgaaaaacacttgcctacagcagtggttctcaaactttactgtgcacaggctcaccacgggatctcataatgcagagtttgattctgtaggtctgggaagggccctgagattctgcatttctaacaagctcccaggtgatggccagactgctggtccttgaacctcacttttagtaccagaagctactcggctgagtaatcccagaattaacttgctacttcagcttccttaactcatgacataataaggtttattgaacctaagatatggcagatttgcaatgtgctagaaaatttcgctgactctgaagtttcagagaatgagcatggtgttgttctagttaactgatgaggaaacatacttttttttactttaactctggttgttagcatgttaaaatgtgtttcctatttcctgccttatgaaatcagctgagttaaaattagttttctttgattaagaattttgaattgcctcaggatattctaaaacaagatctctgacttgtaaatgtagagacatagagaaagaatgggctcaatttaatacgcaatagatgtgagaatatactctggatattgtaattttttactaagatcctgcaatgaaccacattttttggtctcttttttcatcaatttttgaagaaaccataaaaatagattatttagatccaatccaaaaaagtcagtgtgttataatgcaggggttaattcacggaactaacttattagatgcttactcagggccaggtacaggactagatgctggagataaagagatgataaggcaaagatccttccctggaggtattttatttaaagaatgctgctgtatatttcaacatctctgcagctgattggatgagggtttctgctgggtctttctcactgatttctaaggtaagcgcagagaccagtgtttcatttcctttgtaactttcccatagcacttggcacagtgctctgaaggccattaagtacaatagttgataaatgttgatgactaaccaactctttcattcaccaaattaaaaactgtactcacacagaatatgaaatgaagctggctaatggctcaatctgtgccattttgttatataaggggtttgttccatgttaaaatggaacattcaactgtgtagtatgaccagctacgtcacccttagcttaataaaaatgtcatgttcactgaggaatgactattcttcacctcccttcatttaggcagacacacaaggaatgagaaacttagttcacttttctaaaaataaaaattaaattattccaggttccataatggtttattctaataataaaccattctcgccagcatacacacacaaaatgaaccatgggtgaggaatttccagccttcgtaatagccatttttatttcatggttgtcagatgcaacatggccttaaaaatcatttactgtcattatttaagaaaatttttctttcttaagtttaaatcatctacagtgatcataaaaaatgaaatttcacttttgatgagaaagaggaaactatttttttttttttttgagatggagtcttgctccattgcccaggctggagtgcagtggcgcgatctcggctcactgcaagctctgcctcccgggttcacgccatgaaactacatgataaaccatgcagttacttaattttagaacttgaaagcaagataatatgtgggaattacttggggagaatgaaaaggttaaattaatagctaataataactctaggaaatttacatgtcacataatgttacttaaatcagctatctaaaataggtatgtgctaaggaagagatacatttttagtttatctagcaaacattactagaggaaaaatggggcatattttataacatggagaaataacctatgcgtggagcataggaaaatacataaaaactaaatgagaatttagactaatacataatttagcatcatttttacagagacttcaaagccaataataaatgaatacttaagtacatttcatagttatggcctagaagttcacttaaggacagagagggaatacgatgtcacgggtaagtgatggaacaggctgtttcatagtatttcttaacgaatgggatctagaaagaagaattttgaagcaaactcttgtaattctcacatgtcatgggaaggacctggtgggaggtgactggatcatgggggccacttccctcatgctgttctggtgatagtgagtgagttctcattagatctggttgtttgataagtgtctggcacttccccctactctctctctcctgccaccttgtgaagaaggtacttgcttctccttcaccttaaaaacatgattttaagtttaaacttaaaacttaaaaccatgattttaagtttcctggggcctccccagccaagtggaactgtgagtcagttaaacctcttttctttataaattacccagtctcacgtagtatctttatagcagtgtgaaaacagattgatacagcccctgatatgtcttctatctctgcctctccttcccctggcttttcccctctcttctttggatgccttttccttaaatggccaaaacataaacatatcattccttgtaacatatctttgtaatatttaatatctttttacatctttatatttcttatattttggtaaagtaaaatcttctttgctataaatttagacatctacttttctcttcattgacatttatctcccatcatttatcagcagctccagcccttttttaaaacttgagaggcctttcaataatttattttctctgtgaggaaatggtccacataaggttctcaacttgtatctaataatcttctttacattgaggtttatttccttatttctgattctaccctttatagaaagacgaatttcagtttttatcttattttatttttattttattttattttattttgagatagagtctcactccgtcgcccaggctggagtgcgctggcatgatctcagctcactgcaacctctgcctcccaggttcaagcgattctcgtgcctcagccccctgagtagctgggggactacaggcgcgtgcaccaaggcgcgtgccaccatgcccacctaattttttgtattttttttttttagtagagacggggttttgccatgttggccaggcaggtcttgaactcctgccctgaagtgatccaccctcatcagcctcccaaagtgctgggattacaggcatgagccactgtacctgggctaattttagtttttatataaaaccatacatgcaatctactattaattcaccatgtaactttgtctttaggataactaatcctagctcctcatttaccttttaggaggcagtataacagtataacatagtggtttaaaaaaaggctacaaattcagacaaaccagtttgagtcccttgctgcttactaattgtgtgaccttgggcaaatggcttgggcacaataatcatgcccacctcataggattactataatattaaacaaaataaatttcaagttcttagcatgttacctgacatttagtgctcaaatacttctcaccattctcattttgcaataatctacgtttaaccaaagcttttaaaataatacagctctcttctttctcttcttaactcctatactattcttcatccacagagcccaggttccagtgttctgaggataatgtaatttatgtgtcaaaatattaagctgcatagattctaactaaatgctacacctttattttaacaacccactctcagcattccttacagtaccactgccaagttgattcatattggatgaatgtctttccttgggagctaaaggaaataatctgcttctaaacttttcactatccttttgagaagacaggtatattatcactgtctccatctcactgattaataaacagggtctaggagaagcttaatggactgaagagaggcagaatagtcaatgagaaggactgaaatactgcagtgcttgatactatatttatattatggatcagcgaggacacatgcttagacattcttgagctaatttaggtggctctaatagctacttgttctgattttctttctttttgggggactaagtggagtcacagtcttcctgaagaggcattcagaaccatactgctgagcctgatcactcaaatactcagatgccaaatgaagaaaaggtggatgttctctctctcttttcctttgtatctctgccttcaggttctgctaccaaatgggcttcatggcagagaggtgttcaataagctgacaactaagaagagcaagagatttcacacatatgacctttaatcactaatcacctgaactgcatgagaagtaatgtgaaagggaaaattcaaatgaaactatatagcaaaaaatttttaagggatgaagctaactcattatagaggtaggttcaaaatcatgtatctgagaccaatacttaattctgccaatcaagacttctcctgtctgtacttcattcatttatttcaacgttttcccaacgtggccatcttgccctattcagttctaaaagaaaacagggaatagttttctcctcttcggaccatgggcttatggcccatctggagaggatagggctccgaagccctatcctatttcaatttccttttatttaagtctagccctttgaagccagctctcccaagaatattctagataatatctcaccccctcagcatttttccattctttataccaatcatctgcactgtttccatacaagtaataagctggccatttttcactagtcctgaagattaataaaaaaagaaattctacagaataattatctccaactatactcccttatcccccagcaaactgatagtatcataggattactgtggcccatggtaaggtagagaaatgaacaatagggccagagttatattttgcattttaatagttttgactgtatgcttgttctaatttattttaagacctgaggtctgtgggcccatatttatcagtcaacctttttaggtttgcctgaatttcttaacttgttcatttcttaaacattattaagcactgtgctatgattcaaaaggttaaaaaaagatcttaggccgggcccggtggctcacgcctgtaatcccagcactttgggaggctgaggtgggcgaatcatgaggtcaggagttcgagaccagcctagccaacatggtgaaaccctgtctatactaaaaatataaaaaattagctgggcgtagtggcaggggcctgtagtcccaactactcaggaggctgaggcaggagaatcgcttgaacccgggaggcagaggttgcggtgagccaagattacgaccctgcactccagcctgggtgacagagcaagaatctatctcaaaaaaaaaaaaaaaaggatcttttcactgcccttgaggaaatattctggaaaatagtaagattaataattaccatgtagtatgtcttcgtagagacattagcaggatgaaatgggaacacagcggacaggtacccaaatcaactgcattccaaattttcatgttaataatgggtgaaaaagggctctgagtctgaaaaggacacttaactccaaccttccttctttctgttttgtgatgttaaatccaattataagggctgacattcccccaaaggaagatacacattagtgttttaatcaacaaaaggaggtgataaagtaatggatgaaagacaaaatttgtggattttaaatctcttttccccatatgagtccctcgctgcttcctgccttgtgctttttgaacaagtaacttcacattctgggcttcacattctcatctatcaggtgagcataatgttgccctccatgctcaatgatagggttggaaagaatgactgatcaaagttgttcccattcaactctacaacctgtatatttccagatccaaatcttttcaaggaaaagggatagggaggggtaggacctagggcttagggagcaaaggacagtgaaggaggccgaagcccattctcaccgaaaggatcttatcaccctcctggagccgcccatccagggccgcagccccattttctttgatgcggctgacgtagatgccactgtcgttggagacatactgctgatctgtcccaccgacgatgttgaagcccagccctgagaaaatcatggaggagtaaaaagatgggggtgaagaagaaagaaagagattagagaagatgaagagaaagggagggaaagcctactggggaggaaaggctgatggagaggagatgctggcgagtcagcctgtgatggagctggtgaatggtcatgaacaaggtcagccatatcaagagtattgagttgctcactcaaatgaggcacgactgaaaatataaacacagtgatccacctgttttgttcaatatataaagaaagatctatatagaacttaaagaataatggtgattactctaagttcgttcttctttttctttttttttttttttcagagtcttgctagtgggcatagtggtgggcgcctgtaatcccagctactcaggagttcatagctcagttgcccaggctggttatgagctcctggcctcaagcaatcactattgccttggcctcccaaagttctaggattacaggtgtgagccaccatgcccagcctagatgtaagttcttctactcacatttagttttgatcctgttgatggtattcaaaggacccaattcctgacattcctgatattactacagcagggttagctgtgttcatcaaaagaagctatgcatttttaccaattatcaaatgaactgttcctaatttagtgtgagagatttctaaccataccttcccttccacactttccttctcccaagcttctggagaatttatgtatgatagtgctttagaaaaatctcttgagagtttctttttttttttttttttttccattttggtggtggaggcagtggtgtaggtattggcagagaaacctcagaaccagaaaggtaactgctatttcatggtaggactaaatcaccaaatttactctcccttccttcgctacttcaagtacaaccatatataggttgagtatcccttatccaaaatgcttaggaccaaatgtgttttgaattttgaatttgggggattttggaatatttgaattaaacttaccagttgaatatccctaatccaaaaatctgaaatctgcaatgcttcaatgagcatttcctttgaacgtcatgttggcccttaaaaaattttggagttggaagcatttcaaatttcagatttttggatttgggctactcaatctatacttgggcatagtaattgacaacttttattcactgtagaaaaaactgactactcgttgattagcaactccccagttcctcttccctaagtccttggaaaccaccattctaatatttgtttttatgagtttaactattttaaatgcatataattttagttatgcaagatgaattaagttctagagatctgctgtacaacattgtgcctacagataatactatatcatacactgaaaaatctgttcggagtagatctcacgttaagtgttcctaccacagtaaaacaaaatattaaaagaaagaaaaaagagaaggaaagaaaactgagtaccaaagtgctatttctatggaccaatgactaagtgctggaaaggattttactgtacagaaaccgttgttaggaaaggattttacctatgcataaaaaaataaaaaggaaaaaggaacttctctagggctttcttaatgtcagctactggtagaattcaggggcacagtgtaagacaaaggagatagtttggaaacaaaccaaaaatctagcggtgcaattggaaggaataaccataatcaccagcctacactgttctcaatagaaaagatacttaaagagacatatgcggggggccgggcgcggtggctcacgactgtaatcccagcactttgggaggccaaggcaggtggatcacaaggtcaggagatcgagaccatcttggctaacacagtgaaaccctgtctctactaaaaatacaaaaaatcacctgggcatggtggcaggcacctgtagtcccagctactcgggaggctgaggcaggagaatggcgtgaacccgggaggtggagtttgcagtgagctgagattgcatcactgcactccagcctgggcgacagagcaagactccatctcaaaaaaaaaaataaaaaagagacatatgcgggctttctgaaagttctccccattggtgggagaaaagcttacacctgaagctcacagtattaacataagcactagcaaatcaatttgtaatttaaagaaaaacatgaccaaacaaagacacaacaggaaacatttaagttaaaaagcataccttagccaggcatggtggctcacgcctataatcccagcactttgggaggccaaggtgggtggatcacttgagctcaggagttcgagaccagcctgggcaacgtggtgaaaccccgtctctaccaaaaatacaaaaaattagacacgcgtggtggcacatgaccaacattgggaggctgaggtaggaggatcatttgaccctgggaggcagaggttgcagtgagccaagattgtgtcactgcactccagccagggtgacagagtgagacccccatctcaaaaataaaataaaatacataaaaagcataccttgtgcataaaatctctgcagctagataatagaaagaatttattctctaaaataatatacataatagaaagtgctacttctggagtttgtgacctggctgggcaacatagcaagaccctattctctaaaaaaataaataagaaggtgctacttctggaagatgctattttaacttccttgaagggctgggtattaaaaatagtagcttaacttactaaatgattttcttagagcaccctcaatttgtatcatagaaggtaggaagtattggagaaggtacagaaatgtaagataaggtggaaaagcagatggaacaagattatcgaaggttttgaaatgacttcaaaactgtgacagctttgaacaagggggccaaggccaacccacctctcccaagctggaacaaactatgtagaaaaatcttttgatgaaatccaacaccctcatcaaatgctacagttgcctctggtgatcttgggaacaggaagcaaatgttaagcagctgaatgcaatgtagtagttagcaacagaaaggactttgctactggttattcaaagctaactgtagaaaaaaaaggaagagtagaagaaattttaccgagatttaccataaacaaaaaagagccgtctactacacaccccatcgaagtcatattatataggtacatttataacccgttgctacttctgttgtaaatgaaccaaactatttaacatgagaactcctggactgacctgaagccctttgttcagccagaatatttacagaactgggtgtatctataagccaaagcattgctgcaataaaagagtcaccacagcattaagtagtggcatgaccaactgaacctgggctgtacggatacctacataatccccagttcacttgctcagtaaaaattactgattgaatcttatgtgtaagatgttgtgttatcatctgaggaagacataaagttaaactgcacactccctgctttgatcacaaactggagtttttcctttttcctgtccctttaagatattgcagaagcaaatcaacatttactatgtgttaggcattacgttatgctctgaggaagatataaagctaacctggacagttcctattttaaccacaaacccaaatttatccttttccctgtcccttttagatattgtagaagcaaatcaaagtcagaagacttggttctaagtttataacttaccagatatgtggactgaagcaagtcagtttacctctgatcctcagcttccttttctacaaaaataagaattataaattctgccctgtctacatcaatgggtaagtgttaggggccaataacataaaatacgaaaaaaaatcttcataaactacatagtagttgctctattgggataaggcgctaggagtagttgtcaataaactaatggctgctaaagctccaaactagatagtttgacagagaaagaatgaataaatatacagtagaaatgcaaaatctcctaaaaaatgggaagacagattttaaaattccacccatctataaacaggaactcaaacttattaagtacgtctatggcatgtgacctagaaatcccccttaagagtagtttctagcaagtgtgatatctaaactctgcggcaatcatccagcatatggaccaaccaattgaaacagatgtcagttggaaaccaccagaaagggaaaggctattcaatacgtatcttgctaatcattggctatggcccagaaaaatcttgcataagtagggtgaccacatatcccaaaagcaattgccacaaaagccaaaattgacaaatgggatcaattaaagagcttttgctcagcaaaagaaactatcatcagagtggacaggtaacctacaaaatgggagaaaatttttgcaatctatccatctgacaaagggctaatatccagaatctacaaggaacttaaacaaatttacaaggaaaaaacaaacaaccccatcaaaaagtgggcaaaggatatgaacagacacttctcaaaagaagacatttatacggccaacaacatataaagaaaagctcatcatcactgctcattagagaaatgcaaatcaaaagagatgccatctcatgccaattggaatggcgatcattaaaaagtctggaaacaacagatgctggcgaggatgtggagaaatggggatgcttttacactgttggtgggagtgtaaattagttcaaccattatggaagacagtgtggagattcctcaaggatctagaagcagaaataccatttgacccagcaatcccattactgggtatatacccaaaggattataaatcattctactataaacacacaggcacacatatgtttactgcagcactgtttacaatagcaaagacttggaaccaacccaaatgcccatcaacaatagactggataaagaaaattggcacatatatatcatggaatactatgcagccataaaaaagaatgagttcatgtcctttgcagggatatggatgaagctggaaaccatcatcctcagcaaactaacacagaaacagaaaaccaaacactgcatgttctcactcacataagtgggagccgaacaatgagaacacatggacacagggaggggaacatcatacaccagggcctgtcagggggtggggggtaaggggagggagagcattaggacaaatacctaatgcatgcggagcttaaaacctagataacgggttgatagtgcaggaaaccaccatggcacatgtatacctatgtaacaaacctgcacgttcagcacatgtatctcagaacttaaaattaaaaaaaaaaaaaaagatttgaaaccaaaggaaaaaaaaaagatccttaataatatattcttagtttttcattaactcacaggaaaagtctgaccacccatgagacagaaacctattacagctatttacaaggtaaccaggcttgtaaaaatataaaaatgtaaaaaaaaagaaacatggagttttaaaatgtaatgttcatattcataacacaacacctccctataaataaaaacatacacacaaatattaactatttacaaaaatgcatgcatatttaaagaaatataaagacacattagagtgggtacttatggggagaaagatacaggatagagtttaggtatgaagggtgaaaaaagaacctgagaggaacatactgatgataacagtgtactttggagctaaagggtataattaattcagctcttagcatttaaggtccaaaaggagttgaggggagaggcaggaagaaaaaagactgggattcaacttttttttttttttttttagtgaatgaatgaagagcttagtgagctctggttataatgtgccaacaaattttaaaatatggcaagattaaaatgggttgctgggtgtctattttgcagtctaaatgcaaaatagtaaaggtagcataagaatgacaccactataggattaagagagaaagaaagtgtgcctaatagaagaaccttggaaagttaaacaagaaatcccttcttttgaactcctgactataggtctggaccctaagcctgtttaaaagagcaatggcagaagcaacagctaatgtttaccaagaccttattatgtaccaaataatatgctatgtactttatatatattatctcatttaatcttcttgacaaacacaagtactcatttttcaaagagtttaaaaggtgaggcatggacaggttaagcaactttacaaaaatgtcacacagctctttgcaaagccaagacttaagtcaggctgtgtgattccaaagcatgaatttttaaccattttgctacaatacatctttgcagaaaatataaactgctttaagaaaaaaagtcttctaagcattgctggctatcttaggagctaactggtctccaggctggctctgaacaagcaatgctgggataatggttgtagaacaatctccaagggtaatatattctagaggaagaattcaccactatagagttttgtaactgttgtcaaggttcctattatttaccttcagaccagaaaaggaaaagcccttcatttcattcagattcttatctacaaaatctaaaagttataaagtaaatgaccagtgttaacctgttattctagaaataacaattctggacataattaaaatgaaacaaaatagttcattaacaccaaggattatagccacttgttgagttatgaagactagagtaacaaacaccctattttcccttttctttcccaagatcaatccgactaattttctcccagacatcaatcaaactccattggatacacaacccccctgtctgtcttttatgaagactagagtaacaaacaccctattttcccttttctttcccaagatcaatccgactaattttctcccagacatcaatcaaactccattggatacacaacccccctgtctgtctttatctatatcatggtaaaataaacttaacataaaatttaacattttacccatttttaaatgtataattcagtggcattaagtaccttcacaatgtcgtataatcatcaccaccacctatatctggaactttttattcaaataaaaactctatacccactaaaaaatagctccttattctcccctcccccaaactctgacaccatctattatactttctgtctatattaatttgtgtattctaggtaccccatataagtagaatcacacaatatttgttattctgtgtcttgtttatattgcttagcataatgtcttcaaggttcattcacattgcagcacatttcagaatttcattcttttttttaaggctgaattataatcttttgtatgtacataccacattttatttacctattcatctggcagaggatatctgtgttgtttccacatttggcggctgtgaacactggtgtacaaatatctgttttgagttccttcctgcaattcttttttttattttttgagatggagtcttgctctgtcgcccaggctgaccagcagtggcgcgatctccgctcactgaaagctccgcctcccaggttcactcattctcctgcctcagcctcctgagtaactgggattacaagcgcctgccaccacgcctggctaatttttggtatttttagtagagacagggtttcaccatgttagccaggatggtctccatctcctgacctcatgatctgcccgcctcagcctcccaaagtgctgggattacaggcatgacccaccgcgcccggtcccttcttgcaattcttttgggtatatacctaggagtggaattgcagaatcacatggtaattatatatttaataatttgaggaggtgataaacttttccacagtggctgcaccattttacatcctcacaaacaatgcacagctaccccaatgatatgtgtgtatgtatgtatgtatgtgtgtatatgtatgtatatatatgtatatttatatatatatgtatgtgtatatatatatgtatgtatgtaaaatagtcatcctaatgggtgtgaagtggtaacaaattgtggttttgatttgcatttccctaacagctagtgatgttaaatatttttttcatgtgcttattggccattggccatttgtattaccttctttggagaaatgtctactcaggtcctttgctcatttttgaattgggttgttttctgtcactaagctgtaaaagttctttatatatgctggatattaacttcttagcaaataaataattggcaaatactatctcccattctgtgggctatctttaactctcctcatagtgtcctttgaaacacaaaattttttacttttaatgaagcccggtttatcttttgttttgttgcctgtgcttttggtatcacatccaagaaatcatagccaaatcgaaggtattgaagctttttccattcttctaagagttttatggttttagctcttacatttaggtatttaataaatttctagttaatttttgtacataatgttaaggcaaaaatccaactttcacatacttctgcatgtgaatatacagttttccaaacaccgtatgttaaaaatgtgtactctgctgttatttgatgatgtgttctatatatatatatacgcctgttaggtctaatttgtttatagtgttgttcaaatcctctctttccttattgattttctgttggttgtcctatccattactgaaaatgaggatactgaggtctaactattattataaaatggtctacttctccagatcaatttttcaacatttgcttgatacattttggcactctgttgttttgttatgggaactttggggtgtcacttttctggcaggagacctctgtgtggctgctgcagcagggtgggcagctccaggtgctggctctctgcaaggctacagctggaccaggcgtagcgcgagcagcttctacagctggcactggggaacacgatggcatctggaagcttggagatgccaggaaccgtagggtcccaaggagaaagtcacagccctggctcagggagctcccaggtctcagatacatgaagggttgcagctcttctctctttctcttcacccacaatgtggcaagcaaggggcatgtctcagccctgactgtgttacagctctcttagcctcaccattcgatggatcctgagttcttgtccagcaaccaggaagaatgagatacacagacaagtggagtgtcagcaagtcaaagaggagctttactgagtgacagaacagctcagaggggacctgcagggggcagctcctttcagcatccagggtgtgctgatgagtgttcggctcctagcagagacagtagctcttctctgctagggaggtcatcccaatgagtgttcaactctcagcagagagggtagctcctctctgtaggcaggtcatctcaacaagtactcagttctcagcagagagggtagctcctctctggagctggtcatcccatcttctctgctgtggctgaacctggggcatttatgggcctcagagcagaagtgtatgccgactggtccatgggcagccacagacagcccagaaaaggcaccacatgtacccattccagtctgtgggactagcagcccagccctcagccttcaggcccaccttggcctgaaggtggggcctcaccagggaccaacccccttccacccaggagactgtctgcctcctgccaccatccatggcgaccagcctgtttgtgccaaggggcacctgcaggccagtgctgagctgccctcagcacccccaggattcccctcatgcttgttggtgcccaaagtccagagagggctgaggcagcaaggggctggtgtgtcagcactgccctaagtgtgtacacactgggccgggctttgacagcactcagattggcccaaaccctgcactgagatcagagcaggcactgggagcagggagaggccaggcagcaggaaaagacacccctgagcctgtgggtgcagggggaaccttcctgggcccctgagggtgaagagtgcagaaatgcctaggtctttgcacctgggagggcagagctctcatctgctccatgaagtgtgcagccagcactagctgtgcctcctcacagcctggggtgggggctccaggtcctcattgggccggggcaaatattcagagcaggagtgacatcaccacaagctccctgctgtcgccctggcgctgaggggtggcctgggactcactgtcgcttggctcacagccctgcctatagggggcctctaggagcagatagggggcctccaggagcagatagtgggccccagtcctggccatcacaagtgtcaggctcggaagtcacccagatgcagggtggaccccggggatgcggccccgcggaggctgctcccaaggtgcaagaacccactgcagtgcccgtggtgggtgggtgtggtgggtgctccgctggccaggtccccaaagcaggcgccgctcccacttcccaccctggggccccaacgtgcggccccagctctgcacccctggcccagcccccatgctctgtgtagaagcgtggcactgccccaggcccaccctggcctcacggcccctctctgctcgaccacactgctcacctgctggcgcccatctcggcctcgccccatagcgcagcccccagggcagcaggctccagtggggttcctgcttgtccctggctcccactggctccatggagcaaggcactgcccggggcccagccctgcctcctccccacactctccctgcagtggcagcaggcaagagaggcaatgcagggccagggtctggagcaacagaggctccggacctggggatgggtcctgcctggccatgtgagggtgggggacacacagttggctgcctcagggacgcaaggcataggggacccaccactgccattgctgctcccgcagccactcctgctgtcactgcccacgcctccccgctgcagccagtgtgatggcactgccatgaattccccctctgaagaggaacatctaactgctgttaagatagggacgatgactgctcttaactgcttcatgctgacagagggtgttaatttgtggaaaacaggagattttctctcaggatcctatctaagggtcagcttcatgctgattggtgttgttttggggaaaacagcagatttcctctcagggtcctacctaagggtccccagtaaaagggagccatcatccgaggctccatttccatgaccatttggagtttgacagcccaccccttttatttcttttgagctgcagtcagagatcactggttggttcacccctacaattgtcaaaagctgcaaaaaagagaaaagtttccttgactctgaaatacaaaacaaatgagcagcaatgttccaagcaaaaagtcaaaaaggattatttcagtcttccattagttcagatcactcagtcaactcctgttcacaatctccaaagttatcagaaacctgtactcaaggactataatccatcttttgaagaggatcaaaacaagacaacaattgtctgtgaatgccaaaatatcctaaggtcgtttcattcaaaaacacaaatgactaagaaatttggtaacctctgtggattacaataacccaatacgataaccctaattatgattgacagcatatactcagacatttggatttttgaagtcccatacaattttggaacatacacaagtattattcaccaaaatataacctgaagaagactaaaccctatctttatcttgacaatccctttacaaatttttgttaaagagtagaacagtgcctttagaaacccttgtggttttattcccaagttcactttataaaaaaaaacaaacaatacccttttgaatttagtattcccacacagaattttgtttttaagattaacctttacaaatcttccacaacttgtttaaacatttagctttatcttacctaatttaaaacaatcatttaaccccctaaactaggcaaaaatgtatattcccatgccttcttatacttttactaaagacacgttttacattctttacacaccttgcatgtaaatctatcctcagtagtctcaattacatgttataatggtaactgttagcaattcttaattttgatgaaaaatctggtaagttattttaattatttacttagatgctgataaggtctatttctaacatagctaggggtgtggcatatgttccccagccttaccaaactgtaaagcaggcaagttgaagaattttcaaaagccaaagaagcagtttatgacttttgaaaagtccgtaaattatgaaaaattaagcttcaaaattcgagtgctctttttagaaacaccagcatgacttatatataacacttatgggacatcctcttgtaaatatctaggaaagtggactcacttaacttgggatgctgataagcagcaacagccaaaacagggatcctctgaaatgtataaaataattcatttgcaagcacaagagggaaaaaaaaagctggttttagaaccgtacaaactgaatgagagacctactttataattgtcttggttaaaatctgataataagagatttgaaaagattattttttagagttctctggtcagaagtcagcttacttagggctgggcatggcagctcacacacctgtaatcctagcactttgggaggccaaggagagaggatcacttcaggccaggagtttgagaccagcctgggcaatgtatttttttttaataaaagaaaaaaagcttaattaaaagtaatatttaggctatcttttgtgggggggaaaggactttctgcttttttcctctcttggatcctggttcttggctttttttttttttttcagtcaattgagacccctttttaaatatgtttgataccttgagtcttctgtttgtttccaatcttgctggcataatttttgctgagaaaaatataaaacttcactggccttttacaaaatttaaaatctccaggctcttgctctgttgcccaggctggagtgcagtggcacagctcactgcagcctcaatcgcccaggctcaagtgattctcccacctcagcctcccaaatagctcggactacaggagcacaccaccacacccagctaatgtttttcttttctttttttatgtagagacagggtcttgctattttgcccaggctggtctcaaactcctagctcaagtgaacctaccacctccgcctcccaaacagttaggcttacaagcatgagccactgttcctggctaaacttgttctatttctttccactctgctcttccttccttttgttattttgataccacaggaagaaatctaaaggagacttctaacgactcagacccctcaaggaacgctgaaaaaacacaccattcactccctttttggggtattctgtcttcttgtggagtctgaaaagtcatggacaggttcctctcaggtctaaaactctgctctcttccatactgcattacttgttggcttttgagagtaccagagattactttgtactgtgaaagagacctttgtgtatgttatggctggtaagtcactgacaagagctacagtattggaggtgactaacagcagttgtttatggtgaatggttattactataggcagctactcattttattttattttttaaacatttaggtaagaaaggtgtggcttaatgtctttgtagtgaggtgcgctgtggaggtttgtgtggcctggtatcatggcattttgctctttgtggagacccaagattcacgtaaaagtggtttccttgatttttaaagatccagatgcactgccctgcaaatctgcctggtttttagacacttaatatcaggccctgaggcagtcctcactgggacaacaggtggtgcacctgtagtcccagggaggctgaagtgggaggatcacttgggtccaggagctcaagaccagcctgggtaacataatgaaagcctgctttaaaaaaaaaaaaagaaagaaatttttaaaatatatatctattaggccctggaaactgcaaatactttcctggtcccattcatgaaagggctccactttgaagtcagtaatctaatcaagaaacgaactaagtatctaacaagattatagtctccaaaatacaactttctagcacttagctggctactttgaaactctatgtaaaataaatttacttctataaaggaaatctccatttgtaaggacatgcccctatacccaagcagctagaaatttttacaatgggaaagacactggcttaaagttgacataacaaaccttacctatgtttaaagatacttttcctggcaatcttatcttgactgattctttttgtttcagcaaataatggtatatagatataagttctatgcctctaggggtatcaattttcacctaagagtaatgtttgcaatttagggttacctagctaaacaactgtttagggcaatggaataagtaatcaaggaactggtagtctaaacagggagagattatctgcaaactggcaaatgaagaatcttataaagctataagatctgtttctgtcactgtgtctgtatgtctctatgtttatgtgtcatgtgtatgtgatacttcactaccaaaatacatgaaaacattctaatgaatttgtcagaggcgtttaaaccagagcaactccatcttgaataggagctaggtaaaataaggttgctgggctgcattcccagtaagttaagggattcttagtcatggcgtgaaaaagaagtttggcacgagatacaggtcatgaaaaacttgctgataaaacaggctgctgtaaagaagctggccaaaagccaccaagatggtgatgagagtgacctctggtggtcctcactgctacactcccaccagcgccaagacagtttacaaatgccatggcaatgtcaggaaattaccctatatggtctaaaaaggggaggcataaataatccaccccttgtttagcatataatcaacaaatagccataaaaatgggcaaccagcagctctcagggctgctctgcctatggattagacattcttttatttgtttactttcttaataaacttgttttcactttatggactgcctcaaattctttcttgcgtgagatccaagaaccctctcttcgggtctggatcaggacccctttccagtaacaaaatggctttaaaggtaagcacttaaatcaagtattttatcagaaatatagaaagtaactcaaatgccttttagttcacattacaaaaataagactactttgttggtttaatgaaaatggctgtttcttctgatcagcaaaatatgcatgtatgtaacgtcagggtttctttcacaagctgtggaaactattaacaaagaaataacttgaggccaggcatggtagctaacatccataaggccaggagctcaagaccagcctaagcaactggcaagatcctgtctctacaaaaatgaaaaattaaaaaaaaaaattagcagggcatggtggtgcactactgtaggcctggagtgagccataatagcaccactctactccagcctaggtgaccgggcaagaccctgtcttaaagacaaacacaaaaaaataagtaacttgggatgacggccagctttgtttaatgatctatacaagtctaacttttaaaaatgaataaattaaatgaatataaatggtataaaagtgtataagcaagtttttcataattttaagaatctttttcagaaacttaaaatcatgttatgctaaattaagtaacagataattataaaatgtctgagtcatttacatggtatagaaaagctaaatatatttagatctgttaacaaacagattgagaaggttatctttctagaaattatgaaatggttctatctacaaatactggtataaaactgttcaaaattaccttacttcctaggttcttcactggaaattagggttactaagagttaaagttaccgtcaatatatacaattaaaactactgaacacaagagaaacaattctaaatacagtgcatataaagaaagtaagatgtgaagaaagttgacaatagagatcacttttctttacatggtaactttgtgtggacaaaataaggaggaaagaaatgtaaattaaataaggagggccaggtatagcggttcacgcctgtaattccagcactttgggaggctgaagtgggtggattgcttgagtacaggagttcaagaacaacctgggcaacatggcaaaaccccatctctacaaaaaatacaaaaaattatctgggtgtggtggtgtgtgcctgtagtcccagctattcaggaggctaaagtgagaggatcatcaaagcccaggaggatgaggctgcagtaagctgtaatcacaccactgcacttcaagttgtgtgacagggtgagaccctgtcagtcaatcaatcaatcaaatcaatcaatgataggaaagaaggaaatgtaaatttctgtcttaaggtagaatgccaatatcagaaagtcagtataggacaaaactaaagatttaaacaggttgtagaatgtctacggaaaaaaataaatgaatgaatgaatgataatggggaaataaatgtataataaatttctgtcctaaggtagaatgccaatatcaaaaaggaagtataggacaaaactgaaggtttgaacaggttgtattaggttggtgcaaaagtaatggcaaaaactgcaattacttttgcaccaacctaatagaagttttgtggaacatgaatcttatgaattttgtgagtgatcaagttggctaaaattagaaggggattatttcactttttaaaaaactgagcatcaaaatcaaaattgagcattaatatcaaaagcacactgatgcaaggccagactcaaaataatgggttttgggggccactgatctgctctttaatagattaaaaaagggttatgggaatcttgtgtgttcaaagctgattgagattagatggatttgtttattaaagttagctttagcattaacaacatactgatgcaaaggtagaatatggttctctcttttaaacaatattttcatatactaagagataataaaagacttgttcaccttttgagtaatctacaaaaataaaaagagaaaaagatgtgttggtcttgtgctgtctttattaggtcttttgattgtttgggaaaccaagtctcctttctattcaagagtaaaggtctttgctttcaattatcaccttgacttaattaatgactattatttattgtgtcttgtgatcctgtttagattaagtgttttcaacctgcattatttgacatgctttccaaaactaaatttcaaattctaactttaacccttttccaaaaggaacccctggaagtccaacagatacgtattaggcttatatgttaaaatcatattgttatagtaggtagccagtcaggcataagcagggcaggagggggcctaccaccacacacacacaccaggaacgtcaggttacctttgcagaataacacacccaacaactacaaaataaactttatatttaaaatgcttatgaaactgcctttccaaaaattgtaactgagaaaattatgatggtgaaagagatctgacctaactgactccatcttgcttctaatctccaattgtccttgttcattcctgggtgtaggccaaactaactttgggaggaacttagcttacagtttaactttgaaacaaagataacagccctttgctgaaataaacccccttcttgcttggggactatactgccgttgcaggactaacaaattagccacaagattagaaattatgatttaggagtcatgcagctggaggctgcaagattctgaacttccccgaattgctccaggggataacatcgcgattgtaaaacctaagatcagtgcttctgatattttgcagaccctgcactcaatggatcaggcagcaccacttagatctataaactaactcatctagtctttgtagtgcccacccaagaaacaacacagcacaagaggacagcttcaactccccatgatttcttctctgacctgaccaatcagtgatccccactttccaaccccccacctgacaaattatccttaaaaaccctgatccctgagttttcagggagactgataataaaactccagtctcctgtacagctagcgctgtgtgaatgaaactctttctctattgcaattcccttgccttgataaattggctcagtctaggcagcgagcaagaagaacccattgggtgattacacctgcacttcattgaatgtgaatcatgcctcaaaaaagttgagatgaacctggtgattatgtacaaaaatgcaagcattttaaacatttattaatgactcctacttattaggttggtgcaaaagtaattgcagtttttgctataaaaaatggcaaaaaccggccaggtgcggtggctcacacctgtactcctagcactttgggaggccgaggcaggtggatcatgaagtcagaagatcacaaccatcctgactaacatggtgaaaccatgtctctactaaaaatacaaaaaattagccaggcatagtggcaggcgcctgtagtcccagctacttgggaggctgaggcaggagaatggcgtgatctcctgggaggcggagcttgcagtgagccgagattgtgccactgcactccagcctgggcaacagagcgagactccgtctcaaaaaaaaaaaaaaaaatggcaaaaaccacaattacttctgcaccaacttagtcaataataaaaggctaaagtttctcaaagcaccaattttgtgttaattaagcaaaaaaaaaatttgttatagtatcctccttacagtagactttttctactatttcctatgcaaatatgataaaatgatttttaaataaattctaagtatatccccaagataaaatcaaagtaaaaaaaaaaacatagaagatgaagtttaaactcaaaatcaccataatctacctttctagccatctttggacattctctactttgcattatacagtaaacaaaatttaatatttgctatcgcttttcaccctatcatccccgcccacagctactgcttatctccgtgactttggatgtcttcttccctttgcctgaaaacatgaaattacttgtttaattgtctcattaccctattgcaatattcgttcctagaagacaatgtaattagcttatattcatttttgtacctcctgtgccaatatagtacctagtacatacacaaagcccaactggtgtcaattgactattattggaattgaaaattacacctaggtcaggaatttctaacatttccagttctagggaaatctcacaaggttaaaaatgtttctgggagcttctaacaggttttttttttttttggaggagggggaaggactattgcagtaatagggtttttttataaactaaggcataaaaggagggaaaaagagaaacagaagccccatatccctgaaattactgacacagcttaccctacccttcctagatgactcaattcttgccccataaagtctactccccacatagcagtatccttaaagcacttcaatgaattaaatgagttgttttgtggtaaagtgcttaagacagtacagaatcgtcactacaaattatttataaaacaaaaatcggacaggcgtggtggcttatacctgtaatcccaacactttgggaggccgagatgggtggatcacctgagatcaggagttagaaaccagcctggccaacatggtgaaaccccatctctactaaaaatacagaaaaattagccaggtgtggtagcgggcgcctgtaatcccagctacttgggaggctgaggcgggagaatcgcttgaacccgggaggcagaggttgcagtgtgctgagactgcgccactgcactccagcctgggcaacaagaacaaaactccgtctcaaaaaaaaaaaaaatcattgaatcctcacaactctataagtagattctaataatactctcatattatagctgaggaaactggggcagatagaagtgaggtgacttgcacaaggtcacacagtgagtgagtgatagagtaaggatttgaactcaagcattctggcactttttcttttttgagactgagtctcgctgtatcgcccaggctggaatgcagtggtacgatctcaggtcactgcaaccttcacctcctaggttcaagcaattctcctgcctcagcctcccaagtagctaggactacaacaacctcgaactcctgggctcaagcaattcttccacttcagcctcccaagtagctaggactacaagcatgcaccaccaaacacagctaatgttttgttttgttttgctttgttttgttggcagagatgggagtcttgctatgttgcccaggctggtcttgaacttctggcctcaagcagtcctcctccttgatctcccaaagtgctcggattacaggcaagagccacaatgcctggcttgaactgcaaaattcttaaaaatggggatcatttcttattctttattctagtgtccatgattcctaatcatagtgtaggcacataataaatgctaaataaattttaaaaaatagttttactttacttttcagtcttctgaaaccagcagttctgaccctatcatctaagtatagtttggctatttttccctcaataaataattgtgtacttatcacatgtaatcattgaccacttttctggctagtcacatggcttcgcaaaatgtttctgcagttgaacatctatcagcttgcctttctatttccccaaagtaattcctagatattttactgtacagtttttctttagtattgttttgaaaagatcttaatactgatccttgaagcaatctttagagaactgttccatttacctgactctctccaagaggtgttccatctactccttctccttgtttctgatatcttagccagtttcctatccatcataatacaatgtgtccatcctcattctctctttctcaaattgtatttagtgaagaaccatgtttaccactttttgaaagctgaaacagatcatgttactgcttctctttatttaaaacatcccattatggcaggcacagtggctcatgcctggaatcgcagcactgtgggaggctgaggtggaggatcacttgagcccaggagtccaaggcatgactgggcaacatagtgagatctcgtctctacaaataattaaaaaaaaaaaaaattagtcaagtgtggtggtgcatgtctgtagtcccagctactcaggaagctgaggcaggaggaccacctgagcccaagaggtcgaggctgcagtgaactgtcatagtgccactgtactccagactgggggacagagcaagaccctgtctcaaaaataaataagtacattgggtgtggtggctcacgcctgtaatcccagcactttaggaggccgaggtgggtgaataacttgagctcaggagttggagaccagcctgggcaacatggtgaaaccccgtctctatgaaaaatatggctaataaaaacattaatcaggtgtggtgacacacacctgtagtcccagctacttgaggggctgagacaagaggatcacttgtactcaggaggtcaaggctgcagtgagccaagatcgtgccactgcactccagcctcggtgacaaagtaagaccctatgtcataaataaataaatataaaaacattccattatattattatgatatctatcagtttgctcagtcatttaatgaacacttactgaccactgtgtgtcatgcactagacaaagcattaaaaaaacattaaagacacatgcatgcatgtgttcactgcagcactatccataacagcaaagagatcgaatcaacctaaatgcccatcaatggtagactggacaaagaaaatgtggtgcatatacaccatggaatactttgcagccatgaaaaagaacaagatcatgtcattcgcaggaacgtggatgcagctggaggccattatccttagcaaactaacaaaggaagagaaaaccaaataccacatgttctcacttataagtgggagctaaataataacacatagacacacagaggagaacagacactggggcctacttagggtggaggttgagaggaaagaatcaggaaaaataactaatgggtactaggcttaatacctgggtgacgaaaaaatctgtagaacaaacccacatgacactgtttacctatataacaaacctatacatgtacccctgaacctaaaataatagttaaatgaaagaaaataagaaataaaatatatgttctttgactcagaagagctcaaagtgaagtagaaggaggagacataagtgagaaagcatatagaaaaaaaaagttatttataatgattcagggcttggaattttaagtcacacagacctggatcgaaatcttcacttaaagagttgtataatgcagaagtcaaggtttcctcatttctgaaatggggataataaccatttcatctcttcctttttacaaggggacaagatacagtgcttagcttggcaatacatgggaatacattacaggcaatctgtaaatgatgtataatatagacaataagagaacatctatcctaggtaaagcctgcttcctggaggagctaactgttgaactgagtcctaatcaatggctaggaagtagaaagaatccagatagaactttagagaaagattaagtttccatactaacactaaagactccataatctgatctccacctactcaggttactactcagctacctcttctctcttgaatctcctaaaggaaactttccttctgtccaggctggtttactcactaacctcagaatatgctctgcttattttcttctctctattattgcttaggccatactcatccctgactctggccctagcctaaagcctgtccattccagaagacccacaagttccacgttcttttaattgaccattttaatggttctcagcagtgtctgcattcttgaactttcccaacacagggtcagattaccatgctcctttccgcacttcctttgccctcccactaactacctcctcatcattttccttaactatctgcacctttgcagtgagatttaatttttcatatgtgaacatcatatctctattggattgtaaactccatgaaggcgagactttgtgtaagcaagagaaaatagggcaaggatatagcatttagcctcacatctatttgatatgtgaagaaaggaatagatcagaaaactgctagcaacagtttcagttagcatgaaacccaaagcctatgacaggtctacaaggcttaaatgatagaacttaatggggcatcttgattttaggtactcaccttgatatgccctcagctctatcaagagcaagcaataaaaactttccactgtaggttgtattagtcatttaagatgcctcaaatgcttctgggaataaggcatgatataataaaataaaggtcaggggaaaggttggcagtcaacttcttaaacatggctactgcagtggaaagtagtatatggtatagcagaattaacacacctgggttaaaaatcctttgaaatttactggcattagaaactgggcaagtccttaacctccccaaggcaatttcccaatctaataatgtggattaaatatttattactcagggttgctgtgaagattaaatgagtatgtatgtatgtatagtatatatacagtatatatatgtatgtatagtatatatacagtatatatacagtatatatgtatgtatagtatatatacagtatatatatgtatgtatagtatatatacagtatatatatgtatgtatagtatatatacagtatatatatgtatatatagtaactagcacactaccggaaagacaatacctcctttagtattcattattaaaacactgccatcaacccatcatcttttccaaggcctttaaagaaagtaagaaaataaatattctcttccctctttaaagatggcatatcaggagtaacttgctgaaacccattgaggactcggacctaaaaacaagattcctaatcatagtactcaatgtacagtaaggttgtctttatggccaatctcttacctgttgcagtgcaaaaaaacatattaaacagtcttgtcacactttttagagtaactgagttttgagacgcattaagagactttcaatttgataaagaaaaagtgagagccttagatactataatcaagctggactcctgtagaaaaaaacaagattccactaaagataaaaggtaaactgttcaacccttgaagacatttgagattgtagccactgcctttgtaattcttcagctcatactattagtctaaaatggcaggaaataaaaacaaaacgaagttccaaatggtaggaaacataaaataacataaataatcataaaatgagccaaagaatgaactcttagagatggaagagacctctgaagtcatctagcccaagtcccttcttacagttgagaaagcagacaacaggagagattccatgctattaggttggtgcaaaagtaattgcggttctgccattgaaagtagtggtacttatggctgggcggggtggctcacgcctgtaatcccaaaactttgggaggccaaggcaggtggatcacttgaggtcaggagtttaagaccagcctggtcaacgtggtgaaaccctgtctctactaaaaatacaaaaattacccgggcatggtggcaaatgcctgtaatcccagctacacaggaggctgaggcaggtgaattgcttgaacctgggaggcagaggttgcagtgagacaagatcgtgccactgcactccaccctggtgacagagtgagacgcgtctcaaaaaaaagaagaacaaaagaaagtaattgtacttttgcaccaacctaatacatgtcaagcttcttttgcctcttcactctgttgtcataatttccccaagatttcattacttcccttgcagtaagcagatcagtcaggaacaggttcgactgccttataatatgggcccaaacactggaaatatccacaattcttgtccctgacagaacacaaagggggaatggtacacatgttctcggatctgattaaacatcaggttcctgagtacacagctatacaaacacaaagagtgggcaatgctgcctacaaaagaaatgcatacttagaggattttcatatttcttccatagatagaaagatccttatgggaccatcaaaattatgtggaagtttctagtggtgattagtttctagtggtattttgagacagtctcctccctatatatcttcatgatgataccatgaagaaaagctgaattagaccctgagaagaagagtatcacatactaggaaaccagttctggtaagtgattaacatgaacttgaaacctttctttgttaactgaaccaaccaaatttcaaatgactgttttcacccaagttcattcctaaacttgaggctttactctcccagtaagttcactgacttatataattaatacatggaaatgcttatgaaaatttaggaagccactgagtgaataaatacattcatttgtaataaatatgtgatacagaaatcaaaccatttttgggtgaaatatattagctagatataattattccctttaattagtccttgaagcttgtccgaatgccaatgttttgggaaaatactaacactaggaaatttatgactacaaatgccaaaaaagatgaagtgatattatactgaattttaaaaagatttcatctttagaacaagagataatatcagggtcctgctctgctttagacaggagatctgaaaatactttggatgccagagcaaaaggactatgtcaaagtacattaaattcttaagcaaaaggcaagaatcaaatctcaaacatctcaagaggtagtaaaataaccgaagatatttaggataaagaagaaagaggcaaaacaggagcagaacaactagagcctttaaataaatacttgcacagcaatcagaaaaggaactagcattgttttaattggtcctaagagaacaagttatcaatggatgaaaagtacaaaaaaacagattttgattgaaaagtaactttctatgttagcctcaaaagtcaataaatattaacagtgagtgaaggatacatttatataaaatagcaaaaaaatgaatccaagaaacttgggcataccaaatgagcctttgacaaaagtttaggcgcacatatggagcatgacactaatccattaagattagtgataggccaggcatgatggctcatgactgtaatcccagcactttggaaggccaaggcaggaggactgcctgagttcaggagttcaagaccagcctgggcaacaaagtgagacctcgtctctaaaaaaaaaaaaatattaataatggtattagtgatgagttatattccgataagtaaaaccaacttccaatttttaataatagaaaggaaggcagggcacagtggctcacacccgtaatcccagcactttgggaggcagaggtgggtggatcatttaaactcaggagtttaaatgagaccagcctgggcaacgtagtgaaacatcgtctctaccaaaaatacaaaaaaattagccgggcgtggcagtgcacacccatggtatcggttactcaggaggctgaggtgggaggattgcttgagcctaagagggagaggctgcagtgggctgagatcgtgccactgcactctagcctgggcaacagagtgagaccctgtctcaaaaaaaaaaaaaagaaaagaaaaagaaagaaagaaaagaaaagaagacacaaagtatggataattctgaaagttatattttataaagaataatctatccatgattaagctactgcagaactgcagatgagaaaaggtgatggactgtcctaggtagtggcaagggaaacaggagtgaaagaatttcaggaacatttcagagatggagctcagagtacttgatgatttattagagactcttggaatacagtattagtaggatttactgtgtcagtttagctatttatccattaacagtaacaatagtaggaaacacatactgtttaccataggtcaagcaatgttgtaaacattttacatggattaactcatttcattctcacaacactatgaagtatatttataaccatccccattttagagatgataaactaaggcttacatcagttaagttagccaataagtatcaagaatcagtaagaggttagatacaagatttagacccagatactgtaattccaaagctaaagagctcttaattgatcaactaaatagttgtaaaggaaagtaaacaaagtcgaaagcaggcagaatgtagtaatgtcaagagcccggtttaatgaagagccacagtgggggaagaggatagcagtttggctgctcaaaatcacatgaggtgttcataaaaaataaataaataaataaaataaatctgtattaaatccaaatccctgcagatgggagataagatttaactttttattttcttttttttttttttttttaaagccctgggtaattttgtggcggaaccaagtttgggaacctgtgtaataaaagatttctaagggctcttcctgctttaacattctagttgacattgtaaatgaagttcccagaaatcaaaggagcgagggagggatcctagctgcaggaaaacggctatgcattcagagtccacaccgtttatgctcccattttactaaacggtccctcatagggggagggatagaacaggcaacggaaagaaggatgtggtatccacgataagcaggctaaaaaagcaggcttttaaaaaggcttttctagcacgatttgcacaaagaaccccttcttgactatatatatttgtgttcatccaactggattttgaggtggattcctcagacccgtatctggctaatgatggatttcaatatattttctctaagcaccccgaagcgttgcacgaaacctctaggttgtggcctgcccgccccgaggccaggtgaatccggctcagcagcagaggtgtctgcaattacaccctctaatcccctactgtcagatatgaccctttccgcacatacctgagggccctctggtaagattgatctcttcctcagtgaccaaataatccactcttccgttcatgttttacagctcgtctggcttcctacttgggtcagctggagtgcagcacaggtgaaggtgaatcaatctcggcgctgcgcccacagcacagcggtttcggtttcagcagcctcgagacccggaaaag

SEQ ID NO: 1460 - DNA, 92010 bp, Homo sapiens; identical to SEQ ID NO: 1459

SEQ ID NO: 1461 - DNA, 92010 bp, Homo sapiens; identical to SEQ ID NO: 1459

SEQ ID NO: 1462 - DNA, 6910 bp, Homo sapiens
tgctcaggaaataagagctgctattattactactcttcatagcataatgtaagggtttccttcctctcatcccagctcggaagcaccttatcaaggtgaactgagccgcttctgtttcttctcttccctctagccaccacgccccttcctttccgccatcctgcccccagtcttagctgcgcccctctcccaagcccggtcttggccctgccctttccctggccccgcccaccagacctgcaccggcacagccctcgctcagcggggcaggaagctcatggtgtagtttcgtgggatcgtggcaaagcccacgtgtttgggggacacgtcaatgtccttaggtgactgggaggacttgaggcggaagttctgcatgacggtggtgaagaagagaaagagctccattctggccaggccttctccgaaacagttccgctttcctgaggaggagaggcgggaggggtggaggtgaagcccactctcagtgcagcctcgccccagtaccgacctccagctgcggctctcccagggaggaagggtggaatattatggcctgagagagtttcagaggaggctctgatcctccctgagcctcaatttctttctataagagatgtaacaatggtgaaccaatattgatatattattactaacaaagtccatagtttacattagggtttactctgtgttatacagttctatgggttttgaaaaaggcataatgtcacacatccatcatagatggggtgatccatgccaggtgtagcaatgggaggtttagatgtcctttcctgccaggtacacttgcaaatatgactgctgtgccgtcatctcctttttagggatctgaggaatctgctgtgtgaccctagagaaatacatctacggggaaagatgtttcctttcattttacctgggcgcaggtactgggtgcttggtagttaaggaagtatcagctgctggctcaagggtagattctaacaggaacttccaagctggagaaataccaggctacaccgcagagaggggaggagggtgagggaggcccctgctggtgtgagccgtggcctggcagcaaacagtggtctcttaccgatggaaaagggcacaaaagcatcactcttcttaaactgccccttctcattcaggaagtgctggggattgaagtcctgggggttggagaagaaactggggtctctcagcacagagcccagcatagggaacacttcggtgccctggtagggaggaggaagttgtgtgtgatgaggagggtcgggggattggtgaaagtacacaggggctggagggggaactagtgtgccccaggtaaggggaagtggcaggcatggaggagttggggtcctctgatggaggagctttgggggatagaaggttcacatctctgaaacaggaagtttgggagacatggggtccatgtccttctaggcaggagtttgggggacctgagatttctgtccctatgacaaaaggccgaatggaaagggggcttctgtttcttaagataggaagtttgggaacatgtgtttgattctcctgacacaaagagtctggagagatgcaggactcaggagtgtctaagtggaaaggtggaacggatgtggtggttggggaagtcttttttgactgattgagggagtgggacagggtctagaaagcttctaatgtgggtgggatgctggggacacagagaggggctggaagtccccgtagtctggggggtgggggcggatagcaccttagggaggaagaaatcccgaaacttggtgtcctttttgactctgcgggccaaactcatggggatcacgtctccaaatctttggatctcgtggatcactgcctccatgtagggcatcttggcccggtcctcaaacttgggctgccggttcttgccgatcactctgtcaatctcctcatggaccttggctgggggaggagggggaatgtgtttaggtatctaggggtctcagagcaggaaatgatagtccgaataggcaaaatggggtggatgatatggctccgcctatgagacggaagtagagcattcataacagaacagacatcagccattcgcattgttggagtaggatcctgttaaccaggttgtgccagaatcacaggggaggcacagggaggaacttaggggatgacccggtggaacgggcagtgggcactcagtgggcttgggacagaagtgactgaccaatcagtgcagacattttcaatattttaatatctaatgagactcagctgatgcctaccagctgaatgttgccctgtctctggacagcaagtcacgtctcagggtcccgggatctgggacaggtggggacattgcaccagtcgaaggggaattttgagggtctggggccctccacttccgtccccctccagccttaccctccacctctgggtgcttcatgagcagcaagaagccatagcgcagggtggtgctgacggtctcggtgcccccaatgaagaggttcaacgtggtcatcaccaggtttttcaagtagaactccgtgttggggttcttctcctcctgcagggagagggggctttaggccaacctcactcctcttgccctcagggcccttctagggcttttcctttggatctacctctctttggttcagaccaaaggtggaaagagggaccctagatctaccagactcgctctaggttccagcccttgccctggctgctggctttgcccaaaatgctcttccttctcaccttctttaccttgctgaccatctgtccttcaattatcaacttagctgtcagtttttttttgtttttttttttcttatactgacttggtcttgctaagttgcacaggccggactccaactcctgagctcaagcaatcctccagcctcagcctcctgagtagctggaactgcacatgcgcatgaccatgcaggctcacttactttttaaacaattaattaattttttttgacacagggcctcattctgtcacccagactggagtgcaatgccgtgatcttggctcattgcaacctctgccccccttcgcgccaccatgcccaactaatttttggatttttagtagagacggggtttgaccatgttggccaggctggtctcgaactcctgacctcaggtgatccacctgcctcggcctcccaaagtgctgggattacaggctgttagccacggcacccagccaattgtgaggattattatgatgagggttaatttgaatgggcctgtgtcatctgcctgccccactcccagactgatttccctctgcctggctttgcatctccccgcagtggctgctggggtgtacctcctgcatgcggatgagaaaggagtcaatgaagtcccgtggggaattgggatccagcgtgcgctggttgtgctccaccttcttggctatgaagtcctccagcccttgcagcaactgaaaggcctgttgctgtggtcctggcaggtgtttcatcaccgaagagaacatctcatagagctggggttgcagagagaggatgggaagggaaggacagctgtcacggggcaggagctgatgggaatgggatttgtttcatagcaaggaaggaactgagttaaaggcatctgtctcgttgtttaggtatttcagtggggccggataggaacttatatctaagttttcaggaaggttaggtaccagggccacggtctagtaatttaggtgagaagaactgagacatatatccaggtttcaggtatttaaacgaggctggattggagcacacatctaggtgttcagatattcaagtgaagttgagttggaagacacctgtccaggtgtttagctcttcaggtggggctggtatgaggtgagtgtcacctgtctaggtatttaggcattcaagtaggcttggttggagacagctgtccagatacttactgggtctggattgggggcttttgttcaggtgctcaggtattaaagtggggctggtgaagatgttgaagtggaggggatacctgttgaggtgtttacctatccaagtgggatgcactgggagcacctctgtaaggtgtgtgattggaaagggttggggaacacttatttgtgtgtcagggaacaatctgtctagatatttatgtgtttaaggtgttggttagggcagctgtccatgttttcaggtatttaagtgggtgaagtagagggcgcttggccagatattccagtgggctaatctgggacatttgtgtagatgtgaaatgattatgatgggctggattttgcagcaccaggtgttcaggtatgcaggaggccggttgacgcagtcacttgtccaggtgttaaaatattcagaagaactgggtagggagcatctgttagaaattacggtaagttggggatgggaacacgtgcccaggtgagagagctgagctgagggtatgcatcctgccagcaggctctgttttggggagcatctgttgagctatccaggtgtccttggagacagggtattggacatccatcctgggttctggtgcaactgtccagttgtccaatatcggggactgattttgaggggacactgtctggagggcggtgggagtttggggcacctgtctccaggtaggggagcagttggcaggttgtggtaggggcgtcacgggccgggctgcagccagttacctgccccgtggaggttgacgtgaactggaagattcctagcatcatgcgcaacagtgacaggaactctttgtccttatagtcaaagcggtccccaaagacaatggagctgatgacattggagactgtgcggctcaggaagaaggtgggatcgatattggcgcctgcgggtatggcgggagaagggggttggggagagagtcaactcagaggtctgaggagagtcagaattccaggaggcagggccttgttgagccaaattcccagcgccagactccagggctggaagtgcgggcgcctttccccacctagtccccatccccaggcagaacgcgcgcgggttcctcgtcctgggtgttttccttctcctgcccccgcactcggggtcccctgctcaccgccagtgccccggagggcgtcgatgaggaagcccgcctcctcctggatgcgctcctcgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaaggggctccccaagggtggaggagagagggagtagggtgggagagagatggattcagcgccattgcccagcagagctgcaaactcagtcagagaaacacgatgtcgaggtagagagagagagagagagagagagagagagagagagaagagagagaggagagagagagagagagagagagaagagagagaggagagagagagagaagagagagaggagagagagagagagagagagagagagagagagagagagagagaccaggtttaaagaataagacaatcagaaaagaaacagaaaggccagacagagagatgcacatagaaacagagggataaggggacactccatggaggaagggaaggaagtggggagagaaagagagtgatggaggaagaggatggagggaggggaagtgagatatggggagatctgggaggaggaaataaaaatggtgaaagattcttaagctgagctggagaagagagaaaaatattgagatagaaacagagagggtctggaaggaagagagactgttaccaggagatggaggctgaagatgtggaagtaggaataccctgaaatcctaagacagaggaagaagtgagaaagggatgcggagagatgagaaacacagagaagcccagaagctaagagggacaaaaagacaaatgaagacagagaaccagggctggaaaacagaaacccaggatgtccttagagatggagagagaggggaaagaggagactccagtgagagagaataaggaggtggggcagagagaggcagggaggaatcaggacagggacgctggagacaggtgagggatacacatggagaggccacaatgaagggagatggggagggaagaccagactggggactctgccttagcctccagttggcaggagagtcagggagaaggctgggaacactgagaccttcgtgtccacctggccaccttccccctcttgggcaccccctcaccatagcctttgaagacccagtcgaaggtggcttgctcgcctcgcccgctgaactcctcagcctggtccaccagagcctccctgacggcatcatgtccacacagcaccacgacccgccggggccccaagtgaatggtgaacacggggccatagcgctcactgatctgatggaggtgggtgggagtggttagagggagaagcctccactctgaatggggcccagcaccgagatgtcatgtgctgggatgcttcgcacccaggttctcacagtcagggagctggacatcccaagatcctgtctttctgatgctgaaactccaaaactccatttcctaagactctggtccacactggtcaaccccctgccacaaagccccagccaactaggcagcccccaccccgtgccacccatctccctgccttgggacaccttcatgagggagttgtacatctgctctgtgttcagctgcaggtagtttccaatgaagggcaatggggtgggtcccggaggcagcttccccttgctcttcctctgctgccaaacagacatcaagaccattacagtcaggcagaccagcaaggccaccagaagcatccctgaggccagcatggtggtagtgggatgatagat
